United States Patent 11,001,841 (CCCTC-BINDING FACTOR (CTCF) RNA INTERACTOME) - sequence listing, part 52

SEQ ID NO: 122875 - DNA, 2101 bp, Homo sapiens
agctcaaatgaaagcctccctccatcctcttgctaccatttttgaagcttagaaatacataccttcccattttgtgaatcttggatccttacaaaatgggttgagctctcttggtagaaattaaagactctcatattgcttgtgatctcagcaaagaatgggagctactcagctggcagcagcacctaccctgttccctgctcaggggttttgttaacagtaaggtcccagtttcctcaatgttttaaggaaacatctgaacccaagaattagcatgaaccccttgcttgaagttgtttgtgtgtttgtgaggttgtgtatctgctttgctttgcttgctgtagtattctgattaagggccaatgttttaagtagcatgatgttatatggttggcagttcagcctagtgatagagatagcacattagaatttacctccttttttaaacgttggaaaaaaaagaatgggtttatgtaacacagctccttacctaaccagtactgatcctctattgatgatggttttctgcttcattgcatgttaaatgatgcatgctttttctcatgaagctgtcacaatgacgaacacttttatcaacccagatggagcatgccaacatggtaattgtgtcaaaaccacatgcttgtctaatgggcgggctgttcacagcagtgttctttttagttgatgataagtagaaagatcattacttaatgtattatataactatactaatgatggattttgggtaattataattaaatattagtcaatgagcattgccagagtttgggaaaccttagttccagttttggcttgcccatctgactttaccatctcaggcaaatctcctggtctttctgatcctcagtttggttgttgataaaataaagtgaggatattagactagatgattgaacaatactcatttagtaagtacttaatagatacctattatgtgccagtctagatgctgggaacatagcagtatataaaagagagatcccagccctcatggagttttcattttagtgggaatgtcagcattccactacaagagttctcattttcatgggtgatagagtttaaaggcttatccacatatgaaagaaactcagggttataggcatgataattagggtgagtggatgtactgtaatcatgttttcttgatggtggtaatttgttcaagaagccattttatcaacaaagaaggtagtgttttgttttgagctctgttgaactcttgaaactgtttcaagaatatgttgagtaatgatccaattagtcttttccattgttttctgtcttgtaacttccatttggatgggtgacactgatcatcacttttgaggctcttaacccttatgggtgttgtgaatacagtggtgattgaggatgacttcgtgaggcttaaccatatggttttgtcggtgctcttcctgtctgtatttgtactttgtcttcagtgtctgtcaaccagctcagttatgattacatggtcaagcaataacgtacaaatgggattttctttgttatttaaattcatctataaatttcttacttttaagagagaatattttgaataaatctgagaatacatttatgttatttcatagtcattttcactaactggcaggaaccttctttgagtactaggccaaggactctgtggttgagtaggtcattcgtgcataatggagctgtgattgcattatgaagtgtgtgtgagggaaggtatacacagctgtgtggttctccattagtggctttggataagtgactactgtttattatttgtaaaacagggataatacatactttgtagaatattttgagaaacagattatgggcactgtgtcagacagtaaacagtgagtggaaacccttatgattaaaatataaacaactattaatgcttttaacataatagtggaaactcaagttttatatttcactgcttctaaaatattttggccaaaaatcagccttagttgattggttcccagactatttctcacagccaaagtaattagagagctgccaatttatcttggttagcttagacaagtatggggcattttggttttaattttaccag

SEQ ID NO: 122876 - DNA, 1032 bp, Homo sapiens
cattgcttattacaatacaccttaatgtttccccagcttgccctggtagaagcagcattcaactttatacaacatgttttttgataaaagctttgtgtttacacgtttgatgtttatatggttctagcagagcctcttggaatggtggtggctgttttaaagtaaaggagagaaaagaaagaagggaaattataggggatgggttaggtagggatagaattttccttctacaaattgagaaagaaatagatacattggattggtaggaaattattatacattaatgtttgctttttaaaaataaagttaaaccataatgataccttccaccacttttaggggaaaaggcgtagatgaaccttttgaccatggaaattctgtgtttaacagtaaattgcattcatttagtgttttgcactttaccagtagctattatgattcttttttgatctttaaaacaatcccattatataggtaggttagcagctgctacttttatgttatacgtgtagctaactggcaacatgggagcatatctcaagctgtttgaggacgtttgatgttccttaaggttaagaagagtagataatttcttgacaattgcccttttatttttggagacttagaattttgggggaggagggaggttatggcatttttcatgagtacagaagttggagcagagctggggagcattgtagatctcttggattcctagtcttagggctgttttgtttcttctggcccttggacaacaatgaagggtctctattctttttttcttttttctctccttaacagtgtgtctccccttctcatccaggcaggacagtttgctacaggaaaaggcattgagattattagtaagaatctgacatctatcctggtgagatcttgctactgatttgctatgtaaataatctaactgctgggccttagatttcccatctaattaaaggcaagaggtagaggtacatgaacattgagatccttttagctctgaactactttgattctttacaaattccattt

SEQ ID NO: 122877 - DNA, 1991 bp, Homo sapiens
aattttatttgcaaacttaacagttgcaataactcgatttttaaaacattaggtgctcttatatacaataatgagtgaaacttgtgtccaatagtttcttttaattcttccctacagactgtcattctccatgtttagctctgttttgtgttaattttcactgccttttcccccctgaaatgcaatagtcctgtagtgtcctactggaaacattgttctctttgttagggctaaagaagtgcctttgtcactcctttgagacattctgcagatgccattttgcagtcctgaaaaacacgtccctgtccgccttgtgctgtgttaaattgtgcgtgtattgtgcttgatattttaatgaagtcgtagagaaaatttgacagtaacagttgtcatataacaaagaaaggctctttcttgatctaatgtagatatgtgttccctgatcccttcgtagctctgtgtggtctgaaagtagatcccccctgcacttagatgtgacctcagatggttgatgctttttgactaccttcataggaaactgttaaaacaacttctgagcaggaactcttaagtcttttgttgatgtgcattgctttttaaagacctcttaatttacatgatcttaatagcgttttaagtggcaagtacactctctaatttgctaagtggctttaatccttgtatgaagaactgagggaaaaatctcctgggaaattgctgtgataaaatccaggaaattcctttcattcttttaaatccagttcaaatctaacttaaagaaaagtcctctaatgtaacagtgtctgaaagcttctcagagtccagtgatttcttgtgtatagtgccaagctcaaagaggaatagtatgaatgtacctctgtgtttttggtaaatctataccacatggcacaataccaatttattataactttgctgggacttagttatcctgttttgtactgcccttaaaactgttaaggagtatagagttaaagggagaaaaccctacatttttccattttaatggactttatttaaatttttgaaaattataacacatgttcagtgcagaaaacttggtaacagaaaaatgcaaataaagcaaaatttccaggtacccacatttcaggaataattaccgttaccattttggttgaacatttccagtctcttgtctgtgaatatgttcacataggttaaagcaacagcattatccttttaaattcacttgttttccctttgcaaaatagggtgatgcattgccacaaattcttaaggtagtagaacttaattttggaagtgttaatctatagggcattcattcattcattcattagatggactcatttgaaagttcacagtttgtagaaagtgtgtacatttattgcctacagaagatgtgcatcagaaagacataggctagtcattttggatgttttccaggatcatataagtgtaacaagtctatattataactcttaagaaggctttgaaacaagtaaagatcagatcacataagccctgacccgtcctggaggggccagctcactgatttccaacaagagctgatctgtgctggcctgactcctgtcatctggggcagaggtacacaggggttccagtgtttgtttatgtctgggcatcagttgggcttgttttatagaatgattccaagctcttggtcatgccattccatctgtgtcttttaaagataaatacacaattggtataggacagatcctgttacagtaaactttatggcagaaaccaactctttatatggatgttcttttgtaactaaggggtataagtgagaggaaaccctccaaggagactcagatactggggccagtccctctccaaagaagagacagagtatctctggctcccttattactctgaggtccagtgggaagaatatttacttatgatatacagataatagaacaggaaaaacaagtttccttatctattcataactgtgctattga

SEQ ID NO: 122878 - DNA, 1970 bp, Homo sapiens
ttttgccaggaggttaggtttctgcctttgctcaggatattctaaaaagctgatctttcagtcagttagctcagtctaaaatttctttgattctctaatatctgcataataaagggttggctaagttattttcttgggtcccttccagatctaaaattaatatgattcaggaggattgtatacccctcccaaattaattttagcatgttttctggagacatttctagtttcttcttgcttttcttagaatttgatacctttttgaagctagtgacccagtaggccaatcttaatccatgagaagcaatcatgcagggtgaagatagtaaataccatgcttcccccattttcttgaaaggaatcttaaaagacgacatgagatttcttactacaaatgtgccgaaataatatttgttccagtagagtgctgtttgacttaatattacaataactttattgaatcattaagatggttatcttggataatagaaaagtaagattataatgcctagaatggtttgaaaacttaggcatgctggatttttcttattgtttctttctgcccaacatatattaagtagaactttgtgcaaaagggtatggttggttgctgtggtgcatacagaaataagtaagacagacttgcttggtaaggtggataagatgggcgcattgggcctagagtgtagaaaagtgctgagctctgaaagaggggtaggggacactaggggatctgggagagagaagaacagcattgagctggggtaggcagggaagtctggcaaagtcatagcctggtaactggactctacggtggtgctcgtcattatgggcattctacttggttggctgtcttttgagaagaggcttgaggattgagcctggagacagtggctcttacctccagaatgatagctttcatcctgggcagaactgagtagaaaggctggaaaaggagagtcaggccagagtgtggaggactctattcgaggtagaagaattgctttctgggtttgctttcctctctcagtggagtcactgaggtttcctgtacaggtgaatgatatgatcagaactggagttcaggaagattagttgggtagcagtgtcctgggattcaaagtaggattgacaatttatgaaacaaatagtcatagggagaaaaatttacctgttgctaacttatttactggttttatttactgtaatcagagtctactgtttgtaactatggctgaagttgttttttcacaatatagaaatcatcaaatagtttttcagagtactgtccactgaagataactaagcacatacacctcagataaagtgaggaataatcagtttagtatcctgattatcatctttccccatccagtctattcagatatgctatttattttgtaattaatcctaactctcatcattccttctcttcgtttttttcctaaggcattcttaagctactcttttaacagtgttttgcaagtgttacttggttgatcttgggtgggtgtatcccaatttcccctacacccccaattcattaagcaactagctccatttttgtatggtgttataggaaagttcttgtcccatttttgaaaagaatttgtccttaatccatgtgaaaattatttgattttcatagtcttggaattcaaaagatcttggaaagaaagtcaaagtctcatagctagtaagtgaaggagttggaattgaaactcagatctgtctgatgctgagctatgttatatctctaagactcaatttccttacttataaaatggagtcattggtagtacatttctcatagagtggtcgtgagaaattaaatgaaatgatacacatagattgcttatcataatactgttattgcttgtttataaactaccttttaacaggaattatagaaatacagtgcttatgaatcaaattaattcagttgataagtaaggttattttgtgatttt

SEQ ID NO: 122879 - DNA, 2312 bp, Homo sapiens
gtacagggcttcctaagcagagccagtcaaatatgagtgtgttttatgttcaacagcgttgggtgggctcagagattcaagctgcaagctgcattccagggacagttcagacccatggctggtaatgacatcacctccacaggtgccaaattattctcctctttttttccgatataacctgcccatgcttttgaaaaaaggaaaaagaaaatgtttaagtactactgggagattttgttgtgaaaataagtatgaaatccaattctgggcatgtgtgtagaagtagggagatgacaatatgatggtttttgaaaaccatacagttccagaaattccagttttaggttacttgcgttcagtcactcccaagaggtttttgtgaggaggggtggggatggagaaagggattttagactagatgagaaaagtagtagtggaaaaacaaaactgtggttttgccctttctcttttccccctaattgaagactgggcttacagtgtttctaagacaactctgattggcagtgtatttcgaagaggctgaagagctctgattgaaaatgtcaagcttggattcaaaggattggatctttttatatgtttattgactacaattggaaatagagatcataaataataaaatgagacctggcctcatttccaccttcactgttaaaattatatcgtttttatctttgtatgctacattcatggcttatggaataaatctttaagtaaacacatatttttgtacatttcacaaagtgaggctcgtattctggttttgttgtcatttttcactcagtgttattttgtgtactctttgcagtgccaagtgatttttttttaaatgtagaattttataactaagtgacacttaaaaagagataactaatccctcctgctttaattttactgattaggaaatttagtaaagtgaaatcaaataacttgcttaaaactactattattttcatagctggaattagaattggttccacctattccagaacatttttcactataccattctgcctgttttactttatctactgggaaaagtttataaagtattgttttcctgtaggatgacttaaaagatcattgaccccgagggttaaatccatctaactgtaacgttgagtgaaaaattgagaccacccaaacacagctgtttagttaatttggcccaagcgattggaagaagtttgaaaaccattatgatgtggctggattgttgccattttagggttgtttgatgtgaacctgaaagaaatagaggttaaaaacacacagtcatatctgaagtatttctcttccaccatattaaaactaataaatccattaaccttttaaaatgattttgccaaagtaactatcatctcacatgccagattccttttactctggaatgtattcacttcattttgctgaattcctgtaggaattcgtagctgtgtaattcctttagcaattgctcatacacagacttacggcatttattctaatgtcaccttgaaatttgacctgtttattaatgttaactttccatgaggttgtctgtgttagcggtctaggttatcagctcctcagggacaaggctgttgtattgccattccccttctttcttctctctcccctccactttccctcgactccatagtgctagcagagggccttgtacgttctcagtattattgctaggactggtgaaaaacgttctgagtgcatttggggctaatttgaggacaaggtctcttctctgtgtgagtttatagttgtgctggcactggtgatcgaaggaatgcctctgaaaaaaaagcaagtctggcatgattggcacactttgaatcaacaggtagttaaagttctttttgaggcagtaatcatggcttcagactcacctttatttgcatttgactttagtctaaatctagacaaatctatatgtgacggctcaggtgaatttggtgagatgagaaggaatgtctgaaaaatagatgattgagaatcattagtttttgttttgcttggaaatattcttccacagaaatctttagaatattaaatttggcatcctaaagacttatggacaattttgtgcatttctcggctttctttatcttgagggaagaattgaagctggcatgggggcaatggagaaatttagttttgaaagtctaaggagagcagggaaaaaaggaagtaactttcgttgctaggatctacttataggtagggaaagaaggacaggaagaaagaatggaaagagatcaagaaataagggggataaacagccaaatattagggtg

SEQ ID NO: 122880 - DNA, 1100 bp, Homo sapiens
ggagttcgagaccagcctggccaacctggtgaaaccttgtctctactaaaaaatacaaaattaccctagtgtggtggtgggtgcctgtaatcccagctactcaggaggctgaggcatgagaatcgcttgaacctgggaggcagaggttgcagtgagccgagatcgagccagtgcacttcagcgtggttgacagagcgaaactccatctcaaaaaaaagaacaaacaaaagaaaacctaacacacaacaagaaggacttctttttgggaaaggaaagaaataaggaaggagaggaaagagatgcaccttttttttctggctgaggctatctgctgtcagggagaaggctttttgagtggaagggttggggctggatttagcatgaactcctccccaagcttagccttgagtcttgatcagagtgatcacatagtcatttaaaaatgttgttttcattaaaactgggtgtgtttactgtgtatttgtgaactgcgttgggatgtaaatatttccctctgggtcacagttggaaaaaattgaaagccagttcttggtgcatgaccgtgggaatgggtaactgagatagtgagaaaaaacaggattactgagatttgccttttaagtaggaatgcatacacactcgcatagtcttctgccctgtgccttatagaagggagcaggaatatgggtaataactaagaaatgtttacatttggaatacattatacatgtgaaggcttggctttagattctggctccccccaacactcccctttccactgactttaaacattctagagtggtggggaaaagcatggcccagaggtattggttgaacttctggctccacacagatagctccagcttcattgtcagactgggaaaaatagattagacaaatgtcaggttctagggcatctctaagatcttgtgagtctgtaaaagctgtgcaatgaggagaggggactttggatgtgctttgggtcacagggagagagctttctgggacatagctatgttgttgcctataaaccacatcaccagcagtagataattgaaaactgactactttttagaggtttttgaaggttaaaaaaaaaa

SEQ ID NO: 122881 - DNA, 1009 bp, Homo sapiens
aggtctgaacaatctgtagtagcttgtggctggaaaacaacttctgtgaggcaaaaacagcaactctaaactggctctggatatgtgtgagaaaatactcttttttctacttgattattaggcttcatagaaaatttcttttataaagtgaatttttaatctcaaccccttgaaaatggtattttagctgatttggataaaagtctggggaaatatatttggagtgagtgcaagtgggaaataatgtgatacttaaaaaaaaagtagcatttatattttgcttttattatagccatgtgcttggttggtaatccatgtttttctcctgcctttagagtgaagtaaattttggcatcttaggcatgtattttacaggattgggtcttatatatatatatttttttttttctttagttaactgattagaagtgtgttttcttcttagttcctcttgggcaatgtcttccattttgtagtaaaaacatgtttacaaaataatatgtgtaactactggtaattgccatttattagtacttacagtgtgccaggcactgtgctcatgttcttacattggttacaccttttacttctctggataggggaaatagcttagagagggtgtcatgtagttagaagatagttggaaccgggatttggagtcctgtctatgtgttgctaattattattaatacaaaatagttactattacaaatgttcattttgtagaatcaaatcagttaaagaagattcttgtagaatgggcttggatatgtggaatgaagatagagttggtttgacttggttttaatgtttttactaaactctttctttgttgcacttccgccatgcctgagcacctgtgtacctaatcatttaatgtaattttgtggtctcagttagcaattagcatcacatacactcaatcatgtttttatttaaatgctgcagactttgctttgctttactttgttggacttaattttcattttttttccctcttctattgggg

SEQ ID NO: 122882 - DNA, 1119 bp, Homo sapiens
tttttgaaacattctttttactggaaagatcatttaaaaacatgattattttaaaattccacagaataattttgctggaaaaggtataacagaaaataactgaatggaaaaaaatcacgttgtttcaaacaattatcccaagccagcttggaagttacagttctcttctcatagaagatttctttagccacaagctactgggaattgttcagcccattggcagctacacagaacattgcccttttcaccctgtccagcacacaaacctagacgattcatagctggaacctatcttcaagaaagtgatggctttattgaagccaaatgtccagactttttcatttagacacatgaaggaccttcagtgcttttgccatataaaagtgaaccacagagacattcttaaaaacaacacccggaagcaaataaaacacctgaacttactgtgtgcaaattacagatgcagacatagcctatttggcagtaagtacatctctctgtctagctcactctatccctcttcagtactagctgtgtgctttttaatatagtaactgtacaataaatattagttgaatgtaggtggaagtaggatgagaatgaacagaaatcagtgaccaattctgtatttttcatctcttttgttttttagaagagtccagttttgttttaagatgagtgttctaatagggtgaatttaaaaatgtaacagtagtaaagagattccttaattgctcatttagtttgatttgaagtaaatcttccccaggctgaagttttctactgtgggccaggaaacccatgtttaaactgtgaactcgagtgctttatcttcttatgccagacctctggataacgttggcctagttgttctgttgttgtttacttattcgaaagttattcttgtgaagatgtggaccattaactcaagaaatctctgtttttactttttggtgattgtcttacaggctattttatgatagtggtgaacagcacacaaaactccttcagaccctcccaagtgagtttccaacacagactctttcttcttgctctttccacagatgctttctcataagtagtatcgattacagatgtactttgatgatgctgataagc

SEQ ID NO: 122883 - DNA, 1048 bp, Homo sapiens
agccatggcttgcttactcctgtacttgtagtcagaatgtacttgggtctgttctagctaggcctttaggtagccttggccaagtggcaatcctgttgaaaatagcctatatgctacaaggattaaaaatctagattatatgaaaaactgttacaaattaataagaaaaaggcagataacctagtagcaaaatagagcataattgtacacaatgcagagaaatggaaactcaaatggccaataaccctgagtctcactagtagttaggcaaatgtaagttaaaatggagatgttttaataaccatcataatatgagtataaaaataccagtgttggggaagattcattgttggtgagagcctaagttggcataaccatcttggagaacagtttggcagtgtaaaactgaccataccatactagctagcaattgcactaggtatgaactcttgagattcctgtacctgtaggtgaagggaaactcagaaggcatgcttattgacacattgataatagcaaaactttggaaccaacctatccttcaattaggaaaaataaagtatattttataatgaagtactgtataggagttaaaatgagtgagctgcatatgaactacatagagctacatatattaacataatgtactaaaatacaaaaaaactgtgaatatggtgagaatttatataaaatatgaaaacaataatgaaactatgtgaagtactgttatcatccattgagagatgtgcaaactctgataaatgatttctactcatcagtgaattttctggaagcctaaaaattgatttttaaaatccagccaatgttagtttgttttattcccaacaaggttttacttgctgggatactgaaaccactgagctgctcctagtccagtggtataatgttaaaatgtaaaacactttgcaaaacatgtttatgtatatttttatttaagtattctaataactttatgagataatatgacaggtaggatttttattgtaactcaaattaagtgatggtagttggacttgaacttaccatt

SEQ ID NO: 122884 - DNA, 1301 bp, Homo sapiens
tttaatttctggaattaatttggcagtttaaaaatagagctgtgatagttctaatgttgaatcctttctgcgtgtttaaaaaattatttctatagaatgaaattgtagaatgtaagtatagcttctgaaaggacagttattaatgtgctatttagccaggtggttttcagaatttgactagtggaattaagcatgctttttttttttttttttttttttaaacaaatgctgaagtagggtgggtgtgatattttcaggtttttgcaaaaccctaaactgttatgcttttcagtcctaagcaaaacagaaaaaaacatcagtattcccttgatgcttttcccaagtatagcccactaaaggaggaagttgtaaggagacaaagtcttgtatttccttaccagaattttgggaagtagagagatgttagggaggaaaatacccatgcaaatatgaaatattcaagatttttttccctttagcattctctgtccattgttaccactgatgagttatactgagtggaagatgggaaggttgaaacgtttgctatttgatagaagcaattgatctcctagagagaattgtggtagctttgcagaattctttgtaaccctctaaagccaagttgatcagtcattttggtgtacccttagtaatctggctattcaaaaatgcaacaagggttttatagcatttgtatgtatacatggagataaaaggaatgaagacatggcaagtgtagattattttagagtgagaaatgttgctttagataattattacttagagcatttgagtcacctagttacccaagtatgattggaggtcaataatgaagtgaaaaacatgtatatataaatacatacttatctgtggtaggtaatgtaccctgaagaattttccatgaaactggttttatgcgatattaatacatatttagataatttggtatatgatttagagactgtatgatctttttttcttgtgatgatgggaacaaaaatcttgtgttgtttgagggctacttcagtgaggtatgtgtacttagacaatgtagtattatagtgttcaaagtatggaatcagatttaatgatttatcatatatgtaattaacattttctcttttaaaataataaaacagctagagtcaacttttcatatagtctagtatgtcccgagcaccagacattgggatatttttagttcattgctttattccttggagagcaaaattgttgcactaagggatgacccaatccattcgtgacaaataaatagaacatggccaggtaggctcaga

SEQ ID NO: 122885 - DNA, 1018 bp, Homo sapiens
aaaacatatattatcagagcttcatggtcaaaagattcattttatagtgacaattactatctcacaggttggattatttgtttcttttggttgtaaatgtttacaattctactgaattttcagctagtgtgcttataagttattttcttttttgtgtggcaattcatatgacagaagaattgaatgaggaaattaggaagttttgaactgtcacatttgctaggagttggatttaatttattattagtaaaatttccagttaaataagataattctaatatttataggttactgtgtattctttcagcatgctccttggtacaaaactattcaattgaatttactaactatatatgattatcttggagccttttttggtactctatcagctgtttctatggtaattttttgttcattgttatcacttatagcttactctattatggctttttaaaaaaaaaatctctgtatattttcttatccttacttgtttgcttacttttctaaccattagtctaaattgacatttaggtaaatttgcttttaagttgaatacttaagccaatgattcagtcattttgtcttttctggggtgggtagtgcctactagacatttaattgtgctgcattttaatatttcttaccattcattataaactttttttttttagacaggctctccctccgttgcccagactggagtgcagtggcaccattttggctcattgcatccttaacctcttgggctcaggcgatccccccaccttagcctcctgagtagctgggactactggtgcgtgccactgccatgccttgctaatttttgtaccttttttttttttttctgtagagatgggattttgccatgttgctcgggctggtcctcgagctcctgagctcaagcgatctgcctgccttggcctcccaaagtgctgggattacaggcgtgagacacaccatgccctgcctctcaatacactatttaatacatcagaccctttggtacctctaggcagag

SEQ ID NO: 122886 - DNA, 1026 bp, Homo sapiens
acaccttgtagtatgttcagaaactggcatgctgactttatggttctccatattcattagatgttttaacagtcataagctctttctatgcttatgtcttcaagtaattgttggtgatgatagatttagcccttcagtttcattttttattgtggtaaaatacatataaagatatattaaaaactatacaaaaatatgtaaaaaatttgccattttaaccatttgtaaatgtgcagctcagaagcatgaagtatgttcacaatgctgtgcaaccatcaccactgtctatttccagaactttttcatcatcacaaacacagactctgtacccgttaaacagtaactcctcttcctttttccttgcagccccaggtaacttttattttactttctgtttatatgaatttgcctattctcagtacttcataaaagtggaatcatacaatatttgtctttctttatctggcttatttcacttagcatagtgttttcaaaattcattcatgttgtagcatgtgtcagaattttattcctttttaaggctgaatgatatttcattgtatgtatatgtcttacttatccattcatctattgttggacatttttgtttctaccttttgtctattgtgaataatgctgttatgaacattggtgcacaaatatctatttgggtccctgctttcacttcttttgagtgcatacctatgtgtggaattgctaggtcatatggtaattcttaaatttgtggggaacaaacagacaattctacaagggatgtgccattcattctatattcctgccagcaactcataagggttttatttcctctacctccttgcctatacttgttttgctccttccttccttccttctttccttctccctccctcccttctttctttctctctctcctgtctttctttgtctttctctgtctctttttttcttttttaaatcatagccatcctggccaggcacagtggctcacgcatgtaatcctagcactttgggaggccgaggcagatg

SEQ ID NO: 122887 - DNA, 2122 bp, Homo sapiens
ggttttcaaagtataaagatgaataacatttttgaaaaaaaaattaccataattatagctgagactaattttttcagttttattttcttaaagcattttataagcatttatatgctttagagccactttttttcaaaccctgggccctgtgtaagtgagtcatatcatctaaggcacagctcatatgtcagcttttctaagtcttttctaactcccacaagtagcgttaatacctctgtcttttgtggcacttaccaggttggattttgaaatccttaaaatgtcagttttctccgcttatataaatttttccagggcagcagccctaatttattcatgtattcccaatgatcggcatatactaagcttagcgttctgtagatgcttgtggaatgatgaaaaccggtaaatgaaatgaaagttgtaataaagttcagattgtttaatagtttgcttgttttggaataagcaaatacattagctgcctttggcaatatttttattgtacagaaatttctgaagtgctaatcgtaatgtgaattggcttatagttgaatttgagacagattcttcaatggagaaggtggaggagatcagctcacaacttctgctttgcaacctaagagcgacttacccaaccatacctctttcctgcccctctcagtggaaaagatggccttgtttcagtctgtgcataagtacgcttatcctggctgtgccctagaattctgtctcatcacttctggcctattctcagatgtcctattagttaacccataactgtttttttctcctttgtttaggcaatggtattcaaccctggcttgtacaatagaaacatttggggatcttaaaaaaaacctgggcctcaatccagataaattgtatcagaatcttagaatcatagttggaggagataaaagttattttatgaaggaattgagacctagagactttaggggacttttctaagctaatgcttctaattagtttaaaaacttgaggcaagaactgtggttgccattcccatcccattgtcccagaatcattgaatcccattcgtttgatttctccttggttttcatcctcttactcttccttttcccagtttattctactctttatgctgtttttttattacatccgtcttctgctctttaagatgctattattgttttattatgccactctcttgctcagtaacctctagtagctcctttctacctatggtggaggtaaaaatgagcagttcatgttttctcctcccttttcccccattggatcttatgctgtagctaggggatcgtttcctgacttctatacagctatatatttttgagaattttacaacattccataaactgtacctggaattccttcctcctttcactttgcctacctggttcctacaccaaataacagaatgttagctctggaagattataatcatcctttaagtcagtttttgaaattacaaatagaaaaattgagaccctgaaattttaaatgattccccactgcccatcacccaggtcacaaagcaaattagcctcagatccaggttataactaatgtctctctgttcacttttcactttgaagatgtaactgagatttgaccgtttctctcaaaccttctctaatcaacttagagggtctattctggcctccaaactttggtgccattttttaaatcatgggagcatttgtgctttctcttgtagtaataattagcagtgacattgctaacctctcacttctgaactctggactgttaagcatattgcttatctcatttaacctcacaagcacacatagatattgttatccacattatagaagtaaggaagctgaaatttagagaggtaaagtcttaaagggtcaaagtttacatttgaatccaggtctatctggtcacagaactggactcaataccctgtattgtaatcttttacacagaaagtttgaaatgtaaggctctggataacaataaataggtcactaaatgtctttaaattttctactacatcatcccagaagagctcagtaaatatttattgacttcagttggaaagatcataacttttgactgcatcttgaaggtaaaggtgttggtgtatgtc

SEQ ID NO: 122888 - DNA, 1463 bp, Homo sapiens
gcgaaaccccatctctactaaaaatacaatgaattagtcaggcgtggaggtgcgcacctgtaatcccagctgcttgggaggctgaggcatgagaatcgcttgaaaccagaaggcagaggttgcagtgagccgggattgcgccactgcactccagcctgggcaacagaacgagactctgtctccacataaaaaaggctaaaatggttaattttaggtatgtgtattttaccacaattctttaaaaatcccattttatcaccattttgctattcccaaagagataactgattcaggtaaaatcaccaatggatactaacactattatgtcaaagacgtcaaggaactaactatttgtatggtaccaacatctcactcctcccagattatatgccagtatcaaagggaaaactataattttacaacagggagatctgtcatcaccttactcaatcttagcttcactaatagtgagataactgcattatgtggtgcctgatatgaagcaatgtaaaccatacaaaattggctatgaaaatacccttaccaaaaatgtttgttctgaatctaatcaagaatttagatctaaattctacttacagaaaatacagagtttagacgaatgaattaaataccctcacatagaaacaattaagccaaccaagaaaaacaaagattctccaagacctgtaacatcttgcatctctccaacagttcaccgtcatgaaaagggaatgaaaaaggaaggagaagaactattttagattgtaagtgacttaagtgacataaccataattaaatgcaatccttggcaggatcccagtttgccaaacacactatacaagacatcacgggaatgactggagagactttaacatagcacagatattagaaaatattagagaactactgtcaactgatataatagtgtgctggttaaacgggaaactgtccatgttttttacaaatacataacaaaaaagttagggctgaaatgtgatgtttcataatttaaattacttcaggaaaaaacatatgggaaaaagttaatgtaaggaaataatgtatctaggcaataatcaccgatggctgttaaaaaccattaggcaaaaaagcttaatgggaaatcaagcttttcccatcagactgatggatggatcagtccagctagaaacacctgagctcactgatcaatcttcatgccaaaaagaaaactaatcctatattgtatcacttgataggaagcagtaagaaatatacactgataactaggaaggattctatactcctaactcccaattaatcttgaatctgagtaagccccagatctactaccaatttataggaaattcagaagggagaaacatactaaacagcaccacaggcagggatgcaatcaacaaattccagaatgtgggaaactctatagagcaaacaatagagtttcaacaaatcaattgaatata

SEQ ID NO: 122889 - DNA, 1131 bp, Homo sapiens
aaagcttgatttcccattaagcttttttgcctaatggtttttaacagccatcggtgattattgcctagatacattatttccttacattaactttttcccatatgttttttcctgaagtaatttaaattatgaaacatcacatttcagccctaacttttttgttatgtatttgtaaaaaacatggacagtttcccgtttaaccagcacactattatatcagttgacagtagttctctaatattttctaatatctgtgctatgttaaagtctctccagtcattcccgtgatgtcttgtatagtgtgtttggcaaactgggatcctgccaaggattgcatttaattatggttatgtcacttaagtcacttacaatctaaaatagttcttctccttcctttttcattcccttttcatgacggtgaactgttggagagatgcaagatgttacaggtcttggagaatctttgtttttcttggttggcttaattgtttctatgtgagggtatttaattcattcgtctaaactctgtattttctgtaagtagaatttagatctaaattcttgattagattcagaacaaacatttttggtaagggtattttcatagccaattttgtatggtttacattgcttcatatcaggcaccacataatgcagttatctcactattagtgaagctaagattgagtaaggtgatgacagatctccctgttgtaaaattatagttttccctttgatactggcatataatctgggaggagtgagatgttggtaccatacaaatagttagttccttgacgtctttgacataatagtgttagtatccattggtgattttacctgaatcagttatctctttgggaatagcaaaatggtgataaaatgggatttttaaagaattgtggtaaaatacacatacctaaaattaaccattttagccttttttatgtggagacagagtctcgttctgttgcccaggctggagtgcagtggcgcaatcccggctcactgcaacctctgccttctggtttcaagcgattctcatgcctcagcctcccaagcagctgggattacaggtgcgcacctccacgcctgactaattcattgtatttttagtagagatggggtttc

SEQ ID NO: 122890 - DNA, 1761 bp, Homo sapiens
agaaagaatgtaccattatcagttacagaaaagtgttcttcttttttaaactttttactatggaaaattttcaatatattcagaagtagagaatagtagtataatgaacctcgcgtatcctcgcctggcttcaacagttaccagtcacatgaccagtcttgtttcatctgtatttccctttgactccctgacccactctcatctttattttgaagcaaactccagacatcatataattttatttgtgaataagtgagattcccctgctccccttttcttggcatgtacttcttggtctcccaaataaagctcatatttattacggattttgtggaataacagaaaatagatcatttgtgacatactgttgtgatgtttttggaataaatatctgaatattgttttagtcagtaaaagcagtttcacctaaatgtagcattgtggacatagagaatgctttaaccagtgctaaaaacaaggaacataaaacaaaaaatacaacaaaaaccccaacaatttctaaaccaaatctgaactgatattcaaattctagtatgttctcaaggtaatgttaaagttgatgttgtataattttttttcctatgaatcctgcttatgtttatgttagattttattgtttttagatttttcttttctttttttctttttttttttttttttttgagacagagtcttgctctgtcgcccaggcctgaggtacagtggcgcgatctcggctcactgcaacctctgccccacagattcaagcagttctctgcctcagcctcctgagtagctgggattacatgtacccgccactatgcctggcttatttttgtatttttagtagagacagggtttcaccatcttggccaggctgattttgaactcctgacctcgtgatccacctgccttggcctcccaagtgctgggattacaggcatgagccaccgcgcccagccgatttttcttttttcttttcttcctcccaccctgccttctttcttcccttcttttgcctaacgtagtttagaggcaatatgttggaactagaccaagcaaaatattcttttttagctgactgaattttaatgggactatacagttataaaaatcaaagcaacctgtttgtatatggttctgtctggcagtatcgaggggaaggtacatgccttaaacattgatgatacactaatttagaaatcgttgtgtaaattgttggcattatagctgtagctgacaatcacttaatggtcgaagtgcttttcctaaataacaggcaggatttttatgttggagatagtttattttatatattaatttgtactttcaattaagatgtaattatttaatataatttccttgcaaagacattgaattataaaatattgataacaataagcaccatgttttgagtacttaatatatgtcagacactgttctataggcacttttatttttaaatattttttttagagatggggtcttgctgtgttgtctgggccggagtacactgggtactcacagatgtgatcattgcatactacagccttgaactcctgggctcaagtgatccttctgtctcagtttcctgagtacctgggactagaggtgtgtgccaccatgctggttatctataagcacttttacatttatttatttatttaattcttgtagtaactctttgtggtaggtactattatcctaagtatcctataagaaaactgaggcactgcagtttgaagtaacttgctcagggtc

SEQ ID NO: 122891 - DNA, 1096 bp, Homo sapiens
gctgggattacaggtgtgagccaccgcacccggtccccatttgatttttaaaacaattttgtaccacgggtctgacaagtaagaagagcgaagagtttaaacttaaccaaagtcctggagcagttactaatggagcttcaggcacagccaaggtctcttgtgtccagagttgttccctctatactgtgcacttttgccagttgaagttttcttggaaaactcaggaagtctgccaagttttgtagctaaagagatgtcctgtagcttttatatatttgtgtcttgagccctgaaggtagacagagctcagtcttccaaaaatagttcaataaatgtgtcaacattttgaaatactactgaaaaaacaagtaaaagtcctatgggattattggaaaatgatgccaaatgcctccacaagtatttgaaaagcaaatgtggcagtggttatacgctagacaatggttcatattcagccttcgcttttggggaccatttttattatgataatcttttactgtttcccagtactctgtttagttgcttctagactctggtagaaaagctactaagtgtctacactctggtagaaaagctactaaatgaacatcttctttggaaaattttctttaatccacttctcttaaagagaaaaaggaaaactttttttccttaataaagtgggtgaaagttgtgtatgggaaaggtcagaatgtcaagtactgagttgggtctgtccactgcaaagaaatcaaatttatccatgaacttgtaactagaactgtttctggatcttggccattgaaatcaacatcagtaaagcctacatcttaatttccttaatgccaagattgtctgttttaaattatacacatatgggaatgtgaatacattcgtcttcccccacctccctctgcccgaaaacaggaggaaaataaaggtacgttgaagatattctaaacttttgcagctctgcaatgaagagctgtggatgtgggctgcatatgtggtgcagatgtggctcctaccaattgaggtcattttaccttcatcttcagtgctgcaagcttaaatcgaaagagggtagattctagaatag

SEQ ID NO: 122892 - DNA, 1007 bp, Homo sapiens
aaagaatgagggttatgatcaactcagtataccactggaggctatatgagtaagcaacaaaatgtttctcataaatgtagaatgttggcaaactgacaaactgtgtatgccacccagaaggaatgctgaaggcagtcacgccccaagtgcagtgtttcttgtgattaggtacatctgaagcctgttagtaacaatatgaacctgcgatcagttaagcagctgaccagttgctacctcctcctccctgttcttgttacccaataaatacgaagggctgtggagctcaggggggctgcctttgctgactagaagcagggagcttttcttcccctggcctttcctttaaaacagtttctttttttttttttttttttttttttatcatttccatgttcgtcccttcgtcccgtctcctaatgagggtctcaagtagtaacagtagtaactgttgtagtgatggtctcaagtagtaaccgtgacagtctgccacaactactttcactagttttggttttattttctggtgttttgtctctaaataacatgattttcttgtttcttgattttttttttaaagtttcagaatatttttatgttttattatttgttaaaatttacttgctgggcacggtgattcatgcctgtaatcccagcactttgggaggccgaggcgggcagatcacctgaggtcaggagtttgagaccagcctagccaacatggtgaaaccccatctctactaaaaatacaaaattagccaggcgtggtggtgcatgcctgtaatcccagctgctcaggaggcggagacaaggagaatcgcttgaacccaggaggtggaagtttcagtgagccaagatcgcaccatagcactccagcctgggcaacaagagcgaaactcctcaaaaaaaaaaatttatatttttgtgtgtagatagttgttcaaattgatgtttctgtagggggtgaggttagcagggcgagtggggcagagaagcactagaaaagccta

SEQ ID NO: 122893 - DNA, 1804 bp, Homo sapiens
tagggtagttcatgcatttaaatcaaatctttctgaagagaccagtttcctcttgctttgctcttagggcctcaccatcaaccttcatgaaagaattttcaaatacttaaaaacttatgttacccttcagttgcctttttccaggataattgtggttttaaaaagcttgtcatatagttctgattaccaactctgaagtcaccttttccaagcccttgtatttacgtttccagacctgctgatgagcttcagggctgggccattataacaacagtgctgaattcactcatatttttcagagtttcctacattctactgatatatgtacatatcccagtagcttgaagacataaaattaaaatgtgatttacactctgccataattctttgtttctttctctttttgtccagaagctacttgtttttcaccctagattcatttaccttgagggagattatttggttcagactcctgacctggggtggagagtggggttcttgggcctcatgggtgcataaactgcctgagactgtaagtgaggtattgtgttcccatgtgcatgcactcctgtgtgtgtgcagcatctctgtgtgtgtgtgcacaagtggatgagagagacaggttaagggagaaagagaactttaggagtggtttttgaaagggttttgggaaacagaaaagattgagaactgatgtttcagttcttattttcgagattagaagatggaagttttaagagtattttgtttttctctttttttttaattttttcaccctattgcacttttcatcatttattctcccctatctcccattgtacttctttccattcaattgaattcatttagttgacccccatttacctaactgtcaaggttaaactgaattctgatataatcctggccactcatattcttacctgtgaacttaatgaatgtgcatttatttccttacaaatttctttgatggaatattgattagaaggaatcagtaacatgtccactctatttgatgctggttagactgccacatatgccattgtgaccttgggcaaattatttctcaaagcctcgtttgctgtagtaaggggttaaaaatcatacctacctcagagttacatgaggattaaatgaactaatgcttataaaatgcttcatagagtgcctggcatctgtaaaaattgttaggttaagaagagacctagtgggttggttactggtgaatatgtggtaagcagattttttgcagtggtcaggaataattatctgtgtggaagtacagtctttgaaatgaaacagtaatttcctatggtgatcacaagttaaaaccactttttaacaatttcagtccagtatctataatgtttgagcttttagaaactcttgtcttaacttcattctttttgttaatttacaaaagagcatatatatgggaaaacagttgggatctagtttcaacagcacagggataatgtagtcttttttgttatgttgccagaggtaactgattataaatgtaaaattgtgtgcatatgttctaacttcttctctctataaccacagtaaacttgttgaaaaaagcctattagtgagtagaatttttgttgacaatgtttaaacctctgcatatggcattaaaatgtaacctttataaatctttgtgtgaaatatacctgcacacatattttccagcaacatcgtgttttaacttgttagttgccaacattaagaaatcaggtttcatataaatatccttattttaggctagaaaaattagatgatggtgtagcacttggtccactgg

SEQ ID NO: 122894 - DNA, 2870 bp, Homo sapiens
tgaacttcttgcctctgaaatggcatgtgtgtgccaggcgtcttgttcctcttgttactgttatttaagctgttttaaaaaaacgactttcgcggttttcccctcagtttttcagtctttatttcctcccccaccctacgtttttattgtttttttcaacggaatacattatttatctggtctctttataacgctgttgagaattagcatttcagttggtgttctgtcagatttcaccttggacttagcagttgagggaaactgagtcagtttctatgctgcaggggctaggatttagaattctcaagctttgaacaggtttcagtgggggaacgaatagtgcttaatcctattcagtttccctttgcaggctcattgctgtgagaaatcactgggtggctgttgcagccactgatgggggctgcattgcaatgcaatcttgaattgtgataagggccaactggctccatccgttaggctgtgagtttgacacaacttttgaagagctatgctgtgtcacctgtcagagctcgagtggtcattcttttaattcaatttaagaaccaccatcaaacttcagatatctattctttggaggttattggagaactgtacaagtggtaatggcttggaacaatggtgtggatttagcgctaatttaatcctatcctgtcttcctcacttcttgggcagaattcccactgaagtcagtagtggtcttgtgtgcagacagactgccgagaacaagaggctgctcatttagagtaacgggaagggacggtttctttccttttaaaacatccctctgtaagaaagacttagtcataacagttctttaatctttaaccactagtccaagtagttgagagcactttttgcaaaaaccttcgaaagaaaattcgtggatgaattgagccacgtccctcgaactcttcatatatctacgttgcatggtgatccttaaaaaagattaaaagtgattttaaaaaatcagttaaagctataatttcagtaaaatttttcctaacttttgtaaaaaatgtaaactgccagggagcattttgtagcaactaagtgtgtatatttcaaatctgaaatttaagtccaagtagaaagaagcaaatttaatttaggggatgaatctgaagagaggccaccaaaaaaataaccatctaaatataaaagaaggaagttcagatatctcttgctgtttttcaggagatagctttagggcagtttgctcactttcatacctgttcttaacgatttactgactgcctgggtccatcattagataatgctagcacttggaggtttccaaatgagttttgtgctgatctgagttgctgagctagttagatccttggcttcttaacgtaacattcttgtggcttaccctttccaaattactagttctaaggaattgagtttagaaaacctaaccagtgaccagaatgtaaaaataggtatttaaaaatcagaaccatgtccacgtgtactacccaaccacttgctttcaactaaaaatacttgcaaagatgacaaagcagtccacaaccaaaatatttattggtacaatttctctgtaattagtaatattgtacagttatgtttaacatcaggttctgccctgaatcacccctctcatattactgtggctggtgaactacaaaggttgtatctttgccatttcatttaggaatatagggtttatattttatatagcagaatgctaaatatttttgaaggttttgttttgtttctgtttctactctgtctctactaaaaatacaaaaattagccgggcatggtggcgcacgcctgtaatcccagctgaagacatgggcctttttctttcttttttgaactgaagtagcctgtttaaaagctatgtgtgggctttttattgaaaagtgtgaattgctactagttttataaggcaaataaacagtttatagggatcaataccactgagtcacattttgcatttctaaaatctgtgctgtttacttggagaaaacaaaagaaatgtgcctacctcctccatcccacctttatttagaaacatttccagtgggcttgtttttttcagattcagaattactgtacctaaccactgggtacccttacagatttcaaagcctgaagtaaatgtttatgctggctttcgtagtcagcaaataatagccaaaccctaattcactgctcttttatagaatcttggaatctcagggctgaaccgttaggagtcagcagatccactcttagccctagtctcttcctctcaacatgcaaacagttctaatgtctttggaatgtctgagcaaatagaagatttgtatgcgattctgtcaccaattctagacagaacatcctttgggatgccatgttttggcataaaccagcaacttgatattatgagatttgtatcatttctctgcgtgggcagtgccctagactaaaatctaaaatggagtcaatgcctgatgtcattaactatagggaaatggcctccaagttagctattagagttgtttaggaattatagctgggcgcgatggctcacgcctgtaatcccacctctttgggaggctgaggcgggtggatcatgaggtcaggagatcgagaccatcctggctaacacggtgaaaccccgtctctactaaaaatacagaaaattagccaggcgtggtggcaggcatctgtagtcccagctactcgggaggctgaggcaggagaatggcgtgaacccgggaggcagagcttgctgtgagcggagattgcgccactgcacgccagcctgggtgacagagccagactccatctcaaaaaaaaaaaaaaaaaagttataggtaagccaagaaggaaag

SEQ ID NO: 122895 - DNA, 1024 bp, Homo sapiens
gacccagttttccttattctgcatctccaggctctgctccagtgtttacctctaggaaggcgctcagtgaaggtttagtcagcaaatgcactttgaataaataacttttaaaagttgagaggacatttaaggccgggaatcgcagttgagaacgccttgcccaggcgcattagctgtcatccgggctgccctgagggcgaaagacgtcctccacccccgggtctccgcggccgcgcttgccgaatcccgcgggaaaggtcccccgcccgcgcaggggcggggcctgggcgtcgggggcgggaccgcccgcgggggtttccgcgccgggggctcgtccggcggggtcgcgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgaggtacggcgtcggggtaaggaggcgtgcggggctgcacgggccgggcgactggtcagtgtggggttgcaggggcggctcagatttttcctctggctgcagctgggaagctgattccgggcaggaagcggtggcgggacggtcccaccgggatggggggcggggagagggggcccggctttgggattttctgcggctccctctctcctttccttcccggtctctgcccgacccgattcttgcccgggggtccgggtcctgttgctccgggccggatcccggcttcgctgctccccgcggtccccctcttccctcttccgggggaccggggccgcgtcccggcggagccaggaaaggcgggggcacggggaggacgccgtcccccccggggtgccgtgggctcaggtcacgcgtccgggccccgtggagcaacagcgggaaaaatccggctccatcccccccgcggggagggggtcggccgcggcgtcgcccttcaggaggaaggttttaggaggg

SEQ ID NO: 122896 - DNA, 1037 bp, Homo sapiens
ccgcctcggcctcgcctccagccccgggacgcggcccgccaccgccgctgccgccagcccagacgcgccgcccgcatgcgccgcgaccatggagcgccccgaagcgggtgagaccgggctgtccagcgggccggggcgggggcgacaggagccgcgggggcctgggcctgctctgcgctcgaactttgggagggcctgacccgcgccggcccttctccgagtctccctccttcccaaaaggactcagggtagcaccgagaagcccggtgcaaccggggtgtacatcagtgctgcctgtagcgaagcgttttaatgcacgcattgtgggtccgacaggaggcgggggtatgagcccatccccgagtttcacttttctttctccctttctcatcctgtgaccctttgcacaaagttcatgccagtacacattccttccgacggtgttgatgtgggtaaatgtaaacaaaacctagtaaaatttcgattttatcttatatcacaaatattaagcacccgaaccaccatactgtctcatttaggattttctgccaggtttggacatgaccgcttttaaaactggcgccaagtctacactagcgcccggaatgaatttccagtttaggtcagcgtttgttgtgaactgaactttgtgatagagcgagttaggggtggactttcggtaaaagggtccgcaaaccaattagagaaaaggtgctcctctgcaagagtttcataggataaactcatagaagagtataaaaagcataaaaacgttaaagtgtactatataaatagcagttaatcgtgtgaatatgttgacaattgttaagtgaatgatgacagtgagtttttgcatttaggaaatgcatgggaatggaaattgttaaggagaaaagagccatactccagttccttgtttaagtgccgtggctttgcaattcaggatcctgttagcatatctgtatattttccttactcataaagtttaagatgtttgtggaggttacttcctcctttcatccattttcggacactat

SEQ ID NO: 122897 - DNA, 1082 bp, Homo sapiens
atgatgtgctgatgggatagggaaggtggggaaggggattgagaggaaggaagagaaaaaaattctttcctttcaccactaacttctaggctttgcatcacaaaggtgaagggagaaaggggatgagagtcctgtccgcagcttttagttttcatcctttaacctgctgtagcctttgtttctgcctctctacccctgtaaagttgtgtagatgctggaaagagtgcaggctttgggtctgacagacttgttagtcccagctgagtcacagactccgctgcatgtgcaggtcaggttacctaaatttttcaagtttcagtttgttcaggtgtaaaatgaggtgggtgataatacctcctttagatgactattttttaaacccgaatatagccgtgtcaccaacctgcttatatacttcaggattttcccatcgataggataaagacaacctcttttccatgttctctgaggttttgtcgttgttcgtctctccttcagcccttgctttttctgcccgagctcttctacccttccttgggcttgccaggttcccttggccccaggaaaagccttctctggctggagctttctctttgctcctcttggttttgttaatgccggaatctcagctcaaacctctctacccatgaccacctcgtctaggtcaactatccctttccttgccccattcctgtcagctaaaggctttcacagctttctgtatgccatttgtcatccttgcaacttgacacttgtcttcctcacaaggtttttagtgcatgcccatacctagactggtgtttgttcaagagtaggtgcgcacacatacacgctctttcgctctcgctctctctctctctctgctgctgtttcatggcaaaagcgtgtttctgtcattccaagttataaccagaatacttaaaaataataaatacagtgtaatggtggtttcataatacaggttcaacagcagttactggttttggaggaggtagggtaacttataatagagggaaatgcaggtttcaagtgaccttgaaaccaaataatgtaatgtttccttttcaagagacttatttgta

SEQ ID NO: 122898 - DNA, 1010 bp, Homo sapiens
aatacaaaaaattagcagggtgtgatgggacctgtagtcccagctactcaagaggccgaggcaggagaatcacttgaacccgggaggcggaggttgcagtgagccgagatcgtgccactgcactccagcctaggtgacagagcgagactccatctcaaaaaaaaaaaaaaaagaaaaaagaaaaaattctttttaattttaatatcaggactatttctcttgaacatgttgttttttacctaatgaatgttgaacatttaacttgtgtctttgggttagaattggttacttgaacacttagaatccagtttattgcatacttcaatttagaatataggacataatgctattctttttgtgcacttacctcatacctggcttcatgttatctttccagttttagtttctgtttgtctcattttctttattttaaatttacttattatagtgtatacttctttggagttatcttaaatcctatttttagggatagggtgaagcaaaacatgtaagcaagcatgcaaacaaataagcaatatttacaagtcaaggagtacttaaaatcattagtaggccaatgagaaggcaactctaattgttctgagggcaaatcatctgggaccaatgcccacagttaatcttttcttcctgggcaaatcatttgggactgatagtccacagttaaacttaatcttttcttcttggctgctctggaaaaaatgctagacttagagcttttctttggtaatataaatatctctgcactcaagaaacatttctaattactcattcattcattgttcttttaaataattcactgggtgcttgcaacattgagaattccatccattctttgcaaatattctcacaaaggcattttccaatattgatgaaagatccattgtgtgctgaggaatgtgaagtatcaccagctttaatatgaatataagcccgaagatgttggtttgttgttactgctcctgtaattcctttcttgattccagaggtat

SEQ ID NO: 122899 - DNA, 1004 bp, Homo sapiens
agtagctgatagaattaagaagatattgaaaattttgcatttatatggcatgttcccacattttataatgaatgatgaaattgcattgaaaagctttttgcatagaaatggatatgtgatttcattcattttttcagccatatataattttaagcttgcgagactgagagattgctaaaaatttagcccactagaattataatagttcttgcaaaacttttttttttaaatagaaaagtgcccttggttagcatgataaaagattctaagtacatttatctcatacaagaaaaaatgaaaggtttttagaatgttcatttgaacattatgctttctttcattttgactgtcatttcccccaaaagatggagagactacattccgtgttttctgctccttgtgaagaatctgttcagtttctggtatctttaggcccttctagggtgctctattactacatgaagtcttggatttctgaccaccacaggctggtgggtgtcccagcagcctgctaaccgttcccctaatggcttgggctacgctttcttcagaaacgtaaaaataacttagccacacttcacttagaagaccagcttgtcttcttaactaggatggctgcattcacagacctgcaccattgaggccattagagccttagttttataccctgcctctgtttgcatatgcctccaagcacacttcatccttcctctcctttctcatctctctcttaatcctttttattctcacctcttttatttacttgattttcaatcaaacactttctaaatggactgactttgtaccaggcattattctaattatcttattaaatatcaatttcatcctgacaaacctatgaggtatgggctgtcttcgttcattttgtgttgctataacagaatacttgaggctgggtaatttatgaaggaaagacgtttattgagctcacaattttgcaggctgggaagttcaagagcatagcactgcactggctggctccc

SEQ ID NO: 122900 - DNA, 1015 bp, Homo sapiens
agaactgaccttaatgtcactcagaatatagtatatcccccttgacatgctgaggattcccattttggtttgctggggttctgaggaatggtgggaccttggtgagtggagtgtaataagaagtggtgatgagcaaagttaggtgccccatgacaatgcaggagtgaggggcagccaccggattcagaaaacctgaagattttccattgtcatgggagtggtccttcagtttctggtatggaggggtggtgtatagtgagactgtctggaaaagagctaaatgatatctcctgttgagatgctctgttttaaagactgaagccagatggtgtcctccttatatttcaatttgacctgctagagggtagtctggaaatgattttatgtatgatactgatgcactgaaagtactgatgcactaaaagcacctaaagtactggtgctactgttgtcagggtagacatgatgattgttggtaaaaaggggtgtgctgtgtagaggaatgctctggattattacaggaaatattataggaaaattctgagatagtaagatagccggtccattcattattgtctataggaggtataatgcgatattctgtagtgataaaccaattgagatttttttttaatcatctagtcattgtcatttaaaaagtaacctgaaaagctgttacccatgtcaacttaaaaaattagattcaaagtcagagctatcatcagtctgtttatgaaggtaaaacatctcattgacattaaagatgtggacagatggctggtgcaggggatgagcattcaccccctgggaggtcgtacagatctagtgtgagggtttcccagtggtgttcagtatttggtgcagaagtccctgggcttccggggtcctgtcctctggtaggcacttgttggcaggtaattgcatgtagtagtagtaaccaaaagcccagtggggaactaaacattcaatatattgtgttcaaaattttgaaaatacagaaactctctctcaaatg

SEQ ID NO: 122901 - DNA, 1038 bp, Homo sapiens
gttcttagtccatcctagtacacatgcacttgttccccacagagaactgaaattcctttgcctgggagcagttcgtgcacatgtgaagatcaagagcttgagaagcaaatgtcaactgatgggtcaaattaatttatatttacatgtcatcagtgtactattactcaacaagtttaaatgctagttccatttcctacagtaagaatttacattttcaaagaaccttaataaacagtatacatcaccaaagagaactttaaaacaatttagtttttgtctgaatactttttggagcctcttgtaaattgataattgtaggccactgagaagagaaatatcctaaattactttcttcagtcattcttcatgaagctaaagcaataaatttatgagatcaccaagctgcaggggtttttgttgttgttgttgttgttgttgttttttaacggtgtgctctgtctctctgttcatttttatgatatttctagaaaagttggccaaagatgaccctttctcttgattttgttgtaatgattaatcaacttatcttcaagttctctttagcatcacactctatttgacccattattattacttttataattctcgataaacttggttgacagattgattagtattcacaagcaagatgtactgaccaaatatttctgtgtacctggagtttcatgttcagacttcaaagaaaaacagtggcagttaaacctattttatgtgtttgctagctgaataattagaaaaattcacagggtaaaccatattctactcactcatccaaaaagcatttggtttaggattagtcagctgagttaaagattgcagagctaattttgaataattttaaaaaatattatgaaaaaatattttaatataatgttttcaccctgtgatgtttaaagtatttgtgatgctcttggtcactttgtagttttgcttacattttaggccctctcactaagcataatgactggatattggcatcaaagataaaatgaagcagcatcactagtcagtgacata

SEQ ID NO: 122902 - DNA, 1045 bp, Homo sapiens
aatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggagggga

SEQ ID NO: 122903 - DNA, 1037 bp, Homo sapiens
ccgctgtttcagttagctactgctatgtgaggccttgaaggggccacgctgttccatctgttggcaggaagagcttagagttctagaagactttacactctgtttgacttgtgttggttgtcagcttcgtgtagggaagccccagtggcacatattcatatttatcaacaaatgccaacatttttggggatcaatcactggaaaaataatatgtcctagatgaattaagaatgtcaaaaagtaatattttcaacagcaggacaaaattctgtcagctttgaacttggacccatttataaaatgttagatgattattgtattagtctacttctcagcatagaagtatttatttttatagggctttgagatatactagatttatattcaataaattttaatttttaagattaataatttttaatttagagacaaaaaaatcttaattttaagattaataattttaagattcaaattattcattccaaaactccaaatgtgttaccttccagtcatcccagcagccaggcactcccataaggaggtaattaaagcagtttgacttcatgttctggacattatttcaggcatgtgaccaaacagatgtgtttgcttctctgcattcgatcacagatgcagaaaccatctatcacatcatggagcaaattaggaatttatttcattatacaatcaagatagtgatttatttcattatacaaactgtagattttatactgtaaatttaaacttttagtatctccacacataaattgatgaatggataacctttcgtcatcccttattttcaacactttcaaatctcacctataataattttaactttaaacaaattgtagatacaaccctaaattccagttttcctaggtagatagacttcatataaaaataaataaacttggtgtactttaaaaaatagtttctaggtccctatatgaatttgagagcagcacagatgctaatgagacaagtccctagattatttcattcacagtgaaaatgaatattaaagcagttcactt

SEQ ID NO: 122904 - DNA, 1125 bp, Homo sapiens
ggttgctagagaagtacaattaccacattttttttcttgtgtgtgtgtgtctgatgctttcaaaaatgttatgatcattacttttataatgaaaaacacatgctttgaaattgttgacctatatgagttgtatatattatcggcaattaagaacaaataagctatgaattgcctcacatacttatttagaaatgtaagcttgtgatgaatatttagatgaaatccattcatatttcatacattttctgctgtactaggtcaaaatacagatattgtaagacttcaaattgagcgaagtctgtttctataataaaagtaacctataaaatttttttaaaggcagaaaatttgatataaaatataggtcaatgcttttctgtctatatttctaaattttctctcttcttatggccttggttacttcctttgtgccagattcccatagacacagttattcaacaagacctgtggtctccgcccagcaccaggctgattcttccgttcttcttgacttctgccaccttgccagccagctgctcgcttgcttttcccacagaccttggattcttcacaatttgaaagggactgtcattagggatgtcagcaaagggcaggtccccataatccttcacatcacactctaaaattaaaaagttttgagttactaaattaaaaagtagattataaatcagtctgtgtaggatgatctcaattgtataaaataggcatatattcacaagtataagcaaaggaaaaacctgaaaggtctgtaaatcttgggaaggtagacccatgtctgcttttgcttgacgtcatgttaccagtatcacacactggtgcggctgtatactgggctctcagtgaacacttcttgaatccatccagttaaactagacaccaaaatgtaacagtgataatcttctggtttgggcttaatagggaatgccactgtctctgtctctgtctctctgtctctctctgcttatgtgctttttacctttctatagtaagcatgcttcattttgataataattaaatacatatatatcggtatatatatgtattctcagaaaatttagaaagcactggtgtattttcatctggagatacacacacacacagaca

SEQ ID NO: 122905 - DNA, 1054 bp, Homo sapiens
gatttcttctgtgatgtagagaccttctctgtatgtcagacctcccacgactggtgtgccagtagctggtgtgaaagatgggtccagtccgtcaacatcaaaacttagatgaattggccttttctttcttttaagaagtgggaaaggatttcagtttaaggttgatggcttcacatttcatagataataatctgttaacttgttttataaaaagtagcaacccattatttcatgtaaagactttattaataactttggttgtcagtagcaaccttttctgttgcacacacatgtgtgcacacacaaaagaatcctaccttcctagtagatagctgagtgtttcttccatcaccttgccaattcctagtctgtccacttcagtcattgaaaagtatttaatgcctagagttttcaaaatgtagctataaaagagaaattaagataattataattaataaggctgactgtgcccgcctgtctccttttaagggaaatataaatatagtaaaatatataaaacatttaggttctatgaacctaactcaatatagttttatttgtatttatttttaacagcaagtcaattgagatttaattgcctggatacatacatatgtatgtacatgtatataaatatatgtgtgtgggcatgtgtgtgtgtgtgtgtcttgatgtttaattttctctcatagagttggtcagtaaagcatatctagcacacaaagggacaaaaatggaggcaaatcacatcaaggaataagcttactgttccccagggtccacgtctctcaagccaatatacacaatatccttggcagatatacagggagtcacccaggagaatcctggcacatcgggaatctaaaattacaatgttttcacttggttatgtatgattctcttgaacaaatcctacattcaaaggtaaagacacatattggattgcgtatatcttatatttagaatataaatacagaagaaatcatgtaaaaataatacacaattaagaagaggatgtgtgcctccccttgattgctttgactttgccttgaac

SEQ ID NO: 122906 - DNA, 1062 bp, Homo sapiens
tgctagcttttggtagtgggatgactggctagctagatgagtggatacgcctttgtaagtatatgcatatatatgaatatacatatggtacatgtacagacatgcacatataatatataaggggtgtgtgtgagggagaacgtattgtttctcatgcaagaaagaaatcattgtatctgcttttcttaaaacacagaacatgttaagaaacttctcatctaccccacgacactccttagtttattgtctccggatatgtgtaaatcctgctttaaatgtgagaagttgaaattctctgattaaagtacgttttaatgtgtttttatttcttaggtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccat

SEQ ID NO: 122907 - DNA, 1052 bp, Homo sapiens
ttcgtaggcagccagtgttaccagtctcttgccatcccctcttagatatcctggctggttttgtttgtttgtttgtttgtttgtttgtttgttttaacacaagtgttctgtaccctgtttgtttcaactttatcatgtattagggttggtcatttgtattagtacgtaaagagctgcctcatacatgccagatttactttatcagtcccctgtttttgaccttttaggctgtttttcatctttcgctagtataaacagggctgcaatgacatcccttgttgtatgtcaagggattaaaatttatgcaggataaattttcagaaatggaattgcttccacttaaataaaaacaaatataaatacaaactgtatattactagaaacattctgagccttctgcctctcctcagattaaaatattcatagtatacaattgcccagcatgtgaagttgtttcataaatcttctgagctgtttttcagttatctggaaagcagttgatcagtttttcacagttattagtaaccagttaaacattgtggtggtatgtttttttcttggcagatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgataatatcctttttattgtgattttagactcccagaaataacagtattttgatttatgagaatatattttttcttttaaagtaattttttatgtatttcaaggttttaattttttttaagatcacttccattttcatctctgtaaagatttgaaatcttaaattaacagcatcatgccaattaggctgaaattctgttaaaatttttattttagaacttgaggataagcggtaaaaaaattatatttaaaaata

SEQ ID NO: 122908 - DNA, 1740 bp, Homo sapiens
caggcagaaggaatggtaagccagaaataggcaagaaaggtcatatatgtttggggaatactgaacagttggtttgggatagactagacgtctaaggaaattataatagtgagattttactttgttaaaatctaggctttcagatggccctcatgattttacacaggttgaacattttcatataatttttctgttgtttttcaaaggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaaggtactagtcctaattggtatttcaaatagtccttttaaagccatacttgagtatttgatgaagtgatttggccgttttctctctggttctaatgttttttctcttgtctatatagaagtaagttagctctctgaacttcttcaaggtttgagagtttctataatgttgagaataaattgaaactgcagttttagtggacataaggacttctataaaaagaagtaaagtataatcaagtataattttaaatgtttccttgcaaaaaaaaatctaaacaatgttttcacatttagctcttttaagagaattttttaaaaaatgctctaaccatttatcatcttctcaattccacagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatggtgagctttttccaattttaatttcgtctaatacctccattatcaaaagtaggatgggcaggaccacatggtaatagtggctctaaaggttttattttaaatattttaaaaatgaagtgttttgaggataagtactatggatggtgccatgaagtataaaatatacaacataaaaatataaacaaaagtatgagttcagaacagggtgatgttactgtaaactaaacagatcttggcggccttcttggatgggtaggatttggacttgatgcatccaatttatagcagcagcagggaaaatatagcacacgaggcagaagggatcatttgggggaaatcatggaggagataaagtatatttgaagaaaaattgctacattgggttgaattgaaaattcttaccagagagttctagaaataagattggaaagacagattgtacctaactgtagatcaccttgaatgctaggctgattttgtaattgcagataataatcaactggaagttattgagtatgatcatggcataggaaacattatttcagaaagatacatccagttatagttggcagcagtcttaggatgaagccattacaaggacatgtcaaaaagctcagttgtgtgattagtatctaagcaacagtggttgcattgaaaatgagagaaaagggacaaatggtcacaaaagaaggaacaggacttgattggctggttataaggagaatattgaaagaaaaagacaactaaaattttaagcatagttactggagagtggcagggtcagtgacagaa

SEQ ID NO: 122909 - DNA, 1214 bp, Homo sapiens
tagccaaagggtagagacacttcattcttttttttctttttaagattggcggaagtatcaacagatgattgaagaagctttgaattcaggcttacttagaatttccatttaggaaatctaggaaaaggaatcttggagataatctagtcaagcttatgtattttccagacacagaaattcaggccttaattgctgagttgctcaaggtgacctagagtttattagtgtcagaatcaagtctagaactggtttattaactccatatccagtgctctttctactataaccaatgaaataaacttctaatcctctttttaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctataggtaagtcaaaaacctaatttgcattccatttggcaaattgttgtatccatacaacaatggagtttatgttttactctctgccttccagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttagatcaagatgtatgactaatatatgttatgccaatctgctctatattgctttgaaggatttaatgaatttatactatatcaagcattgctgtcacttccctaaagagccggaaattttccaatttctgtttttgtttgtttttgtttttttgtttgttttttgagacagggtctcgctctgtcgcccagtgcagtggcgtgatcatggctcactgcagcctcaacctcctggtctcaagcaatctcctcctgcctcagcctcctgagtagctgggagtacaggcatatgctaccatacccagctagttttttttctttttaacttttttatagagatggggtttctccatgttgcccaggctggtctcgaactcctgggctgaagc

SEQ ID NO: 122910 - DNA, 2950 bp, Homo sapiens
gatagagtattccccaggttttgatgagatttttaaaataagaattatcccatattaaacttgattctcatgcacacatgatcaacttaaagaggtggtgttgtgcatgttgtatatgactatgttctaaaacattgcatttttatatgcattagttgttttggggagcaggaaataagcatatatataatattaaaataatttagcaggttttgcatggtgtgtcttgaattgagactaagtaattactaagtgccaaagttagatgctgactttctcagagcaagaaccaggtttctccttaaaaacaaaaacaaaaaaacaacaaaaacttcctgtattcatctctttaagtagcagtgtatacatgtgtatttaaacatcttttatagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaagtaagctttactgagtaactattcataacaacatgatgagtaaattatgtctaatttatgtttaaggattttagtgtgattttgtgtatttctaaagtttatgctaaatcacaattgaatgttaagtgtagcaagctctttctctacattctaggtaggtctacagttttacaaatcactaaagctgttttaatctatatacatcattgaatggccagataacagtctttattaatagctattttttctttgacagttgagcctcagtatgtcccctgggtattttatcatataagatatttgagtaaaatgtgatgtattttgatgattgccattttctagaagtactttatcatgaattgttgttgttgttgttgttgttgttaaggagtttcactgttgtcacccaggctggagtgcagtggcgtgatctcagctcactgcaacctccacctcctgggttgaagcaattctcctgcctcagcctcccgagtagctgagattacatgcacatgccaacatgcccgactaatttttgtatttttggtagagacagggtttcgccgtgttggccaggctggtcttgaactcctgaccttaggtgatctgcccagaaaattttaagatgaaacaagagtatttcttgatgatgggtataacatgatggggttactgtaaccccaccatgcactagctgtaaccccaccatgcactagctgtaaccccaccatgttatacccatcatcaagaaatactcttgtttcatctttcctccttattttttttgttaatgttggacaattttcaagcaaatcccagacatccatatcattttacccattaatagtcaatatgtttaaatgtaattatttaggttgcgtatttcttagatttttatctgttcttaaaaattattatgagacttttagaaagtcttgtttttagttacatttgtcactttagtaagatttcatgatgatgtgttttaattttttaaaagtaaaaattaaaaatttatttttatttgagaatgctctgcgatagtaggaaaagcttgaccaagcacctgtgaatatgtgttacttaaagcaagtaaaaacatataccaaataaagcatcttgtaataatttcaaaattttatggctgttagaccttctgatttgtattattgaattatcggggctaaagtaagacatgatatgctaaaaagagttatattagaaattgattactaaaatacacataattatttaattcttctctttcttctattgtgttatttttcaaattgttatttttcagtatatcccagttcctgatattaacaaaccccagtcaacccatgcctttgcaatgacctgtatttggattcatctcaatagaaaagctcaaaatgacaactccaagctacagattccaatacctcattccctaagacttcaccatgagtaagttatttgttgcttgatacttaattttcttgtttaattaatagcggattgtagactaatattggtctcggtgtttgtgtgaaatttggaaatctccgcatacccactataggtaagggcaaatacttgatgtatatgtcatagcaggagaatctgaccagtacctatatcaggaaacagctacaaggttagtcttgcttatatgtatagatttttttttttaatttttaaggctgatcttcagttgtatatgttatactttaaagttattaatataatgaaagcatatcaatttttataaatgtaaaaatgtttcagaatttcccaagtgcttggaacttcagcataagctgactgagatatcattcatctctgggctgccaggattgattgagctgatctggctggcatgccccttaatatctcttccaaagttgtgatgactcaatgaagataccattcttagatagtattgtattgtagtcaagggtgctaggagtagcctaacttcccacctagaacttctgagaaggactgccacttctcttcacaggagatggcaggattgtcagacttgatacttcatttggttttcattttatgagacagcccttaaccaccttttcatagtggtatctgtaatgaagacattgttgtgtttatacagacagataataaatagaaacctggttcatagacttgtgagttatttcttcattctctgaaacttagcctaatatggtggtcatatatgtagtgcatacttaacagtacccattaattgtttatttaaaattatttttcttctgaaatgctactcaaacttctatgtgtattcccactgtacatttcacacagaaactataatacctataggaacaaagatagcattaataaataattgcataaaattgaacttttaaaaaaatacaaattaacattatggaagttattttcatttt

SEQ ID NO: 122911 - DNA, 1133 bp, Homo sapiens
tcttctgctaccatcaggtaccggagcattaggtactgtagatattcctgacttaatttttgacagaaaagttaagggtaatcttgagtcatggcatatattgaaagaccatcagctttaactgtaaatttcctagttgttcttgctttgtcaaaatcgtactatttttgctttccttttaaaatcattaactgtatgataatcactacatgcctaaaaatatgtaggtgaaaatccagtttttttcttaaatagctaatactaaaaaaggaaactccaaagtgactcaagtgctaaaaactagttttatttagtttgctcttttttcctaaagcagattgatggaagaccattatggatggagaaatagatgacaaattggtcagtttccaaactggaagcaaattcccatcactagtgaaaaattcctactggaaatcctggctttacttcttttcacaattttttctgactctgtatactttgaatgatctcactctaaatttgtgttgtctgacacatttcttaggttgttggtggttggcagaactagtgaatttcaagccctgtacacagtagttttgcatgctgatttaagaaatagtctgtagtgttgtctgttgcactttgctctgcttcataatgataattacatttggaggaaaagtactgtagtctcaactggtggtgttaatattgctatttgtaaacctgtaatgtgattgaactgtggtcatggcattgtgtttttggaaaaaatatgaaacaaccattgatgcttatcatttggatagatgtttgttttatttgcatgctttaagaaactacagctatattggagcttacaagtttggagctggcaaagagcatgcaaaagaggggatgctattcattatgtcttgtttatttccaaatttgtccccattttgcatttttttccctaaatttgaaaaaatcatatccctttttcatggcaaaagactgataatcacatctaaagtttagggggaaagatctgtattagtaattgtattcactagaagggcttccaactgcctgctactaagtcatataacatatttataaaggaaatatgaaaatggcttaaacatggcttaacatatttcttttgg

SEQ ID NO: 122912 - DNA, 1019 bp, Homo sapiens
acatgagcacctaggacaaaatctatataaattgacattagtgagatgctaaaatttaaaaaatttaaaccttctgcgttttcagggaaaggatagtagaaagtgcactggggaagggggattggaaggtctggtgctagtgttatctttattgttaccctctgtatgaccttggggcaagccacttcatctcaggtgtcaaatgaggcaaatgaggggtgggaacagatgaactgtaagcactaaaatcctatgatttttttcccactagatactgcctactctgtgaaggtaacaagtgcctttagaggattttttaatctcatttctaataatttggattaatgttgacattgatcttgaagcaatgattttcttattttctttaaaggatctgtttgaaccacagactgctttgttgagatatgtattggagcagccttattccagggatatggtctgcaatatgctaggtttaaataagcaggtactgtactatgctggaaacctagtaaattctgcatagaatctgcactattcttttctcttttctttgctatagctaactgagcaaaacagttaagaactatttagtgacttttaaaaatatacatggttttttaaacaatgtattattcctatcatttatatattgctttaagaatgtttaaatttaaaaagaaaaatttttaaagttggtttattttgcattgcttttttttctataaggccagtttcaagtataccttttgccagagaaacctacacatgactcaaccataatttttgactttttttgttgtttgggtgtctatttttatataacccttggtatcttcagcgtggccttcttgctgattttttttttttttttttttttttttttttttggtgtgtgtttgcttgtttttggtggtttaacatgtgggagggtttgtgctgactctgggttccttgaggctggcctcatagtcactgttttgtcttttctttttttcttcctttatttttgttctgtc

SEQ ID NO: 122913 - DNA, 1061 bp, Homo sapiens
ccaaaccaatgcctatttcagcatatatgttcattaaatatttgtgaagtgaatgaagtactgctgtgttcacatttacttaaaaacatttttgtaatacatacaggtcgctgtagtcttctgccagttgtaaataattcgggtgccatttgtaattcatggaaactggatcctgctactcttcgttttcctttgaaaggccttttgccatatgataaggtatgttgctaaatataatggcacttttagtccatctgacagtcttcaacctagattataagatatgtgatgctaaattgttgcttcataatctgaagaagtaaatatttaatgaaagatagtttatagtttatcatgttattctagtatctaaatataccctgtggtttatgctattgtgggtgtttatgctccagtggtccacctctggcaaagtatttggaggtgagaaactgaaattttaaatggcaaactgaaattttaaattgattccttgattaagtcctcacattttaaaagtagtagagctttttaaatgtgaactcagtctaattccagaatctacactcttaacacctgtgctatcaagttatttgtctttccaaatttggaaatagtgtttttgtttacacttgtaaaacagaatttagaaactgtctccattcttcttagattacatttccgagcagaaaattacttccttacaatgatacttaagactaatgtgactatatctgaagtcacatttctgagtttaaccctaaagggacgagggtatgctttttcaaatcactgaaattttgatataccctttaaggggcaccagtccctctaaattgttgcattagtgagcagtcttgctgactgaactgataattttttgggcctagttgctctttttacaactatatctacattgtcaactcttgctataagaatgtctttgtaaaacagtcactttggttattctgtttttaaatgcctcaggaattctttaaaattagcacattgaagtgaatgcttatgtactcagacccctttcccagacattttactgttaa

SEQ ID NO: 122914 - DNA, 1048 bp, Homo sapiens
aaacagttatattaatcttatttttgtgtgcttatttttttaatgatgacttttatccttagataatatgtatatttttaatcatgatgtatttctttcatttccatttccattgagaatttatatgccatgtaataaaatatgatcagcttcatcaaatagctaaggatatggtggtgtgacttggtttaattaagggacagatgaactggcgagtgattttttagaaggaagcaaaagggagctaacctttaaacagttatcatgtgcaatctttacatatattatctcattttatataaatgttcatatatttcaggggcagtctcaattttccttttgtacgtatttatttgacttccctctttctttctctctttagttacttggaaacctagtatcagactttgtggataccttcaggcccacagcaaggataaactccatttgtggtaggattataattttaaatatgccaaatagtacctgatttttagtaatctaattattgaacaaagctgagggatgttctcttaatatgtgccttggtggcttgtcattttggtgactctctaagagcttaatataatgcctttcccttgttttcacttactctgtgtgccaagtacagggaggaaaaagaaactctctggaatgggtttaagcttcatttaaaaccattctagaagtgggtttcttggtgattagaaagacattttaatacagctagtaaagcaccatggaatttctaggcagctggaagtctgaacagacctgtccctctgtggctacagaacgtgaaagtgtcaggctcactcagcccattctaattcccacttttgcttttcctttcgcattttcccatgttttgttagagtctctgaactttcttttaaaaataaccatgtgatttggcaatttttgcagtgcccacatatcctctttaattatttctagaaatcatggtgacctcaactgtgtggaaatatagaccattgtttattcagtgatcaaatattgagtacttcctataagccaggtgctattc

SEQ ID NO: 122915 - DNA, 1035 bp, Homo sapiens
aaataaatgttgaatgaaatttcttctttatatatcagataatgtaactggtattggatatgtggaaatgattaacagaatagccttggatatccttgagagattaaggtatgtgatggatgagaagggagaataggccagtcacagtggcttacacctataatcccagcacaaaagggagtgagcagaaacagtcctctaccaaaaagtttgatattgttactcaagttttcagagtgcattgaagtcttgttacaatatatttctgtctatatgtataattaaggtttttgacccttgtaacaacgtaaacccttctaatgttatgagggccaaaaaagcttgacaaactgtataatgactttctttgctcattgtattttaagacagtctttagaactctgttttggaacatgactcttctgttgggttaatgttagggacttagattgtaactgattcagaaaatttaaaggtgtgaccttgaaggaatatatcaccctgaaaccttcggacgttttagctaacacagtagacactacttaattttaacccatgtcttttttcttatatcagggtgttcgagatctcttaaaagtgattttggagaagattttgacaattcctaatacagtgagctctgctgttgtacagcagcttctggcagcaagagaggtaatttagacatgtctgaaattcgtgatcataacctcaaaaaagtctagctttgtttaggtctgtgcttttaatacttacggtattttgtgagatgctctatttcttctaccaaaaaaaaatcacttctattttaaaagatgctagttcccttatatttcaaaaggacattttaaattttaattcatggttttaaattatgaaaacaatgaaatagaaattaaaatagcttaaacattacaagaccttagcatatggaccacttaaaagatctttgtactttgtaactagtatcgcaagaattgttacgttggtctgttgcactcctgtttaagtgtgccaatatttaaagcatgtgca

SEQ ID NO: 122916 - DNA, 1050 bp, Homo sapiens
cataaagggcactgtttacaatgccttacaacaatctgtgttaagagttttctattgaccgttaatatgttaactaattaattactacttttgaagttcccatgtaataaaaatggtagcattttatctatgtaattacaaaatgttaagcttaatgtgacaaatactaaatctgaattttttaattttgctttttttaaaaattattttcatccacagatgctcatagtgaagtatttctttcatagtattggtatacttccagttgtagtattagctattggttataaaaatgtaactttagaccccaagtaaaatcattctctcattttccaggagtctcatgaacagtgtatccagtggattgttaagtttattcatggtcagcatagtcctaaaagaatttcttttctttatgactgcttagcaatggcagttgagactggtctccttccacccaggtacgtttaatgggtatgagcaatctgaagaattttcttttctatatgtgattggaaattggttgaggttgttgttgtaaaaaggtaagagaatgaagaagaaggtgaggtttatcaagtaatcctttatataatacctcaggttttagtttctaggagtaatagtctttgaattaggtaatgcttgtgggctcaaaaccagatgtttctgcccaggggctgaaattaatcactttaattagtttgtaaccctttacttttgctgcacaacctcaacaccttatggcttaaaacagtaatactcaggttttaaaattattcatggttttagtggttgactcggcttaggagacactttttactcaaggtcataatgattgtgatcaatgtggctagggctggagcatggcaaaagcttccccactcagatatctggtggttgattcctggctgtcatctggaacctcagctgggattattagccagaacctccgcaggccctcaccttgtggcctagactttctcacctcatggtggagcctaacagcaagtgtgcaaaagagggctaggcagaaattgtatcaccttg

SEQ ID NO: 122917 - DNA, 1148 bp, Homo sapiens
aagtttagtgattctcaaactgctgtcaagttcattgtatcctttgaaatcgatacagtgacaggccagacaggtattgatagtttcagagctgattaaggtgacttgccctgtgttacattgtaatacttggctaagggaggcgcctttttaaaattaacattgtttacattttgttttttttttttttacagaaaacggaagttatagaagaggcttttcctgggtgagtgtatgcgtggcagagttttgtgtttttatgtgattgtgtctgtcagattttacttagtttcgtgttggaaggttataagatccactattctgattgtgtgtaattacctttttaaaacgaatgacaaataatgtaatttttatttttttagcatgtttatggatactcctgaagatgagaaaacaaaactaattagctgtttgggggccttcagacagttttggggtggtctttctcaggtgagcgcttcatttttaatacattcagctgatgatttttggcctcttctttttttttttttttttcttttaacatttactttcatgctgctcttaagatcttcctgagaagggagaaataaaattgttatcattttttattctggcttccatttgttttaatttgtatatttcagtggaaaacctgtgttgagaagtcaagttgatactgcacagtgtgagatgtttaaaaaaaaaaacctcccctatgttagattaattgagatcattttcatcctattcggatttatttggtacacttgaaaacagatatgttaagctttacttgtcaaggatacaaattccatttttctgctaaataaaggaattggcacagcattgatacaaagatgctacaataggaataccaagattctataataaggataggaaaatattatagtaaaaatgaggagacaaactgtaaaagtaacaaagaacagctaccagaaaatgtatccgtgaaaaagacaaaaatgtgtcatcctcgaagagctcacattgcagtagtgccttaccttctcatggtacactataggtagggaaatgagaactgtttgcgtgtcagccactggtgataagatttgccactcagacatggatcatataatgccaatacagtcatgttttaacctttt

SEQ ID NO: 122918 - DNA, 1086 bp, Homo sapiens
aactgtattcagtattatcccttatgaaaactctaatgcaaattaatatcttaaatcatattttacacgtaagaaatttgagtaacaacaagttaacattacgttaaactcaaaagttggaatccatgacagaacgctttgtggcgctgattttttgcatgattataactacctctcaatcacttttttattgcatgagtattttaagacaagaaagtgagaaattaaaatcattgtaccctattatttgctgaaccaacaattgtatcctattttacttcactcctagagatagtctcttttgcctattttctctctcttgtcatttcatgtggtaagatctgccaccccccctcaccccccaaataaattttccttgattttattttcttttttcttttttttaattttaaatttttttctttttctttttactccagaaatacgcttatccatttccttgattttattactctctcttttccctttgccatcaaacttttggggtaaagagggctcatttcattgcttcagttttctcagcccccaaccattcctttgtgctctggctttgtttctactgtactgagtccctgactcaaaagtcagtcctcctcgtccttcatccacttgagtgttcataacaacaataacttcctggtactttctcattctgaattattctctccccttgcttctaccatgacattgacattttcattttatgacttttttccttatctgcattcttagccaacaatttatctttattctcatgaaaattacaacacaagcttcactaaaccctatctaagatctcttaagaaatctcatgttctctaatagtctttttaattttaattttatttttgagacagggtctctctcctttgggatctcacctcaccacaacctctgtttcccaggctcaagtgatcctcctgcctcagcctcctgagtagcttggaccacaggcacatgccacaaggctcagctaagtttttgtgagtttttttctttcttttcttttttttgtagagactgggtttcaccatgttgcccaggctggtctcaaactcctggatc

SEQ ID NO: 122919 - DNA, 1021 bp, Homo sapiens
atcctcaaaaaaataatttatgtacttcttaattatctaagcaaaatctgatgtttttttcttttgtgaaagttattttttgtgtctgaaactataacaaaggttattgtaaaatactttcctaagtaatttgattacgtgtctttctgccattctttatgacaacatacagtattcaagccctgtcatccagcatgcttatctctggacttcatggaagaggaaagagggcagctagaagaattctttttaattatatcatagtttaatctaatcatagcataaagttcgttacaccaaagggctttgtcagcagagcgataatgaatgacataaacaatctttggtcaggcagtttccaaattatcctaagtggtttgtatgagtggaagaccaaaacagattatttgctagttaactatttggacaatgtatttttacgtatgttaaatattattatcatcctgtgatagagtaggaaaaaaagccctgctcccttagaatgaggcagttaaggatttaacagttctgcaattcttttcaataaatgatcacaaatgggtgcctggtttaaaaaaaatggcccagaaaaatggttttatggttttaattcttaactttaactcaatttgcagttaagttcattgcatttgaatggtaaatgtgtttgaatttgaagatctgtaataaatggtatctttaaattctgccaaaatattctttcttaatttcaagcattaaataaaatactatacctccagttaggccagatactagatcattgttggatctggtatctggcataactagtacgctgcaggtacttagagagaatactgagaaagggtggttatttgtatctttgtaattttttaaaaaattataaaagttactttttcctttttgcaataggttcttcttgctttgctggtgatcatgtcacttggattaggcctggggcttggactcaggaaactggaaaagcaaggtatacccctcagccttttctcagaacattccc

SEQ ID NO: 122920 - DNA, 1062 bp, Homo sapiens
agtcttgctttgtcacccaggctagagttcagtggcacaatctcagctcactgcaacctctgcctcctgggttcaagcaattctcctgcctcagtctcccaagtagctaggaccataggcgtgcaccaccacacctggttaagttttgtatttttagtagagatggggttttgccatgttagccagactggtctcaaactcctgacctcaagtgattcttctgccttggcctcacaaagtgttgttattacaggcatgagccatggcacctggccatatcagtgtcattatttattacattgtattggcagatcctgcagcaccataaaaatcatctagttgtctgtcatagtctgtgctgtgtacttcctgtgtgcttccactgcttaggtatgagatattgaatagctcctaaatgttcgggccctatttcctttactttgtaggcagctgcaggaagaagtgctttgatgcatcatttagaggactggagaactgccggtgtgatgtggcatgtaaagaccgaggtgattgctgctgggattttgaagacacctgtgtggaatcaagtatgagttctgagaataagtttattagcatgttgcttgtgttactattaatacatgtcaaatttttttcttttctttccttttttttgagacagagtgtcactctgttgcctaggctggagtgcagtggcatgatcatggccaactccagacttgatctcctgggtccaattgatctttccacctcagcctcctgagtagctaggaccacaggcatgcaccaccacacctggctaattgtttttaatttttttgtagagacagagtctcaccatgttgcctaggctggtcttgaactcctgggctcaagcagttgtcccaccttggcctcccaaagtgctgggattataggcatgaaccactatgccagggctgtgtccaaattttcacctacataccttgtgtattagtttcctaaggctgccatgacaaagtaccacagactgggtggcttagccaacagaagtctgttttcttacagttttggagactg

SEQ ID NO: 122921 - DNA, 1092 bp, Homo sapiens
gctgctctgtcactgctgtcactttccactgagaagtaccttgatctgcctacattctcaaagacatgactgtgctcctgttacttctgttgtcaccttttcttccttgctgcttgtccttagacaaggctgggcaaagctgcttttgggtggcaataatcagtcagggctagtgattcttcaccttggggagctcctgctcttgggtcggaataggagccatgttcagatcttctccaagctcacagtgtacctgctaagtaaacctgggttgcgatttataaagctgcatttctctctgccacctggctagtgaagaaaagtggtggtttgcccctcatttggtattatgtattttcatttattaatacagataaaccaagaatttgattgtgttattataatataggaataaataaatgaaatttgtatattttatactgcaggcttaaatgctcagaactgaattgtatcgttttacagctcgaatatggatgtgcaataaatttcgttgtggagagaccagattagaggccagcctttgctcttgttcagatgactgtttgcagaggaaagattgctgtgctgactataagagtgtttgccaaggtgagcaggaggatgttgactcatttgcccctgcgagtttagaggaactccatgagtttcctagagccatgctaggctgcaaaaatcaaaacacatcggagaatctttagttactctgtctgtgctgcagcaagtatcaagattttgatcttatgcttttcaggagaaacctcatggctggaagaaaactgtgacacagcccagcagtctcagtgcccagaagggtgagcatgactgatacagggatttttatcctcctttaacaaaggtgcacataagaatgtagttagttgagacgcagagaggaatttcccccaattcatgtacatttcaaaacagaatagtccacaaaggattagatttcttgtggcttccaagttctaatggacttttgtttgctttattttttcacaaagcccttttatattaatttattatattcatgtcttacaacgacgactttattttgtttttgtctttgag

SEQ ID NO: 122922 - DNA, 1089 bp, Homo sapiens
taggcatttattactataacttccatcttagagctgcttttgctgcattccattttcatgttcgttcattttgtttcaagatattttctaatttctcctttgatttcttctttgacccattggttgttcaaaagtgtgttacataatttctacattatttgtaaatttttcagttttccctgtaatatagatttctagtgttattccattgtagttggagaaaatacttggtatgatcccaattttttaaatatgttaagacttgttctgtgatctaatatgtgatctatcctggagaatgttccatgcatacttgagaaaaacatgttgtgttgggtttaatgttctgtaagggttctgctttaaaaaaaaaacctgctgatagttttatagggcttctcttgtatattgtgagttgcttttattttgctgctttgaaaattcattgtctttgacttttgacatttgattataatatgtcttagtgtggatttctttaggttcatcttatttagaatccttcaagcttcctggatctggttgcccatttttcctccctagatttgggagtttttagccattatttctttctataaactttctggttctttctctttttcttctccggaaaaccccatcatgcatatattaatccacatgttggtgtcccacagttctcttaatctttcatcacttctttccattcttttttctttttgctcctttgcctgaataatttttaaaggcctgagtttgcctctctttgttgaaattctcactttattcatgcattgttctcatcacctcaacgagcatctttatgacagttgttttgaaatgtctgttaggaaaattgtatctctgcttcattcaggtcaattcctgaagatttatcttgttcctttgctttgaacatatttccccatttactcattttcctttactctctgtgttgacatctgcacgttggacaaaacagtcacctttctcagttttcatggaccggcctcgtataggagaaaccctcgccagttggcctgatcagcgattctggaggccccttaaaccttcatgctagtccagccttgt

SEQ ID NO: 122923 - DNA, 1036 bp, Homo sapiens
gttttttatttttctgagagactttcatgttcagatttttagttatccaaaaaactgaagaagaaacaacttcctaatttctcaccatattctgttgcagaaacatgtggaattcattcaaaatacatgagagctatgtatcctaccaaaaccttcccaaatcattacaccattgtcacggtaagtgcttgacccagtggtaagacaggccaaagaccagaactgaccacataaacagacatgtttgggcaggaactgaccgagttctgtgacttacccttctgaagcacatggggggatagttcatggctgaattcaggctgtgaaggaatggctcaatatgaggccagtccagggctgtgaggaatgaactatgaataagtgtccagcattaggttaattcacctgtgtcgagccaaaaacagaccctttgatgtgagaaataccattttcctctgatctttcgattgccctttgtttatctgagggtctgctgggaacagtaggctatatatagggacaactactttgatgtgggaaattttgttctttcctagtcttttcattacaattaacttgatagaacttctttttcataaatgaattcacactgtctacatctctttagataaagcaataaaagcaagtgatataaaaaagatgtaggtagaatgtgtgaaaagtgtataaaaagatgtaggtagaatgattaaaatgagctcaaataaaaattaaattatttaagatagatagatttataacacattttaaggcatcggctgcctcaaaggatatttgtgtcttcattactttgagttttaatcttttattactatggaacagtaactatgacatttacattttaacccccacacaaatgtatgtatgtattctcattacttgcagattctgtatttgtgggtttgcttactcactaaaatttatttgtaacccccaaatcaataagtatagtgcatttgtggtcatttgcagccatcacaaagaagcacaaaaagttgagttgcccaatgcttat

SEQ ID NO: 122924 - DNA, 1088 bp, Homo sapiens
gttaggaaacctatccttgctggagccaagtagaactactgggtctgaacaaggaggaggaggttagagagaaagaaaaggcaatggctagcaagcccaagatctacaaaatcccccaatccagcctgtatgtttatagcaaattgataatatatttctgtttcaattttacccctagacccaggttttataccatgtattttgaagaacctgattcctctggacatgcaggtggaccagtcagtgccagagtaagttgttgttttcttaaaagaaaaaaaaaaatgtaaaatcatctaaccctaacccacaaaacaagatagtattctttaacttctactgagcacaaatgtatttgatacatacacaagaagatcaaaatagttaaaggtataaaagggatgccatggttcaactgcctacttaaccataaaatagttgaaattctagaaaggacaactgccttattaactatatattgaatcatttgaaaagccctcattgaatattagatgtggcactgttgttgcatataatgaaaacatcaaggctagatactatacaagccaattcatactaatgtggtgcatttcaggctaagtcacctgcaagtccactgtggtatatccggctgtctactccccgacagttcagttataagttccttataattggatttaacatgttattgcctcaggcagagttgtttcccttctaggctcccattgtcattgaagtggactctctaatatgagtttattcattatctaggccattctgttatgattttactacacaaacatagtccttaaatattgcgtttaacaaaacaagccattctgtcttctaaactccgctaaagcctctattgtcttggacacagtggaaagatgcaaaggctgccatgaatgtggcatttccccaccccatggaaactcgttgacaattgtcctcaattggaatgcaagcatattcgctctggcagcatgcctttgcaatttctcagaaaagctttttttaaattccttcctattaggccaaaatgattcctagtatagggacttactcaagcctcaccacttttaagc

SEQ ID NO: 122925 - DNA, 2097 bp, Homo sapiens
ccagagaaggagtcaggcaccaatcctgcagggccttgcaggtccttgcagtctagaaaaagtacaataagaagcattgaagcattgtaataaaggaggtgacaggaccagatctatgtgtatttagagatcacttttattgtgtaagaggaatgagttggaggaagcaggggaaagtggggagagacaggttagctttcccaacattccagaaaagagataacagtgatttggactaaggtagaggcaaacattgtggatggaagaagatataactgagattcttttaggagatagacttggcatgacttaatgtgagttgggtgagggggttgggggatcaagattgatttcctagtttctatcatgtgccagcaggtggtcccatttatattaataagactgctaaagcagggtaagtttggggagatgcttgttttgcaattgaggtgcctgtgatgtccaaatgaggatgtccagaagacaaataaatgtggatttaaagctcaaaggaggtgaagatctgggatatcggcagcatatagatggtgcacagaagtggagatggcctaaggagaaagcaaagagagaaaatagaagggttaggaccaactgtcacttaaaacttgagaagaagaggcaaatgaatggaagtagagattttctgactttcttaattattattgttagttttaatcgcatacctttattcagagttaatatgacttataaattgacagtaaaaaggcgattttagtttattttggcccattcactaagtggaaaacttatcactcaaacttatcaaagctactcaattgttgcccattataggaatttcttgtttctttcctttggttgggtgagagttgggaactggcatttcacattctatggagtgtgtacttcatgacagaatctgggttcaagaaatatgtaatgatttgggttgcatgatccctttcctgtgagaactcatgctctccttgagaggcagacaggtacacagatgatttcaaaactgtaaagagtccaatggcagccatatgccagggtgctggcagaggacagaagaggagggggttcttggtgtggttgggggagtgaatcagatgactatgtaaaaggaacgttatgtcatgacaacaggtggaaacagtaactctcgctggcaaaccaaagtgcaggtcacactaagactgaaggccaggaaagcatcttggagttgatgatggattgagctgtagatagagagtggcttgtgttcaagtcctgctctgtcccttattaactgaaggactgtgaacatgtcacttaacttctttaaacctcaagtttcctgacctttacaactgactgttctggtagcactttccatgaatatttgctgtgaggatttcaagagataatgcactaaagaccttaactctatcaggcttgtaaaattccttctcaaaaaaagaaaaagaagaggcaatcattgttataatagtactctgagagataagacatttctttccccaatccattgctattatgctttcttattcactggaaaaaaaaaaacacagaaaatttacatcagtgaaatttacttaaactttatattagttccatgattatattcataaagtgtagaaaattaaaaaacacaaaggcagtgagtataaacaataaaataaaaatgaactccaattctactatttagagacaaccactgtcaatagtactttgatatatttccttatagttttctgtgtatgcatgtttactaagaaatgctaaatatatttcaaaacaaaatcaggattatgcaatatgtatacagtttggttttcatttttattgcttaacattgttttgtgactattttcctatgccattgttttttgtgggggatggggagagggagttttactctttcacccagactggagtgaagtggtgcaatcttggctcactgcccccctggggttcaagtgattctcctgcctcagcttccctagtagctgggattataggtgcctgccagcacgcccaactaatttttgcatttttagtagagatggggtttcaccattttggccaggcttgtct

SEQ ID NO: 122926 - DNA, 1124 bp, Homo sapiens
aaaattccaggtatgaggggttgtgtggcattaaagggaatgtttatgtttttagtacttttcccctgctgtcttgcattcttgaatttttatgagctttggcggaaaccaaaggcggagagattctaagtgggctcagactaggagtttaatacaattcttctttgttattgttttaaaactagcttccttgttaccaaaagttcctgtcctttcactgatcccacagaagtacttgtgtatttctccttccctgtgacaggatggaattctagcaattttctgctttctaattcagaaattactctgttagtgtgttgtggttcaagaaaattacatacaaggatgttttgggattcacataaaaatgttgtaaatcagctctgtgtttcaaaaaatcaggcttaaataagcactttttggaacatggacccaattggtcttagcctttaagatttatagagcttttgtttttctgtggttttggtgggttttgtaatttttgttgtatctcagaagagttctggggaagtagttgtgatttgaaatcatggtcgtagaacagctgattcaaaaccattaaggttagtcagaccatacatagattttgcttctgggcctgttcagaaggaagatatgcactagtgttcctgttgctaggtgataaattgaaaataagagcaagaattgtgattactgtttaaaataggtatttcagaatttaatatgaaatcaaataacttttcagagtagaaatctagtgtactttgaaaaatgcctctctgtctccctatgtatctatgtatctctcgctctatttacctatctatagctatatgtctatctatctgtcaatctacacacatatcattccatgttaaaaagccttttttcttgtttctaaagattattttgtgagtctttgaaacaggggcattattgtgtgttgcaaacatttttgaactatgaaagaattatttttccctgtagaaaataaatcatacaaccaaataattaaaaacatacatagttattatccttaccgtaaggcaaaattgtaactatctaatcttcaaacaagtaggttttagcttgtacattcagcctacaggtaagaagcatct

SEQ ID NO: 122927 - DNA, 1085 bp, Homo sapiens
acaagtcacttaacaagacctagatatatcactatagattacaaacgttaataccgaatgaaaaaaattgtagaataccacttataatattaacataagtttaaaaactcatcagtactacatattgtatagtgatgtacagtaaaagtttgaaaaaacagactggattcaccctgatataaagatgtttagttctgaacagaggagccctggggacttaacttcatctgcaatatttaatttcattaaaaaaattacatctgaagtaaacataaaaatagataaattttgacaacggtgttctatgttagttatagtatactttgtacttgtgttttctttttatttttaaaaactaaatttagctgtatcaaattaagatttaaggaggtaaaaatcatcggcaaaaagacaacttctaagcaataaaaatatttctgttcatgaaaaatactgccttgtgaaaaaaaaagtgttgtgcttttctttttcaggaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtattt

SEQ ID NO: 122928 - DNA, 1049 bp, Homo sapiens
gtgcactttattagtgtgaagtcaacaatcagctgtttctgggagcttccaaagtaggtatacttttgggaaattgtgcttttcttcttagtttgagtttccttcttggcttattttgaaatgtagtagaatagaaaaatagagagttttgatagaaagtgattttgggatgtgtggtggctcatgcctctaaaggagaccgaggcaggagaatcacttgaggccataatttaagatcagcctgggcaatataatgaaaccccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagatgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaaaagccatttcactaaaaagaacaccttagatgttttattgcttagatgaagcaataaaaatgtccttgatgaggctggtcgcggtggctcacatttgtaatccttgcactttgggaggccgaggcgggtggatcacgaggtcaggagatcgagaccatcctggctaacacggtgaaatgccgtctcta

SEQ ID NO: 122929 - DNA, 3481 bp, Homo sapiens
cgagccgcggccgcccggagcgtataaaagcctcgggccgcccgccccaaactcacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccgggtaagcgccgggagcccccgctgcggccggcggctgccagggagggactcggggccggccggggagggcgtgcgcgccgaccgagcgccgctgaccgccctgtcctccctgcagccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccatgcgacccgcacaagggcctattctgtcacttcggctccccggccaaccgcaagatcggcgtgtgcaccggtaagacccgcagcccccaccgctaggtgtccggccgcctcctccctcacgcccacccgcccgctggaaaaagaaaccgctcggactgagtttctttctccagctgctgccagcccgccccctgcagcccagatcccaactcgcatccctgacgctctggatgtgagagtgccccaatgcctgacctctgcatcccccacccctctcttcccttcctcttctccagccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcgggtgagtcgagtcttcctctaagtcagggtcgtgattctctcccagggagggagtcctaactgtgccgaccgaacgggggaaataccttatccaggcgttttacatggtgtttgtgtgctctgctctcgcagcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaaggtacatgttctgctcctattaactatttttcacaggaaaaacagtggataggacccaacttagggctcttgccacgcttgttagtataagcccgttatctccaaaactatctaaccattgagctgttttgctggaatgagagcttgtgtaatagcaaccaccagttttccactacgaaatcttccacagggttagttaattcaagacattccaagagaggctctggctatttttggacatagcaaatgagactcaaacttcctcccctcaaaatataaacagaagtcagacaacagaagactaaaacacagagggttgaagaaagccactcctcttgtagagtcgctgatttttttttttcctctctcttttcccttgtcttccttagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaagggcttggttattcatttatccttctaaacatttctgagttttcttgagcataaataggaagttcttattaatcataagataattcaccaataattttctaaatatctttaattattctatacattaataaattgattattccatagaatttttatgtaaacatacttcacactgaatcaagtatcacagacttgcaggcatacacaccacattgactatacagccattt

SEQ ID NO: 122930 - DNA, 1024 bp, Homo sapiens
aaattgaaaagacttgtaattaaactgaaattaaaccagtggtgacagagtgttttttaggtaaaaagacatagagacatgagagcaagaaaaacaggggtcaagatcaaggagttgccaaattcaattggatcagaaattctcataagaaaacaaaaacaaaacactggaggagacctgatttcgcctgccacagacttgatcatgtccatgaggaaaaaaaaacatcggtgcaactcttttgctataagtgatctacagctctattcccgtatggcaatggccaccttggcaatacaacatagtacatagaattatcaaatcttagcctgccaaagaactccataatactgacatctttctttgaaagctgttcatgccttaaggctttttggattctgaacatctagaaagcacttgacaaaaaacctagacctagtactacctttacttgcacataagagaggcccctgccattaactgcatatcacaaacacatgacaaatacttttagtaaaaaacacatgagtgcccttactgtggatccagtcctcagcactggcacagcatgacctataaccctaaccactgctctcgtgactaaaatggctcaggctccagggaaatgcttctgcctatctcatgccctgtatcctagaaaaagtgattgtgtctgtgctgttgctgatgtagaagagagaaactgttttggagtagaggcaagatttgaacagcagaagcccttaggtaagagaacaagaaaatattaagtaacttgtcaaattcctcctctctaataatatgaatgcaattcattctttcataacaaagtcttgtttccaagtagtgctgagccattttcttactcaaaaaggaagttttcttacttctcttcatgttccaattggtggctccagaaatacgcacaaactagtgtagtatccacaaccatcatataacgtggctgtagagcattccacaatattaaaaattcatattactgttaaatctgtttacctctttt

SEQ ID NO: 122931 - DNA, 1062 bp, Homo sapiens
tcagataaaaaatgtttgaaaaaattgcatctatattgaacatgcacagaatatttttattgtcatcattccttaacaatacagcataataaccatctacatagcacttacattgtattaggtattataagtaatctggagataatttaaagtagctaggagcatgtgcataagttatatgtaactactacaccattttatataagtgtcttgaacatcacagattttgctatcctcagtcccccatggataccaaggggcaactgtgtatttctttttaattatttgttagaatttttgttcattgttcattgaattacttgttttcttattactgagttgtaagaattctttatactttggatgtaagttctctgttggatgcctgtttacagacaatttctcccagtctgtggcttgactttcattttataaaagctgtatttattgaagtttgtttcatcatttttttggtttgttttgtgcttttcatatcctgcttaaaaaatctttgcctactcaagggaagactttctcttgttttccccctgaaaagttcacagttttagcttttacatttaggtggatccattttgaacacatttttgtgtgtagtgtaaggtaaatccaacgttctttgtttttcatatagatatcaagttgtgcaagaaccatttgatgaaagaaaactacctttttactattgaattactttggaatatttgttggaaaatcatttgtccatatattggttctttctggattttctattctgtttcattgctctatatgtttagccttactctaaaaccacatttaattattatagttttataggaagtcttaaatgtaggtctccaaaactttgtcattttttcccaaaattattttgatagtctaggtttattctattttcatacatatatttaaatcaacttgtcaatttcatttttaaaaaggacctgctgggatttgattgggattatactgaatttctagacaatttgagagaattgataccttaacaatattgagtcttctaatctatgaacatggtatgcc

SEQ ID NO: 122932 - DNA, 1024 bp, Homo sapiens
gtgcccagagttttttggaggaactagtcatataggtggtctctgcctaccacttactaaaattccatacttccagatggaaagcagttgttcagcataaactgcattgtttgcacagtataggcacaatgagtcactcttatcattagagaaagtttatgtcaatataggaaatcgtttactatttaagtttccaggcacctgccaaggattatccttgcaagcaggcctttctgaggtgggcctattatgttaactctttaggtataattgttctctttcggtacaattataggagctatttaagatataataaacaagattcatattttccttgccctcttgagattgtattctggagtgagggagaggtaataaacaaaaaaagatattttaaatagtaatagatgttatgaagacaaaacagtgaaggaagtatgtagttgttgtcaacaggataaagaaagcctctctgggttggtgatatctgagcagcgacctccgtgataaggagccagctatagagatatgcaaattctgcacaggaaagagccagtgtaatgaatgaccctgtggttagtctgaacctaccgtgtttgtggagcagcaagagagtgcatttggctgcagaagagtgaagtatggtagagaataagtgaggacacatgagagcaggtgggaccagatgatttaggactttatgggcaacataaggccttggggctttaagtgcaaagggaagcaattaaaggatataaataaagtcaatttggctactatactgggaaaggactctaggagggctagactggaaggaatatcaatcaggaaactattgtgattgtctagttgagggatgaaggtcacttgtgccaaggtggtgacaccaagttgatgagacacattccattcaggttactttttgaaaggagcacccacaggcttgttgatcaatggcatctcatggaggcagtgagggatagagcagagtaaaggctcagtgatggtgtgaatggtgttaggg

SEQ ID NO: 122933 - DNA, 1135 bp, Homo sapiens
actcccatttcctcaagttgtaccctccactaaacaagttatgtccatccttaaggaacattcttggtgtctcacttaatatccccatggtggtctgaaaatttcctctctagaaattattcttctatttttcaggagtttgatagtcaggtaattttttctcccatattatcagtttcttaatttatatttatccttacatgtcatttccaagcacttctttttctttctttttttccctgtctttgctcacatcctttctattttgccaagggcttgcttcttccaagcctttttatcctctcctcccgtgatcagtacccaagtttgcagcaaggttccttgttgttttatgggttggtgtttttgcttaggaaatcctcatgttttaggctgcaccctcaatctgtaatctgaaggtcagattacagtttaattcttcttgaagccctcatcaagtttcaaagagaagccttgttatttgccctttgtaagaaggaacaccttgaaaggccatgggtctgtcttctcatcctagaggccaaggggcactgggactggagtggcagggaggccatgagccccctccccaggtgtaagactcccagtctggcactgcacctctgagggcatctgcatgtggtggtccctgctagtggcttccagaagtaccttctggcattggctcctgaggtcatcacccttgttgatgacagctgtcggcaacttgccttactgaagcctttcatcctccctcccaccggcagcaacttccagggtccttgatgcatctccaacacgcttcctacaataatgtgtagccgtaggaaagtacagactttggggtcacactagcctggtttaaaatcccatcaccctttcccagctgtggtactttgggcttgttgtctaatctctgagtttcagtaaatctgtaagataaggattataacatctttcttatagatttgttgtaaatattaaatgaaatacatagaatgattcatatgtggctagtagatagtaggtctaaataaaagacagatgttattattattccagggataaattggtagctttgcagtttggtgttagttttagcacttcctatgaagacaaaaaaaaaagcacttgc

SEQ ID NO: 122934 - DNA, 1055 bp, Homo sapiens
gaagtttctttcttaatactaggcgttgatgtatttctcttatattctgtattctttctcatcttcaataatattagagagctaaaggcctttgagaagacagatcaacaaaaatgtatgcctgaggaagatttccatctttcatgcaatttttaaactaaaactttgaaatctcaagtttcttaggaaaaactaaatgtctgccttttttttctatgaagtttatacattgaaacctcacttataaaaggaaactcatgacagatgtaaccaggtagacactaggcctcctggtacttggcagacccagatccttttggatagggccaagatgagttcatgctatggcagattgcagtccagtcatgagcaggccaagttaatagagaagtgagaactgggaaagatactttttattcctatgtcaaaatttcaagttcatctgcacattagaatcacttggagatgttttaataattccagtgcccaggcaaccccatcccccaccagtcaaagcacaatccttgggaggtggacacaggcattaatatatttttcaagtttctccattgattccaatgtgggccaagttgagtaactactgaccttatatggttaggttgtttgataggaatcaggcaattcaacctgcagaagcatggaaaattgcagacataggacatggggatacaaagcaagattccatacacagccattcagagtgaccatctgatgttttaaacaagggctagcatgtgcttgcacatttaagattattttttaagataggaaaataagcttggttttcctggcatggaaacccttctgggataagcttaatgagtaagtattttctctaatttatatagtgagggctgggcacagtggctcatgcttataatcctagctactcaggaggttgaggcaggaggatcacttgaagccaggagtttgaggctgtagtgagctatgattgcaccactgcactccagcctgggcaacagagcaagactctgtcccccaaataataataataataatttatggactgacac

SEQ ID NO: 122935 - DNA, 1170 bp, Homo sapiens
cacacctgcaatacaccccgcttcatccctgatgggaagggagaaggacctaggctttggctttggggacctaatgggacagctctcagaggagggaagggacagagcgctttagtacgtcgcggacttgctgtctaggagtggaaatctcagaacttcccaaatcgtggctatttgggagcctccaggcgcggggctgatgtcagctacaccattctccagaagaatgaagggcccctaagaatcgcttagggactttcctattccgagagctgttcaggaagccacatttagagaccaaaatcgaaggtccccaggcaaaatatcctatgaagtgacaaaactttggcttactttaataaccaataaagttaatttgaccgctgctgatttactttgaaggagcctaagtaaccaccttgcctgttcatgggtgctttactaaatagaaagaaaaaaaaaaaggaagaagaagattgtgagatgaccagaatgattaggtggctaggtttcctggacatccttgcttgatcgtgaccaacgtttggatggcggtgaacgtacacgctttgttattataaaaattcatccgaacatactgccctttgctaaaagtcttgatccagatgaaaactccgaattgttctggcattgcattaaggctttgatagtatttaaatcagtgttctccgtggatttagagtgcgcttcttagtaattttatccccaggttcttttcgactgaaatatgccatcaaacttgaacgctgattctggcactgagctgttaactctggaaggaaataaagtgacaacaataaaaagttcaaaaccactctattatctattttttcataaattaatcgtttcttcccccaaataagtaactttacaactccaataaaataaagttttatgaggattgcattctgctgaagtcactgatgtataaatattctcctcctgcagcatctcagacattaactttatgaaccaagtatttgaccacaaatgcaggcctcactaggggaatgactcattctcctgtaatataaagtagacaataccttatttaaatacctatttaacgttttttaaaaaagaaattttaccgtttagggagaggagtatagtatgccccttaactatccttgcatgttctacaaaagg

SEQ ID NO: 122936 - DNA, 1040 bp, Homo sapiens
atgcagataaagggcttccacatccccagtatctcaaacataaaggatcagacatctaacagtctctccttcaggttccctctgattcaagtcatctgtgtttctaaatggccgttgaattgatttctctaagcttgcctaccctgtgtgagtgaagaacctgacatataatatttgctcattatttatcaaagaataggatatgaaattttttttgatagagaaagttgagagccagtttatgaaaaggcaatttttgtacaactgtttatcagtgttgattcaaaaggcagagttgaagcttaaagaagtatattagtcctttggctgtaatgcgtgttttctcactttaggcaacagaagcagcagtatactaaccagcttgccaaagaaacagataagtacattaaagagtttggatctctgcccaccacccccagtgaacaggtatcaagctttaagacacattgttgatgtattgaatgtgaaaaaaacccagtgcactgtaggatctttgaactgttacgctagaaaggaaattatgctagaaaggaaatcaaaaataattctgtttgagattagttcacagaacacaaaactatatttaattgctcaggtagtatcctgtggttcaataaagcaaaaattatttccatgcatttgccctgacccataattaagttagttctcagaaaatgcttcctgagtaattatttcctggccttccggggctgactgcgtggaacatgcaggctcattcaagatgtgaggtgtcctgggggcacatatttatttccctgcttatttaatggaagttattacttagctaaaagtataaggctttatttgcctgaaaaagaattactttaaaatagcctcaaaataataagctagtttttagcagcgtgaaaacctgaggtgagaaatccagcataatgggtcttttgcctcaagttaaatatgcacagtatttgacatactatcagaatgttactgagagttaatctgtaaggccctgtaattggggagtaagtgaaaac

SEQ ID NO: 122937 - DNA, 1998 bp, Homo sapiens
caggctggtgtaaggacttttactctgggtggagcaagggttatgaggagaggagtgcagtgctggtgcagaggcagtgcaatgttggactcaaccagaattttagattttgtcaagtggttaagaagggagagaggggcttaagatatatgcaagagtctggatatggactgactccagagtttaagttggttagggagtgggtgacgacattggaggtgaggaaatgtggcagagtggcaggatcaatggatggcaggttggagttggggccaggggagtgagctggacatgcaggaggtgatttctaagtagattgcctgaaaccaagattatggaagagtgacagttcctggtaatgagaaggtgtttgatgggatcttggagtgtgtggctgagggagggtggaggacagaatcatttcagtaggagacgtgtgcaaagaatggaggccagcaggatggtggaaggatcgtcagcctgtgtattgaaatcacaaaaaaattaagataggagtcatgttggacagaatggcagcgagccagaaactacaaccaatgaagagtgaggggcggcccaaggaacctaaaatgactaaacctgcagtgggtggtgatcatgaggcctgatgtgttctgcgtctgtctgttattgtgcttcttgtcatggggtctttatttttgaatttgtccttcttttctgagttccttcagtctctagttagtcagtgcatgcatgttatctggccatctcttaagagttcttttgtgatcttcctttaaactgtgattacttcattgagttttttttttttcttttaatcctgtgggtattttggggtataatttttaccatattcactttgtggcaacatgttctcctgctgtgagttcttttagggagttttactgttcttttccacattttaaaatagtcttttgtgtggttactctccccatttttttttgtttttcaatggaatgagtttgattttcctggcaggagattcctgtggagggagagggaagtgcccatttctctgctcaagggctctattctctctgctgtgctgtgctgtgctgtgctgtgctgtgctgtgctgtgctgtgctgtgctgtgctgcactgagggactgtttctttcctcctctgcctctcagcccctagcctggtgtaggagggcttcccgctccatccctgatgtcatcccaatcacttcatcggccccaagatgcacagacacctctttccaaggtgttccccacctggtttttgagtagggtcggcagcccatggcctcctgaatctgttccgtgtctccttttcccaccttctccagcagagtccccggtgcttctcagccctgcttctgcccattctcactctgggtgggatcagctcttctgatgatttgctggtgacagtgtggagctctgcaaccccggttattctccgccccacccatacggcttcctgctcaggacctgctattttctgttgcttttggccgtatgtacacgtttttgagaatttggtcatatttacacattttgtgttaatttctctgaaaatgtaatttttatgggttttctacctgctcccccattctataatatgccttgaggagggaagaaggaggaatattcagaaacatgcttctaccgtgtttctataagaagcagaaatcgattttcagtgttttagaaacagctgccagcatgtgttggcagttagaactgatcagaaatgactgaagtaaaaggtttgggaatcactgcctgtaaactagaggggaactcgtgacaacaattcagctgcttttggagcagtaggagaattattgggccctcgagtggatgacaggaaggaagctcatcatgatgggcaaaagatgtgtcagcggggttggggaattgcaaggcgcaaggcctcaccactgcccagtcctttcctgtttgcttcttacacaaatcacattgttatggaaccgttgttgctt

SEQ ID NO: 122938 - DNA, 1039 bp, Homo sapiens
tcttatatgttcttttggtgcatgtatgtgaaggaattgggttactggctcataggatatgtttatgttcagcttttgtggataacagctaaacagtgtcctaaagtggttgtaccagatatgagtacagccagtgtatcagagtttgtgctgctcaaagtccttgtcaacatttgatgtttacagctttttattcattttagtcataggtttctcatgatttactttgcaattctctgattagaatcagagtttttagagtgtagctgagctaaagaaatcaatgagataatcggaaacatttctaatcaagcaagctgtatgtgattgcatgtacatttcctgaaatcagatccaaatagcggtgtgaccttgagtaagctctcgaaccttccaagacatggttttctcatgtgtattttctgtgggctaggttatggtctcttcaaactttaacaggcaataattctaaccaaagttttttaagagtcccgaaactcttctaacaggtacaagattattctatgttttgttaagaggctgattgccatatctgaatccataatgcatgctcataaaatcccataattgaagaagccatcacactcaagactagctagagttccaccaaggcttatgtattatttttaagtgttaggagatgggaaagctggggcacagaggtttgtatcctgtcagaattaacaaaattttgtattgaaggaaattggtgaatagaaatgagaatagctatgaaacacagtccttgagataaaaatttccctaactcctaaataacatagtaagcctttccactagtgctaatgtgaattctcgcatttgagtatttttttttaaaataataacctgaaagaggaagatgtagtgtggctaaagttggaaagtgaataaaacagatatattggaaacataaaatctactcatcagaatttatgagtatagaagtttctgctaaaatatgcatcatgtatcacatgggcttgtggatgtgtgttttttccagaaaatttggaaagac

SEQ ID NO: 122939 - DNA, 1063 bp, Homo sapiens
aagaatgtttcaagaatgagtgaggcattatctctccctaatgctgctgagagactaagataaaagcagataattggatttggtaaactggtgactttgaaaagaacattctcatagccatattgcaagtgtagatggaggaagggaaggagaagcacccactctttccattttaaagagactttccagattttctcctcatctctgcttatgtcattgatcaggtggctacacctagctgccagagaggctgaaaacatcttagcaggatttcagtgtgctcactaaaattggggattattctatttgagaaagaaggatgagagaatcaatatttagtaggcaactagcagactctgctatgaaagtagaaagaggatcaaagaaagggttccattttacactgcaacagagaaattctggtaagcgtataattgcaaaggaaatgttttgaaagtgagggcatgggaatggaccactagcaagttcacatttcatccaccgtatagaggtgaggctacgtgtggtacagatggaaacatggtgggcaaacatgggagatttcctgtttgagtgggtctgttcttaaatgaaatgggaagcaaggtcatcagatagagaatgggcgggaaagaagggggtttagcaaatgtgttgagtatacatttaagatttggggccatgaatttagtgaaaccagtcatcactgtactttttctaattctgagattcaatgtctaaatgaaggggagtttagattagataaagtattgttaaaaatctaactactgtcaagtatgtgtactgataagggctatgcagaaatcacgtggaagtgaaaggcagaagtgtgaaatttcagttcacttttttccccatttggtaatgctaataatactgggtgcgattgaataaaatgatactttgcaccacatttaggttctcttcacactacatttgcaacttttgaaattgtgtcagtacaattatctgattttacaaaagaaacctaaagagaagatgctgtaagtaaggtaacctgtaattagaatatgagcatctg

SEQ ID NO: 122940 - DNA, 1036 bp, Homo sapiens
gtaggaatgtagcagtaaacaatctataaggtcctgctctcattgtagtttacagtgtagtaaggagaaataatgagcaacttaactttctgtaaagaaaatatagtgaaagtgaggtgagagcaagtgactggggaagctacctttactttagatggtctttgaatgaggatgaggagggactggtagtgagaagattcagagaaagggcatttcagacagaaggaataactagcattaaaaattcaaaagcagacctgggcttgaaatactcagaaaatagggaaaagggaaaaagctagtgtggctgaagcacagcatctggggcaagagtgccaggagatgaaaccagaggggtctggcgggtcagctggggccttgcaggtggttcaggaagtttagatttcattttaagaggcagtggaaatcactggaggcatttaagcagaggagagacataatcagatctacactgtgaaaaaattactttggctgctgcttagaaaatagacattgagggaatagcagggaggtatgctggtcatcacagaggtctggggagagctcggatgctggcttgcaccagggtgatggcagtggggatggagagaagcaatgagtgtgttttggaggtagagccagcgggacttgctgatgcatgtgggtagggatggtagaggaaggaaggagttaaagatgactccatagtttttgcattgagcaaccgactaggtggtggcaagtgtgtactgaaacgggagggactacagttcaggacaagtaggggagagttttgttttgactaagtatattttgagatatcatttagatatctaagtggagatatcaaacatctactttagatacaggaatttggaagtcagagtgtcctcagagtataaatggtatttaaaaccataggtgtaaagtaatcacgtaagagtgaggaaagagaagaggcctggaacattaaaaaatgtggaaatcaggaaggtagcatgaagaatctaaggagtgacctgtgaggtaagataaa

SEQ ID NO: 122941 - DNA, 1054 bp, Homo sapiens
aggctattctttttaacagaatgttaacacattgcagaaatagtgttttcaaatgaccatactctgtttctttatctaatcattaactcctcaacagctgttcctctacctgaattatttaaatgagatgctagtgtgttttaggagcaaagagaataaaactagactctaaaaaggtgctgctgtgcacagtggtataaaataacccttattctgatttggggtgatttctgggttttttacctatttctggaagaacaaggaagtgcacagtgccaggcaccacgttgtccacagcagggactgtaggaatggtacattgagaactgctgcagtttgtcacaggccaccggcgttggctctgctttgctcctctggcatcagatctgttctgatggtggccacagaagagcctctttccttttcttttttttttttaatggctcccttgctgctggttagaaatagcactggtctgccccaagtgtatctggctacctgtgcaaaaattaaggaagtttataattctaattacatatgtggaaaattaggacctttatgcaagaaaggaggccaagaggcctttctccaaagaagaggataagcatcctgtgttgggaaagctaaacagtgttaggaattgaggatgaggaatgactgtcctgtactgagattgtagaagtagcaagcagtaggtagtatgaaagatacatggattgaagattgtgtgtgaacatgaactggaaggagaaaagagttgacttaaatcaggccatgttccctaagaaagagatcagttgatccagaggatgagaagtgacagattgggccagagttgaatatttatggcaggttggtagctaagtgtgcgagtacatccggggcagtattggatcatgtgaaggtctggctatgatactccacagtctatgtgaagagctgttaagaagactgggactgttggcagggcatggtggctcacacctgtaatcccagcactttgggaggccgaggcaggcagatcacgggaggtcaggagttcgagaccagcctg

SEQ ID NO: 122942 - DNA, 1032 bp, Homo sapiens
ataggaaatggcacccagcaaaggcccaaggcagcaagaagcctgggaccttcggtatctgaaagaaggcactggaattttatgttttggaaatggtaatatttaccctcacgctgggtgtgtgttcttaggaggtgggtacattcattcattctacaaatgtttgttaagcacttgtgatgtagccaggcagtgagaatagtgcagtccacaaaacagacaaaaaaatgctcaccccccacccctcagaacttacttggggtagagggtatagagaagtccagttgtttatgctgatgctaatgattaagaaagtgaaattgactacttctttgcccagggtagatttatagagcatgagatatatgctaaatggaaatcttaaggattctacagtatatcggattttaactgggagtagtgtttgacacttcaagattaaattttaacattccttttgttcattcctttgtgttctttagaagccgtcttgagaagactctcatctgagtgttgcactttgattctcccttcctgtttttctctttatagtgtttgtatatcttcatagaaagatgattattgcaatgtggagattagcactgtgcaatagatctttctgtgataatggaagtggtctatgaatgagctgtccaagctgctggccactagccacacagaatttttgaacatttgaaaggtgtctagtgtgactgaggaactgatttttttcatttaacttaattttaattaattttaattttttaaaaacgagagctacaatgtaatttaagtgatacacaatataaaatggtgtaaattgtcacatgaaaaaatgaaatgtagagtaaaagtgtagtttcttactgcaatcagttatcttgttagcagcttaaaataacctgtaataagatttttttgcttttattattttaatcgacagataatgatttacatatttgtggatacatgtgatacatcagtagatgtgtacaatgtgtaatgatcaaatcagggtaattagcatatcca

SEQ ID NO: 122943 - DNA, 1079 bp, Homo sapiens
tatttgttttctccaaaacccttttgcagtcagctctggctgctggtgctgatattagttgtaagtggcctctctgctggaatgagtataattccaactttcccggaaattctcagttgtgcacagtaagttacttccattgcttgaagagctgtattgtgaataagtagtaagtatcacaggctttcttgaatttctcaattttgcagcatgttggatatttttgccccaatgttaaatcttcatgattttgtagcatatgatattatgatataaatagtaataatacactaatagaaatgataatagtacattaatagctaaaatgggttgtggacagatgtctggcttggtttatgcctcagtatgtaagtaattttgaaaagctaaagcaaaatagataggtctcagcattgttcctctttcatggaggaggtccatgagagagcctagagtgaccagcatctgtcacctggtcatcattcttttgtttaataggcatgatgatgaagaacactaagtactatggctgtgctgggtcagttcaatagttctcatgggaataaggaactatctctgttttttaaaagttgcctttgttctctttccatcttcatctcattttaagaatttcttaattatatatttttataagtatttaatgcaaatgagccatgcttcttaatatcatatatatatgcagaaaaattatttctagaaaaccatggagtaaatgtaactatgaaaattcttttaaataagatttgctttttatcttagaagcagagtattcttgctgttggtttttttccagattatccttggtttatcttaattgatctatcatacaattttttctttcacacaggttttccttttaataatggatacactcatgtctctttttgcagtgaaaatgggtttgaagagggattaagtacattgggacttgtatcaggtctttttagtgcaatgtggtcaattgggtgagtagtcatttaatttctttctttttttttttttttgagatggagtttcactctcatcacccaggctggagtgcaatggtgcgatcttgg

SEQ ID NO: 122944 - DNA, 1074 bp, Homo sapiens
ggcgcagtggctcacacctgtaatcccagcacttcgggagtccaaggtgggcggatcaaccaaggtcaggtgttccagactagcctggccaacatggtgaaactcccatttctactaaaaatacaaaacttagctgggcatagtggtgggcacctgtaattccagctacttgggactgaggcaggagaatcgcttgaacctgggaggtggaggttgcagtgagccaagatcccgacactgccttggctacaagaacaaaactccatctcaaaaaaaaaaaaaaaaaaaaaaagtgaactaggagaatctatattaaagaacccctgtatcaccagtgtgccccctgacttcattttgggggttagaactggttatataagtaggacttatataagtaggttatataagttatataagtaggttatataagtaggacttaaaaaaaaatgtagctccctctaaggagggaggtttgtgtgaaaagacattttagtgcagtgaaacattaaagcagagatccacgatgtctgagtcaatagaacagattagcagctgctgaaagatagaaaccaagtctgagctggttggtactgggaacaactgccttagctaacaaggcacttgatcattttccccccacataaatatgctgtttggcagtgaatgttttcacttaggtttcccaaattccctgcttcttccttaaaaatttgtttggggaaggaatctaatatgcttagcatatcaactgtactgtctttagataatgagaaatgcgctgaaagactatttgccacattctctttcaaaaatacaaacgtgttaattataacctccaaaaaaggcaagaaggatttcatgcctttgcccctacactttcatccatttagaataccctcctctccttccatgctcaccgatttggaatctcttagtttttgttttgagcctgtttcgaatgctgccagaagcctgaggtcctcttaccttttcacaccatccccactccctaaccccctgccactttgtatctcctctgtggccctgaggtattctgatttttgtctaaaatct

SEQ ID NO: 122945 - DNA, 1414 bp, Homo sapiens
cacatgcgcacaggggacctgaaaaacccttaaataccggcatgcgtgcggatgaggcctctttccctgccgccgccgagtcgcgcggaggcggaggcttggggtaagttgagcgaggcggcaggggggtgtattggttataatttgtggctcgttgcgttcttgctgggattcgtgacgagtatctggttctttaacaagtcaatgcttttgttttttagtgcgttcaagattcaacttcacccgtaacccaccgccatggccgaggaagggtgagcccaggggccggggttggagttggggtcggggtgcggctgaggcgtggggctagagctggcggaacaggactgggtcaaacgggtcgccgtaagcgcgtctgttgtacacttagcttttgctgagtgcaaggccttatgtggtgtgaggattttaactgatggttctgatgtgtcgcgtttaagcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggtatcagaactcagatctataaagcccacttaaaatgtgtgggttgctgtttggaatggggataagcactcaaaactacagtgtttgaatgatgactttaattgtcggataccccttcactccttttatgagtgaaacataagagtctgacaaacctgtaggttgtggagctagtcagtcttatacttatctggcagatagatgagatggagagccacattacatctggtagtttgcaaaacaagcattaatttaatggaatttcaaactcaggtttcagaagcatttggtcctagatgaatttagtagtataatagctgtgatttatttgaatttgggatatttgttaatgtatttgaatggatcgagttaatgtgttttttagggtggtggcattgacaaatcaacctactcttgagctgaatttaaatgcagttttaaggttttacaggacaagttcgttttggtgtaatctagccagttcaatccgatggaaacggcattattgtttaatgtatttagtaggtcctagtatgagtcttctgtatttctatttcggcattattgcatggcatttcataactgttccattaatgccacagtcttttttttttcttttttcttttttttttttgagacaaagagtcttgctctgtcccccaggctggagtgcagtggcgcgatctcattgcaacctcta

SEQ ID NO: 122946 - DNA, 1807 bp, Homo sapiens
gctggcttacaagaaagctattatggttgggttttggccagaagttttaaaaatgacttacaccaattcagtgtgtcagggacagaggttttactgaagaccagttgtaggttaattgaagatgtatatgctccctagcaggttcttcagactcaagcaattttgtacgcatttatgtgttcagtggattggctgcttatgtttcgcaagtgttagtgcaaagataaccctcctaaaatgcaagaatgatggatttggatctgagttttagctccattttcattgtaatttgaatttcaggcgccaagcccatctttgtgtgcttgcatccaactgtgatgagcctatgtatgtcaagttggtggaggccctttgtgctgaacaccaaatcaacctaattaaggtaaggctgctaaggattgtgttgggactaatgttcagtgatgcttgtatatgggggtaaattctgtgaagtctcaagctgttcattttgtgcaggtgtaaacattacgtgcacctgatactgtcggccattttaaagatgattgtaggtagaagcattttatacctgcagaattgaatcctaattttgacgttggtatacaacaaagattagtagcaggcttgtaggtgatcttagtgctgtacatgatgacaactggctccctctactgaactgccatgaggaaactgccatgtcacccttctgattacagccaccttttgggtttcatttaattttggtagtgttaatgtctattaatgtgattttttttttttttaacctttctcccaataggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggagtctcaggccaaggatgtcattgaagagtatttcaaatgcaagaaatgaagaaataaatctttggctcacattcctcatgtctggctttttatttggggcagtaaaataaggtccctgttagcaaagtaaaatgtaatcatcgcaaagtgattgctacagattaactggaaacttgctctcaaagtcttctccccagccaatgactgcatcatggggcaattcaaacctggacagccttagcaaagataggtctgccatgcagtgttggtgatggccaggattacttagctatgggcatttatccctcactagactagcctagaatttggagagagaggttgtgtttttaatagattgcagtctatgaaaggacagtgagtagacttgctgggcaggttagtagaaagtacacagttgggccaggatcatatcttgcatgtgggacaagtgttatgatacccaggaatgcttgt

SEQ ID NO: 122947 - DNA, 1427 bp, Homo sapiens
gagacagagtatcgctttgttgcccaggctggagtactgtggtgcgatctcggctcactgcaagctccgcctcgcgggttcacgccattctcctgcctcagtctcccgagtagctgggactacaggcgcccgccaccacgcccggctaattttttttgtatttttagtagagacggggtttcaccgtgttagccaggatggtcgcgatctcctgacctcatgatctgcctgcctcggcctcccaaagtgctgggattacagccgtgagccactgcgcccggccagtttaagttttataaatgatatcaattagaattctgtaaccaccagtggacactggctgttttttatctttcttccaaggttactaattttgctcaattgcaatatatatgtgtgaaatacaaataaattataaaaatttaaaccgttgattttcaatgttttctccaccatactgagaatatgcctagaactacccgaagaacaagtttccagagaaagcctattctggaaaatgggcataatttggagatgatcaaggcaaggggtatactttggagattaaattctccacaccatagctccatggaagcatcatctatgttctgagcctttatctcccgtgcctaggacagtgcgtggtgtagtaggaactcagatatttcaattgtttgtttgtgggctttcttttcagtcttaaactcctcagccttttttcaccctctattttttaaggttccttttcctctggcaacgaaagtaagtctctaggttgggctgctttgagtcgagtgtggagccaagctgtctcaacttcctttctctccagctccactctagggagcagggcatagaaacatatcctatcacaatatggagtacatggctctaagaagctgaaaaaatacgtttaaaggccattgtgagacctgggaacagtaaaaagcatgtgaattcagagaaactatttttacattgcaataagttcttttttgaagcttatttatcgagacatatgccaacagcacggaattatatgagtgatgtgaattaaaccttacacaaatgtagtatttgtctttttatttttccttctctcaactacccccaactaaaatttacaaatggatataaaaatcctgtttgtacttggttggctcgttagagaaataccgagtcaaaggtctgtgatatttcacagtgctgcccccaggtgaaaagaagcaaaatgcacattaaaaaaaaataaatatgagatccataaggggaaaataaaatattagcatataaaatgctacaaattaaaaagcctgccttctcctgtagatttgaagctggataaacttgatggattctaggagtcagcagatgttttgctaaatgggtacatgttgtgtcttgcagggaggtacttagccccacga

SEQ ID NO: 122948 - DNA, 1001 bp, Homo sapiens
gaccagcctgaccaaaatggcaaaaccccgtctctactaaaaatacaaaaattagctgggcgtggtggtgggcgcctgtaatcccagctactcgggaggctgaggcaggagaatcacttgaacccagaaggcagaggttgcagtgagctgagattgcaccattgcactccagcctggacaacagagtgagactccatctcaaaaataaataaataaataaaaaggaagaagaatatggagccaggcacttgggttcagacctcagctctaacattgatgagtttgtaacatcaaacacattactgaaacagattttgcttcagtttctcatgtgtaacagaacatgcctcatggggttctgatgagaattcaatgagtaaatatatgtaaatatatttagagtagtgcttgatatgagtatcagttgttattactatgattgggtatctttcattagattacccccaaatgttccagagatatttagagctgaaggtcttttttggggggctatggattggtgaccataaatggagtgtccagtagtccaagtataaattagatactgtgggtcatcttggcaaatctgaggttgtatttggagccttaagagaagacactataggtgctcaacagttggcattggccatttacgttgtgcagtaatatttcttttagtaaatatttccgcatacagtaatctagattgttttagagctttaatctgtgtggttccttaactactttaagcaattataagcacgttgtataatggtagtactttatagccaatatttaagtttcctcagttgcttttttttcagccgtaaggtaccaattatgagaatttgtataattttcaatagtcagtgggcctgatgaactcaatgtaaactttttaaaaggtagctttacatattgctatgattcttacctttagagagacagtaggaggtaattagtacctctacttacagaatttatcacttggattcagatat

SEQ ID NO: 122949 - DNA, 1133 bp, Homo sapiens
acatgcaaaatgaagagctctgtctataaggtcccttctaataccacatgcctatagttttcccttggggtgatctactcagcaagaacacggactctggagccaatctgttgaattctcaaatgaactctgccacttaccgcggtaagtatctttggtcatttagcctctcttttctctagtctccttgtttgtactttgtactaatcatcatgcaatatgaatgcattgtctacatcggacagaaaaggaaccagaagcatcacagactcttgcaacaccattaaaaccgccaggaaaagtggttacatttggcacaatgtcgtctgtgatcatatcaaacataccatttagaagaacaaatacacacacacaatgacatctattaagcacatagataatcattattacttaagagttaccaataatggcagaaatataacagacatgtccttcatatgcttctttccttacatattttattctttgatagaatctacttgaaattttgaatatcagatgcaatctaatggacatagttgaaaaagacagacctggtttccagttaccaattctgtggtcctgaataccttcaacttccccagtggtaccacatgtagcatagatcttggtgtaaggagagctaccaccttgggttagtgagaagattaggagaaaacatgctaaggaggctgtacaatgctaactcaccatgaatgctcttggctaaatgatagcaattattatcttagccagcaaagttcctattcttacaagtgaaactcaaagattaaaaaagaattaaaccctgtttgctgagcatagatagaagctttaacagtcaaacgctagctgacatttattaattccttaccatttggcaggcacacggtaaatatgaagtgatttacaagttatttaattccttacaagcaccacttctcaccactccattcctaaaaactggccttgtaaccggtcttcctcgtgcccttgccctagctaggctattctcaaaacagcagccaaggtgtccttatgaaacatattatgttattacttgcccaaaactctccagtggctttatctcactccaaatcctaataatgaccaataaagacctacaaactctg

SEQ ID NO: 122950 - DNA, 1068 bp, Homo sapiens
ccattcaagctggactatcattttgatattcttcctcaccatatagctttgctcaagactccaccctcaacaacaaagtaaatgttttaactggagctctaactctttaatagcttctttgcttccatcctctttttctgcttctaagaaatttaacttctcttcttagtttttttcttaccacccttctcattttttttttccattccttccatcttgggctatatttcactttcagaataggactttcttccatttccctgtagcactgagcctaagactatgcccttttatgtttcctttgcctttccttgttggggagaggggtttaggattaagtgtaggtgtatccacatctcctaagatcttttaagattatattttattttcattttcttcttagtaagcaggttctcttatttaaaacctctccccaaactcatgtcgataacattttattacttttttaaagatagaagttacatattggacttataaggtatgggagtgccagggtgtgggagagcttgctttgttaactttttggtttacaatgaaggagatgctcccttttattttggatagaaggacattgttcctcctcctgtggagtaggaaagtttgctccaagccaagcatgcctccttcctgaggactgaggaatagctatctgcctgtgtctattcttcacattgcctggagaaagttagaatagaggtggagattgagtatctagccacatgaagtgattcttactgtcattcatatttaacatttattgcctttattttggggaaaaatcatttagatggaagactcctctctttttaattttatctcccattccagctgatctacagtatattttctaggagaaaatagatttagatactaattaggataatttaatgaaatataaaatctgtgcgaggttagttgttgctattccaataggaaaatgaaactggattcagttatcttattgctaaaatatgctaaccaagattcagctattcagataactttagagctgtaaaatatattttataactctgttttcattctttc

SEQ ID NO: 122951 - DNA, 1030 bp, Homo sapiens
cagatggaaagtgtttttacagtagggaaataattaaattgggtgtggagactttgacaagagaattcttgaagtgacatatgtgtatcagcaaattctttttcttgcttggccttaattcttttgggaagaaatgcttgggctgcagatgtaatggtatattgggaaaaagaatttacaaacccatgcagtataagtacggcaccaaactatcttctttgaaatagcattacatgtatatagtataagccagatgtcaggaatagtattttttccctgtttcctaaagctactaaacttgatgtcatgtggaaagggatgtgatgtgctttgtgtaaaatttgacattccttaaatgtttttctttttttgctttcctctgtgttgctaaccatgtccaggatgtactattgttcctaaactaatgttaaccataaaatgaatttatgagaaaaacaaaattaatatccttaccctaaaattaagtttgttactagatagaccatcttaaaacataaactgaaatgatattttgcattgatgtttttttctgtcttcatggtgaatttatttgtgtcaatttgggtcccatttgactcatcaccgaaaatacatggttcttgtttaatgtaataaatagctcctggacaaatgaattttacagcagaagtttccatgaatcttatttttttaactcctctactttcagtcctttttatttctgataatgaggtgaggaaataatttatttcattcttgtattgcatactttacaaatatcttagggtgtctctgtgttaaagtagtccctataacacacaaatgatttctctgttgaatttctatttctgtttctctttgcttttcctctcttgggccactgactagcattttcaccaagaagagatcaaagacataggaaggaaataaaactcaaaataggaaatttttattttatactcgttttgttaactagagagtgaatagaaatagaaattgtggtgaaattgggctgtgaagtgacttatca

SEQ ID NO: 122952 - DNA, 1067 bp, Homo sapiens
tttagaagttatcattcccataagtgcattcacattatattttagtacatatttatgaattcagaaacaatatataatatgcttttgccagttttaaaaatccacataaatataaaattgtatgcataatgctgtgacatttaaaaatctaagattatattctttatatttattcctattaatacatgtagctctagctcatttattataaccgctgtatagtatttcattgtaattatatggcatagactatgctctcttttagatagacatttaagttatttctaattcttaactcttagaaaccatgttatggaataatttttctggagttgaaacagaaaagaggaatttggggacttagtgcaaggtacttgcttcaccatttattgtgtaatacaagttttaataacagtaaattaaagtattagaatgtgtgcattcaataataacattttgtaaaaatatttcaaagatttcaataaaaattaataaacacaattggtagaatatccctctgcctgctattggctttgctgcctccctagtctttagttccctcaacccagaatacccttggaattgccccttctgacttggctggccctgtaagggcttcctgtcttcctgctgagtgtatgcagctttgagtgaagttctttctgtatctctggcaacagttttgttttctctctctacccaccttgcccactctctgactgcttcccatcccaaaggagagatgtgttttcagatggcacttctcatctctactcagcctttttttggagggtgagtggctagatatgggcgatggggaacacaaagggaaatgctaagacacaaggggttttcatgagtggtaaaatgactggagggtttgcaggaggatcagggaggagaaagagtaaggaaaggggaaggagagagggaacagggaaaaatctaggaggggtggactaagatattatagtttcaaatatcagtatttatgcaaaatacacaaaaatatatgctagtactttaaaatggcacctattaatggaaaattaaaaaccggtgttaca

SEQ ID NO: 122953 - DNA, 1064 bp, Homo sapiens
tcaggccggcatcggcctttccaccagagctcggctgcagtcagaagcccctggcgttagttgaggtcaatggcagccctgatttaattattaaaagaccacgccgagccgggttcatgggtacctggcctctgattggtgggaatcagatgaaaaaaatgaaaatgccactgcctttttaaaagagaagacgtgggctgaattcttggggttttgacagtaggcaaccatttaggtattttattatttacgagatctccaaggatgcctcttgattttttgctttcccctctgagtgttcagaaacatattcgagcatttgaaagctccgtagaatgatggagtttgttttcatttctgtactaatttatttttcaagggatagtgattatagttgggtcaggtttaataaagaaagtgaacaagaagctgggttagaaagtaatgtctgtgtggtggtggggagaggacttttaggaggtaacatctcagccaatttctaaaagggatgggagtgggaagaatgtatgtagagtgttccagtcagagggaacaagatatgctgagtacttgctgtgctggggtattagtgtggctagggcatcaggaaacagtgcaaaggaagaatgacagtcattgaaattggagggaaattaaggtcttgaactttcagtgccttgtagaccatagaaggagtttggactttcttccaagtgctagggaaagtggagttttagcctggaaaataacatgatttgccaaggaaacggcaggggagactctctattccagtggctactgccactcctgaaaagtcaacgttacagcaatggcgacaagttctaaggtccttacgaggcattctccttcaaggggaccagccaaatacctagaagcaggaatgtcaattactttagactcccttttgtcatggatcagccaatagtttgcttccctacattagttccacattctggaatgggatttggttttgctgcaagcactattccctattaattatagacctattatactattccggtgatggttaacactaaaagccc

SEQ ID NO: 122954 - DNA, 1060 bp, Homo sapiens
tctgtgagctctctgactgcatctgtcacctgcagttccaaagcgacactggcagtaagtgcatgagcttctgtatttagggtttagaacagtgccttaaaactgtgacttaagaaaagggagcaggtttgcgtgtgtgtgtgtaagcaatgtggattctctgggaaaatataaaaagagacataagaaggttcagccatcctggcataatttcgcagtctctttgagaaaatggcagttccttcctattgagaagtgactgttagcactatctggttgaaaggattattcacagtttggtatgcccagtgaaatatcagtttatgttacctctttagtcttacatcacaagctgcttaatggttttatactttacaaaatcattttgggtgagtaaatgaggttttcctgtagcacaatgaaaaggccacatatacatacaaagttctttatgtaaagttgaagattaaagatgaaaataaaattgataaatcataggagcaattaggtcaaccacagcttctgtttgttccccaccccttttgttaaacctgacttctcctaagcaaaaaggtgtcatcctttccccagcctcctctttacgtaccctctgccctcaaaatcagtatcagaaactctagtgacctattactatgtgcccttgattgggctggcttgttcctgaatgagggctagccagaatatagcttcaactcaggcgttttcatcttaagcttttaatatggaattgaggtccagtgtctgttaaaggaatttcattcatgtgtaaagaagtggacaggatgcaaagtgtgaacattgggaaacttaagttgcattttaagacattaagaagaaaaagatagattaatgaatcaaagactgttgcttaatctttgtagcagttctgtgaaggatatactgggatagccatacttgaggctgtggatgttgagtcctggggttatctttgtgcatatgagacttgacgaagtgtccctcaacctcagggctgccatcagactcacttgacccagatctagtttgccgttgtctgtct

SEQ ID NO: 122955 - DNA, 1314 bp, Homo sapiens
gaaagaccttccctggatcattgctcctgaagtttctctttcattatctcgtttcctttataacatagatcacattctcttgattattttgtcagcctatttgttgtctttttcttccactgaaatacaactgccatgagagttgcttgcctgaccattttgttctgagctgtattcccagtgtctacccgcagagcttggttcacatgagttgcatactaaatatgcaattatgcgtaaaagtttcctagttgaaggagtggggaaaggacgatttaggcagctataaaaccgcgaaacagtctgttattggaagaggaatggtgtaaagctgagaatgttaaggtgtgttggaagtggaagattaggttatataaggaagatcgggggtgggaagtccactgcattccaaggcaagcagatgagattctgtttttcattctaagagagccaagagatgcttcttcagatagggagacaattaggaagataatcctggtagctatttggtagatggattagagcatggagaatgcaagcagagagttctattagaagcctgtagccataatgacatgtgagctggcctaaaataaaacgttgctttggatgcagaaaagaagctagattaaaagttaactgagcagaggagaagaatgagagatgaaggatgattctgaaatttctggttgaagtgagcgagtgttaattgtgactcactccattcacagaattacaaggagatagagcaagatttcttgaggtgcttaatgagttttgtttgtatgtgtcgattttaatagatatgcctaatagatgattgggaatatggattcagatatctgataggtcaggatagatgtaggagccagccataagctcatagatagcaactgaggcctgaaaagtttaaagaggaaaaggatttcaggcagtggtttataacctttagggatcttaaacctattggtaatatgaaaaaaacaatggccttctcaggtacagattagtgtgtatacaatttcagggggttcctaacctgtggaacctattgttgagcttttcagggtctggcatggatttcagttaagaacttctgatttaaggaacagacagagaagtatatgagatggggagagaattcaagaaagcttcttcagaatccagggataggacatggcaagggagcagttggagaatcagaagttcccagtgctttatgctctagagtaggagggagtttaaagtgtgccattgaattcagcaatgagccattcatttgtaacattttgtactgtgtagaggcagaagaca

SEQ ID NO: 122956 - DNA, 1590 bp, Homo sapiens
cttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttccttttttttaaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacat

SEQ ID NO: 122957 - DNA, 1154 bp, Homo sapiens
aacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccacaatagttgagaaaaatgagcatttttttccatttttaaaaaatgcatagaaaagacaattttaaaatcctgggaccatatttatttagaagtagctgttagtaaaacattagaaaaggagtcaggccattaggttatttatccaaatctctaagcaattaggttgaagttattaagtcaagcctagaaaagctgcctccttgtaaggctttcatgacaatgtatagtaatccacagtgtccaattcttcacactcctcaggaatatcactacctcaggttacggtacacaggctataattgatgatgatgttcagataactgaagacacaataaatgacattcagacatcaggacaattccctcatgttcttttctatgatggccacctgtacca

SEQ ID NO: 122958 - DNA, 1059 bp, Homo sapiens
gccctttcacttaccctcttttatttttctttatcactcttacctccacctaaattttaacacttctgtctcctgaaactgtatcataggtgtgttcattttttttttcttttcgtctgtccctatcactggttcgtgaaaataagatgtggatctccagcacctggtactgtgcctgccatgttgtgggtgagcaagacacatgtgctggatgtgtgagtgaatcaatgaatccctaccacttctctatcttctcctcttcctcactccaagatgttttctggctggaatttctgcccatttgagtcctcagagttggtagaagagatcaggggaggttatttggtgtcatctgtcacttgaatatgtgaatacaaaggtagctgaaggatgacagtcgcagctttatcacctaacttcgtatgtgaccttgggaaacatgccttccatctgctcaaagtgaaaacttattcatcatgagatgaaagaagaggttaattaattaatttatgggcatattaatttttggataaaaagccctaataattattataaaaaaaacagtcacatatattttccggagtttcagtggctattttaaggagggctgggtttctacacaagtgtcacctcagatgaactcatgaaataataacattatgccttgggttttggctcatcttgactttacttgtgaagcatgaatataaaaatcttcacgttgttctgtgtcttcacaatgtcaagaatctgtgattctacgttgtgaaagcttgaaccatgttagaaaaattctgttattaaagggagctgaagtgatgatcaagagcaccccagaaacagtggggagtcgaggtaagattttgaacatatttgaagtgaaagataagttatggacaacagagtgtttaataagtatatatcctgattttgtttgacatacgggttttaatattagctacagaaaaatggaagggaggggctcttagcctctctggggccatgaacctcttcggtaggctggtgaagcctatggaccccttcttagaataatatttt

SEQ ID NO: 122959 - DNA, 3422 bp, Homo sapiens
tgtatggcctggtgagtggcacattgggaaccatggaacactgcctgctccctacaatattgccttcacacagcccatgcttggccatggtgtcttgcccttaccagtacgcttatcaaaagcagctaagaggcatattggttattttatagttcataagaataatcacttacctggttcttttgtgcatttcacattttactagataggaccacattgaacctgtgtggtggtgaaaaactaccacttattaacatctaccccctcaccctccacacacacacacacaaacacacacacgggttgcaaagtagacacttaaatagcaagggaaaagaaagcattgaggtggggagagtttctcaaatcgagcctaatatttattgccgtttatatctttttctctactggtaatgtgtgccatatgaaacttccaattaagtctaaagtaattttccccttctttcagccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcgtgagtgatgttttcctgtcctcctgggccggccgggacgtgcactagacctccctgcccttattgaatgcacctgtctaaattaatcttgggtttcttatcaacagatggagattaagagtcatgtcttcttctccttaattaactgggatgatctcattaataagaagattactcccccttttaacccaaatgtggtgagtatctgtctctcttctaagtatagagaagcccaaagggcatttattttaattcagaattgtctgggggagggttggaaggaatacattggcagatgttttctccataaacctgttattttacctacataaaaagcacatttttgtgtcccaacaaggctcccataatttttagacacatttatcaattcgaagcaccaaaaggcaacaagtgaacattattcttatgtttaactgtgtgtagccttttgagattttgtgcttgaagtgggtgattatggaagttgatataagacttaaacttggtatttaaagcctggtcaagatttccctgtcctgtgtctagtgtgagttcttgacaagagtgtttttcccttcccgtcacagagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttacatatattgtgtcatgtgttattttgtatattttggttaagggggtaatcatgggttagtttaaaattgaaaaccatgaaaatcctgctgtaatttcctgcttagtggtttgctcccaacagcagtggtttctgactccaggggagtataggatggtcttaaagccaacctacgttccaggcctttttagcagcattttatggtgtctgtcattcataaatccatccaaggaaatcctttgcaatttactcatcttgcaaggattgctatgaagtaatgcttcctgtatttattgcctgtcctgtgaagttggactatttgtcctgacatttggcttgtcttcagttacaggtaattctttccagaaatatttgaaagcctactctgggctctattgcgagtgctcaggatatcgtagtggacaaagcagacaacttcgcccttccagagcctgatgaagaaggccgacctaaagcagttagttgagatggaaattgagaaatagtctgtgaagtttaggagaatgccacacaagagggtgagaattttttttttttttttttttttttttgagacacggtcttactctgtcgcccaggctggagtgcagtggtgtgatcttggttcactgcagcctccgcctcctgggttcatgtgatccccccatctcagcctcctgagtagctgggactacaggcatgcaccaccatgcctggctaatttttgtattttagtagagatgggatttcaccatgtgggccaggctggtctcgaatccctggcctcaagtgatctgtctgcctcggcttccctaagtgctggggagaatgttttaaataagtggatatgttcccaaaaagctgacctggctgggacatctggtttctgagagtacctggagttgacccaggtctagagtgagctcagtaaagggaccctgaaggagctcatccctagcttggactgaagcttcttgagccagtgtctacctagcaccctaagggcccagcaggctctggggctgtg

SEQ ID NO: 122960 - DNA, 1031 bp, Homo sapiens
atggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcg

SEQ ID NO: 122961 - DNA, 1221 bp, Homo sapiens
ttggtggggagaatgttaccagaattagcatttccttcaacctgtcaggtttatagttaatagattacttggggccacttcctgcagttgttcttttgctgtgtatgtcaaaactaattaaattcatttgcaacccagaatgactttgttctgtctcctgcagttgttctaccatctccagagggaacgctgcttcctggaaccacgggctcgtttctatgctgctgaaatagccagtgccttgggctacctgcattcactgaacatcgtttataggtaagcctgagagctcttcaggctaccagttttggtataaaggagacgtagcactggctgtttcatagggccttaaaataatttgtgtttatttgcaacttggttgcctaaaaccagatcccctagcacgtgagctggcttgacttaagtgccaagggggaaccagccaagtaggattgtgcctaatccagaatagatgagcagaacaagggctcccttttttcttcactacacaactacagtgaacctaaaatgcctctaatacctttagcaattatctttaagaggatatcttatgaagtgaaattaacttgtgcaactacttttctattcacttttttacagagacttaaaaccagagaatattttgctagattcacagggacacattgtccttactgacttcggactctgcaaggagaacattgaacacaacagcacaacatccaccttctgtggcacgccggaggtaggcgctgtcttggtttggtgcctggtttacccccgccttccaagagagagatgtacaatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaaactttctaaatccctaagtaagagatatcaagtgcccagcagtttcctaaatgtcagtacacataggtagccagtcaccctcaaaaagtccagcagttttatcaggaaggaatctaaagatatctatcttccaagctggctctgggtctctcagctttttcaaactaaatgtgtggtcgtgggattgcttgctttcgcaggttctaaacgctgtttccctggtctgtttttcagtatctcgcacctgagg

SEQ ID NO: 122962 - DNA, 3200 bp, Homo sapiens
acaaagcaaaccaaggagttgagactagagctcactttagggcaagtgggggtggttttgcctgcaaaacaaacccctgcccaagaccaaggaaaaggcgtttcacatgctattcctggtttgacagctggtatttcgggactgtgccagatccagtaggcaactttaaaatggcagagcctttggtagcaagaggtcatggcagggcagccaccgcagacagcaacagcgagcgccaggtacctggccctgcgaatagtggtaacttgtaactgcccgctccgggcccagtcgccgtgctcgcggcttcccggccagcactggctcacgtccccgcgccggcggtcaggctgcggctcccagacatcccccagccgcggggttactggaaggcaccggcatcgctgttctgcagagcccgggccgccgcctcgagcttccctctcttccctgccttctgcagcggagtcacccggctaatctttcaggataaagtcacagtttatgtgggactcacataaagagcgagcgaggtggcaaaactaagaagccctggggcagccttgagttaaacccagggagggtagggacgattttaagaccatgtatcatgacctgcagggttttcaggtgggacagcgggagaggagcaggccccacagaggaatcgaggatgcccggttcacgccaggtctgcccccgggcaaagctacccctcccttcgcttgttacctcctcacgtgttcttggcatggcagagattaaaaatgcaaggaaaaaaattacatgcggaacggacaaaatgttctcagagattacttcagaaaaaaaaaagtgaaatgcagattgtacttcttcctttagtgcagagacgacttttatttccgccccctcccctccacattcctgacctctccctcccccttttccctctttctttccttccttcctcctcttccaagttctgggatttttcagccttgcttggttttggccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactgggtaagcgccgccgccggccccgctgggggcttggctcacttccccagagcggcttggaggcaggggccggctttcgtcggagttctcggggccggggtcccggcggcgggaacgggaggacctggcgggcgaggtcgcgcgcgcaggcctgcgccccagggataaaccccggagggtggcgcgcaccgccggctcgggttggggaggagggtgggagtccggccgcaggacggcgcctggccggggagagggtatctgcagggacagtgagcgaagccaccgtggccgccgcgcacccgccgggaagcgcttcggcgctgcgaacccggctttctccggcggcggaataaatgagagaggtggaaaactaccccgggctctccggccctccccgcgccctccgccggcgcgttctctctctcctgccccaggagccgatggagactgataacggccctgcgccaggccgtccccgggcggtcctcgcgcccccgcccggggctcgccctctcaatggggacagaaccgcccgccgcaggcagcgtagccgccagcaaaccgcgaggcggccggggcggggcgaggggcgaggcgaagggcggggccacttctcactgtcgcgcaggccccgcccccgcggcggtgccttttttataaggccgagcgcgcggcctggcgcagcatacgccgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacagtaagtttgaccggatttgaggaaataactagtatagtttgaatttgccagcggtaaacattctcatcacggcgtttatcgggaaggcgaagacttcttctggggtggggatctcatttctccttaaattctaatatatttgacacattttaaacattaaagttaatttgctgatttggcttgaactggagatgtaagataaatggttcgtgttggccgaattcacggcctttctccatgagcaacaatccttatttctgtatttaatggggtttattattttctttaactgactaatgtattggggtattttcagtttaaacagtgaattatccgggtagaagtcggtagagccagaaactcacttttgatgttggtgtgccccctagtggcgagctggattctaaatcgtgccctttattccctgcagccctgaagttcagtccatcttgaagatctcccaacctcaggagcctgagcttatgaatgccaacccttctcctccagtaagtttttgtatgtgccgtgcatctgtggagaactgtaagggagtcagttagtattcctacattaatggattaaaatagcatttctagaaattagtatcaaggcaggaatgcttcattatggcataacaagtgatataaatatttaagtattgagtcagagtattattttatttttttcctgggcatattttacctccaaagtggttattttaaaaggcatatttcataaaaaggttttatctgtctgaaacaacatgactgtgtgcagtttccatactcatttgaaatgtgatgaaatgtagttttgaatgtttatagatgtatggtcatttgcatcagtcatttgtagatgtaacattttctacatcg

SEQ ID NO: 122963 - DNA, 1051 bp, Homo sapiens
tccagttttcccagcacgatgagttgaaaagactattccttccctattgaatggtgctggtaccctggttgaaaaccaattgactatgtatttgttaacattttaaaaatacaggttatctagaaaattaaggaaaatgatttacttggccacctaacagactacgtagcccatttgagtttatagaacactagataatttgattctcataaccctacacgaagaatagaatcccagcctttacctgaaaccctttagagcaatggttttagaattcagaaatgttagaactttagaaaggtaaataatgcatacaagttacataacagaagggaacaacactctaaaatcaaaatattaatgtttctgcaccagaacttattaacactaactgagataaataagatctatacattgcctcacttcaagtctggttttgcatttaaatgggcttgttacagacttaagaaaaaacttcaaattttcagtcttttgggacttgggaattgcagataagtgattgtggacctgtattagtatggttcctatttacagataaggaattgaaccctccgagaggttgtgctatataaataataagtgattaagccaggactccttattcattacctttactctgaaattcagtacttttttttcctattacactatgctgcacattactttgaattatagatgactttggttatatataatatgaattaaaatattgagatagtgtgcagtcacttccctctgttattttcgtgtgataatttgtttgagctactatttgcaagatactgaggagatgaaaagacatataagacctaacttcatgctgccacaacccatcctttgtccatcctgattttgcatagctcacacatagctcaccaagggtagaagaacttaattaggtttgtatgcttctgttctttcaaatttggccatggagactggttccagttccttagtcacaccttggctaagcgaagtgaatcctgcttgtttacctcagttgtttgttacaaacgaaatgtttcttaga

SEQ ID NO: 122964 - DNA, 1540 bp, Homo sapiens
aaataggatacaaagtaatgataataaaatttatccagggaaaaatgatagacacattttcactgtgttctaaagtttacttacttctaagtttttcttagttacttctaagttttttaggttgaatcattctgggtttccatttttaatatgtcgatttgcagtttttctgataataaaagttatagattgcatagaaaattttggaaaacttaaaaatatggaaaataaaaatgccatatacttgcataatccatagatatatatctttacatgtcagtgtgtttttatgtgagcatattatccacccagttggtatgtattgggtgtattctggggatcctagacatacagtaaatgtctggggatcctagacattcagttgtgctgaagcaacacattcagaacctgcatgttgtaaggttggtttgccagcatcatttgaacatatacattttatgggaagagggagattttatacaataatgttacttatcctgaaaagctgttacttgtgaatagtctggattttttgttttatgtgtaattgttttgagatatttgggaccgtactcttatagtttttgtactttgcttttgtcacgtgacagatgaccatttttcccattagacttttttttctaattagctcatatagtacagattctgcatgacaataaatgtttctcagtgatgtttctaccatttgatgcatctttgaaataaaagtaagagtttttaaagttagtgatagtggtttagaggttggcaatacatttatttgggtcatttatactgatacacctatatttgagataaccttgtactttataattctttgtaattatttctatattaatttgatcatgtaaaattatattttaaggtactatttaggtactttacttacataattatattccatttcttccatacactagaaaagaaaagcttcttttaaaaaaattgctatagttgaagatacttaaatattcagaattcatgtattgatcatcaagtaacaacaagttaattgttgtgagcgaatggaactcattcacagaaagcagtatgtcctatgaggcaaaggaggggttggttactgcatatttttactcatgcaataataatatttgccaatggagaggtagagggatgaagaggtcagaagtgactttgaatagtaatactgtctccctgactactgtagtttcttaaaaataagcatgaattgcaagtttttcactgttgctttaggagattctgccagcatatattgattcagaaataccaggatcaaatttgtttcagaaaaatatggccatattttgtcagtctactccctatgggagaaaaacttgaaaaaaaattttttaagcaaacaaaggtttcctaagctattaaaattttactgtttagggactaatgccataatactacataaatatatttaaattttccctattttgtatgggaaactctatttcagtagcttttgggtacaagtaattttttcctttgttttttatttatttgtcaa

SEQ ID NO: 122965 - DNA, 1069 bp, Homo sapiens
ctttttctccctactcatgcatacaagctacctaataaacacttattccttcttcagagtgccagatgtctattctcaccatcatggattctttggtgcacctttgtgtttctattgtatattttacatattatttgtctcaggacaatgtaattgtttccatctttctcttcactagtataatatctttatgggcagggacttacatttttatttttttttatccccagagtttagtataatatctggtactacgtatttattatttctcaataaatatttgagaaaggaatgaacctttctttggtaatatgagtatttttatttgcaaaaaaaaaaagtaaagtgtggtatgccatatttagtagagatgttaattctgaaatgattattatttaatgtccattgaactactagttttatatgactacttgagaactaagtatagttaacggtattaatcatcagataacattgctgtatgaaccataagattttggtatgttttgcagatcaaggatctggattttgcataactggtaaaatagaagctggttatatccaaactggtgaccgactactggcaatgcctcctaatgaaacttgtaccgtgaaaggtatttatctgcaagatgcttttgctaaacaagccttaagttgagacagcagatttttaaaaagtggtttagttacaactccaaagtaagtaacctcttactgaaattgtaactgactgtcaaaatgatactgactgttgaagattaaaatgtgaaaacattaaacgatttttttctgttgtgattgtgtctgtatatatatgtacataaacattctaactgtagtagcattctatttttgacacagatctgagaagcctggttaggatttaatcagatatgtatagatacctcacagatgtatttggaataatattctgtagcagaaattaaatctagtcccagccttaccctaactagtcagtggcaaagcagccttctacagtctgttactttgaaatgtatgtttcagaataactataaattaacagctttgatcatgtttatgccaa

SEQ ID NO: 122966 - DNA, 1105 bp, Homo sapiens
tgtcctctaaatctccattgtcacagagccagcaatgcagagtgaatgtggaactgagcagcagtaaattggtaaccggcgtgcttacctgcgcacatgccctgacgcgtccctctgtattctctgtatcctctgtcattgtgctttcatgcagcattataattttttctatgctgtctgtttatcccacttagattatgaactccttgaaggcaagtactatctcttctttatctatatctgcggccctagcccagtgcctggcacataatacatttaacacatgaataaaaaaatgaatgaatgaaggtgctttgaaaaaatcatgcaatgaaatcaaaatttatcattatcattattagcttccagtgttctagtaatagaggaaatatgctaatagtttccaagatgcccattgtttatcaagaatacaagaggtggttacttttctttgattaacagtgtttgctgactgtactttctcaccttctgttcccccttcaggctgcttcctggcttccgcctacgctgctctcctgagtgtgttcctcctgaggtcatgaaatgacctcttggttgccaaagtcaatatacactttcaattctatcttacttgaatttggcattggttctgatgctggtagccacatccaccttgaaactcctcccttggtttctgtgacctgctttctcctgttaacctgtctatttctctgacctgtctatctctgacctctctatatcttctctatgggctcctcattctctgtcttttaaacagtgttctgctgcctcagtcctcttcttagtcttcaagttccttttgaactgacatccatgagtgtctctaccttctgcatcttgatgcttcccaaatctgtatctccaacccaaaccttttcactcattctccacacacttgtctaagcactactggacatctctcctgggagagtgttcttttaggggtaccattctcatggaatgtggtgtgattggtccccccggaatgcaacttctgcatgtgtgtgtctcatagacacttcagatttaccaagcctaaaatggatcttgtccttagtttcatatctcacagttaatgcat

SEQ ID NO: 122967 - DNA, 1130 bp, Homo sapiens
aggagtgtggaaactgatagggaagaatttgtccagcaagcatctgtagtatgcctttgttaccaaatgcttgaatgttttggaataaatttgcaagtttcccaatcaaaaaagttgaaaattattggatcagataactttggggctgtagttctgtgatttctattatgttttaaaaagtacattgttgcttttgcaaacttggtgcagttatggtaatggtgaatcttttaatgttttaaaaaatgttgtattaagtttcataagtcaatctttttaataggagagtgatgtaggttttattcctacaagtggtctcagtggtgaaaatctaatcacaagatctcagtcaagtgaactcacaaaatggtataaaggactatgtttattagaacaaattggtaagtatactgccattctagctttaatgcattataaacttggtattaattattatttagagttctttatgggagagagtcacacgtatgaaaaagcataggatttgtagtcggaggaactaagttacctgttttgtcatcatgtgcaatacttaacctgtctagtgctcagttttcctcagtttatgaggctagtgcctggtttacatatcttatagactgttgttaaaattaaatgagattaacattcattttataagctgcaactattacttggttgaatgtcccttatccgaaatgcttgggacccaaagtgtttggggtctgaaattttttttttggattttggaatatttacattatacttattagttgaacagcccaaattcagaaatctgaaatccaaaatgctccaatgagcatttcctttgagcattatatcagtgctcaaaaagtttcagattttggagcatttcagatttcagaattttggatttgggatgctcaatgtgtatattagtgacagttaagttgctattagtaattataaaaagtagttattttctaggagaagtgggattataatgagtttattgaagtgagtcaaaaatttaattttaaattaaaccttgccttttgcaatttcttttttccagattcctttaagcctccccagcgatctattgacaaaccttttagattatgtgtgtccgatgttttcaaaggtaa

SEQ ID NO: 122968 - DNA, 1126 bp, Homo sapiens
atccacatgacgcaagtggcatcaacacaaaagaatagtgggaacctgtaaagttagtttcaataaggctaacaaaaactgagctaagctgaggttagctttcttcttttgtggggtgtgtaatttgagtctgaaaggaatgtctttctatctgattcacaagatggtccacacaggttagaaaactttgttatacaaggcttttttttcaatagctgtagaggatgaatatgctgctttttgataattcatatatttgctgtttttcttcattataaacagtactctgatgaatatctttgtagatctatacttatttctctgggataaatccctagaggtggaattgatgggaagtaaaatatgtgtaatttttaagttcttgatactttttgtgaaaataccccctggaaggtggtgcacctacagtcccatgagcaatatttgaggatgcgcttctcaccgtatccttgcctacagcaaataattttgtctttcaaatctttaacaatgtgatttgtaaaaatgggagagagggaatatgtcaatgtgtttttattttacttttaaaaaattttagtttctactgaatttgaatttttttcatgttgaccatttatatttctttagcaaatagcttgcttgtatcttttaaagctatgtcttcttgctttgttttggggttttttatgttttttttttttggtaaagattctatagagattataacctttactttatatgttacaaatgtttgtccctccctgtctactgttttttgtttttttgagacagtcttgttctgtcacctaggctggagtgtagtggggcgatctcgactcactgcaacctctgcctctcaggttctagtgatcctcataccttagcctcccaagtagctgggatacaggtgtgcaccaccacacccggctaatttttgtattttttgcagagatggggtttcaccatattggccaggctggtctcgaactcctgacctcaggtgatctgcctgccttgacctcccaaagtgctgggattataggcgtgagccactgtgcctggttgctgtttgtttatgttttaattttgtttatatttttcctcctttgcttatatattttaa

SEQ ID NO: 122969 - DNA, 1003 bp, Homo sapiens
atattaatagagaaatttcccagtaattttttggagatagtaataggaagattaggtagaacatttgtggccttaggtatcttaataccaattcaatgaatttcacattttaacctaagaaggtaaatataattttacagttattatgaaaacctaatgagaaaaagattttcaattactgagcctaggacttggaagttctggtctggatgttttatataaactatatttactccctagggtttctgtgaagtaagtaagttggtaacacagagaggttagacaacttgcctgaggtgtggagaacagttattgactacaggtatgcatgaaagagccaatattcaaattgattgcttcagtttgtatgcttattctaatctaagaatccttgatcaaaagagctggatctcattgaggaaattaatgttcagttttataaaatatgagggattggaagtgaagatggcacttaagagtagagacaaagcaggagtatttaggtacgagtaaaaggaaacaggaatagtgtaaattatcccaccaaagtgtatggttagtacttcaatttaaatcgtaatgttctgttgtaagaaagtatctgagacattcttgacatattttatgaccatttattttccattatggtgaggattatatattatatctgaaattctttaaaaactggagagcacagaagtaaagggtcattggggaagcaacaaagaaacaagctgttgtggactctgttctgaccagaaagcaggagaacttaatgatgtggatggaatataagaggaccctggagagatagtgattatcatgtaacagcccgagatagctaaaaaggggaatgccaggtgtagtctttgtttcctggatttcagaaaagtggatttctatgacaaacaggtatgcatacaaagcaaaagctgtaaaagagaaaataaaagtgttctttaaaaaatgcccctacagtgcattgacagaaataattgataag

SEQ ID NO: 122970 - DNA, 2795 bp, Homo sapiens
tggcagatatatcaactgtgtcaaaataatgactctttacaaacctataaagtcctgtggaagtcctagattaacgagattaaactgtgttccctgatgtcttcaatctgattattggagaatatatctggattttcatgcctttttaatgtgtattttcttgcagtcttggatagtctccattataaacatataaggtaacgctctgtaaagcaggtcacagtattccttagctcttctgataaaccagaatttgtatcataatggtttctctttctttgtgggtgtctttagttctttatagtatcacagacctgttttctatcctagtaagaaaaattagctggacagttgccaattttggaaaacaatgtaattgtatatgatgcaatagtagaagcctaaataattttcacctctcagtttaacaagcacattactaaagtatgtggctttttagttttctttgcattatctagtaagcaggtaaagacattgagaacagtataatttaagttagaatggtttacttgaatttacctagtatcttagttgagctggcaagtgaactaataatctatttgattcctataatggtcagtcattttagcttttttgataatacatctgttgattggctttcatatttttgctgctgcgttttgctgctgctagttttttattgctcagcatgatataagttttagaatatttcttcattccatagatagcagatgcttccaggtacatgatgggagttttagctcaccaccgtatgttccttaatagcatttacaaaatgtaatatgttgcttatcctgccatgttaaatatttgtaaatcccctggtcttctcagatactgaagaacagaaattagtaaattgagtgacatttcatatccttagggttacaaattgaaatcagagctgtgtcagcagagtatacccaggtcagtctagggaggatctcagaataagtcttagttcaccattactctgaaggtgtctgtggtccctagagtatttgggaattattaaagagaattaagcgtcactttagcaaactaggatggcccatgctttcagattaagctaaaatggcttgactaaggagacctacagttactttattgctagggcaaacctatagttcattattctaattgttgtactcttttggtagtaaaagggagtattattattccttactttgggtgattctggggcaaacctagtttattgccacatgatttccctgtttaaattcctgaggcctagaatgactgagtgcccttgtagaccttccttgggccttcttatacaggttaagcatccctaatctgaaaatatgaaatttgaaatgctccaaaatctgaaactttttgagtgctgacatgacatcacaagtgaaacattctacatctgatctcatgtgacaggtcacacaaaatgactgaaaatgttgcataagattcccttcaggctatgtgtataatgtgtatatgaaacaaaggaattttgtgtttagatgtgggtcccatccccaagatacctcattttgtatatgcaaatattccaagtccaaaaaagtctgtaatttgaaaagcttctagtcccaagcatttcactaatctgaatctacatttttgtggctgaaaaaaggcactatgttggtctccaggaagaattaaataggatacaaagcaatctgctgttcatctatctctgttttttaaaaattaggcatctgctttgatatcttatgttttctaaatatgtagcatattaaccagccttgcaaattaagttttataagctcatttctataattagtgaagcataagtgtagaacgtgaagaaaattacctctcggtcgtggtaattttgcatttgtcttttctcatatgcagtattttccccccatttagagttgtccccatgtatccttcttcacaatttacactatttcttacaaaacaaataagataatagggcataactatcatttttattgagctcttactttgtcctcccttttatgttaaaaccatatggatgcacttctattatagcagaaattccagccccgattgataatttaattattcaaaaataatagtctataaaaacaatttccatttttacctaagaatgtagatggtcatgtagactattattaatttactctatagcactatttatatcgtacattctaaccatgttatgttttgtttaaggggagtaaccatggatgttggtatgacaaagtttgaaaccacaaccaaagttattacattaatggatgctccaggccataaggacttcattccaaatatgattacaggagcagcccaggtaactgctgttttcttcactatagtgtgctgattgtactttacataaaattttctgatgctgaggttacaattctaggattttgacttttaaaatattttaaaattaaaaattttaacctttataaagcttgaacaaaaagagcaatattgtatttttcatgatctttctacctgtactttgtaaaaccttttaaaatttcttacaaagaaacaaaatgtataaaagctatgagtttctttatcgtaaaagtaatggtaaaggacttgatgagtatagcttcatatttcctttattgataagttggcctgagtatttcaaaatctgccttatgtctttcaatatattcaagttctatatctttttaaagagcttgtttatgcagaaataatgaagcttgggtattttcgcccagtggtttatttactttctttataat

SEQ ID NO: 122971 - DNA, 1888 bp, Homo sapiens
cactgtcaaaaatgtttatgaactgtagtcatttagagatatctcccctcggggtagtatttgagtaaaaaagatcataagtctatcatgttggaaggatgagttgaagtaaaactatattttagtactaattcatctccagtaatatatttggtgccaattttacaaaatatctccttcataccattgattttgataggatggattatatggccaagactgtgggcttgattttgaatttcagttatttttcaacattattttcttcttatcttcatttttggtacagtttttctcatgggatcttccacggttgtatttgtgtggtttgagtctagctacttatcatttccaccttaacagactttagctacttagcagagattatttctggtctggagcataaaggattatgaagaaacagtttctctgcccttctgtcattgtaggacatcaatagagttggtttcaaatacttttttcctatctgccttctgtagagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtaatgctctttgtccctctggatcgtcagccagccatgccttagcctgcccactgtctggaggcagcatggaaactctgagtttctccatgggtggaatggacagagagcaaggaggcacagtctcataatgctttctagtcatgtggggagagataatgccaagttaccaaagaggtcattacacttgattgtgggatttttcattttgtgaacattttgaaattggcgtgtcttgttgacaattttaatttccaaaaatctgagaaattccccccgtctgtaaagagatatgctcttttttttttctattagatgttttaactgtcatttgataaatactggtattactgtaaaccactgacatgaaatattgaattacacatttatgcaatgcctcaatgtgaacatctggaaatgtacctggtattaatcctgaatcaattttctttaggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggtagtcactatatttcaaaattttcagtttgaaatcatacagtcttctaaaataagtgtgtaatatgtgttgaatttgtaaaacatatgaaatactttagagattatttttagaaaatagcttttagatatcagggaactattttgacttttttgatgtaatctgcatactgtttttactcttctgaattttatagaaatagattaaaagaatgtttaaaagaaacaaaataaaagccatgcagaaaaacaacagtaaaaatcataagctgattattctatgggataagtttcagttgtcacttccctaagtatttgtcaaattgtcttgattttgaattaaaattatgagtaagacttttaatttcatgtcagcttacaaaggaaaggtaactgtcataaaacctcttctgtgtagaatctaaataaccagcaaattcaaattaccaaacaattcatttttatactttacatattatgtttttatgagacagtctgcaaacaagtaa

SEQ ID NO: 122972 - DNA, 2080 bp, Homo sapiens
gttcataaacctcgcaggattaaaaatagtttagccatctgctaactgaccaaacaattttagtattgtgaaagggtgtggtaggaaagggaggtatagggtctaggtataatgtcagaacaaggctcagtgcagaaactaccttgtgacctcttaatactgaaacttaacagtcagttcaaaattaggaagagatttggtggaggttaagcataggagagtcctgacaataggggatttcctagattaaagtgacagaatttctttcagcattaatatcttactaaatttttttagagataatgtgtttataaagacattaattctgtgaaagttatcataatctataatttaaaatactatgtaatagatttctttatattactaaagaaattaattggccttttatattttactccttaactaggaaaaccagtagattcccagacatcgcgaagtgaatctgaaattgtgccaaaagttgctaaaatgactgtatctggaaagaagcaaactatgggatttgaagtgcctgggtaagactttgagtacctccctcatccccacccccacccccaagtttttgaaatcactgttgcttctgtaagaaagagactgtttcaatttcgcataatatatcattagcactgaagtatcatatatcctcagtataacatagtacaaagagacaaaatgagaaattaggcttgattctggccttatcttgtgtgtattacttactctacctcactgccagttttcttacataaatattttatagctactttaacataaaaaaccctatgattttgtgaaacctagcactgtgagatagggaattcttataccactaggtggcagaggtaaccagattttggagtgagtccccgaatcatggaatcattaattaaattttttaataactaaaatatttttaaactcttttggattttcatattgaataaattggaccattgtagcaaagacgtaaattggaccattgtagcaaagacatatgatatgaaacatatgtagaatttcaaatatgtagtgaaaaatggaaataaaccataccttggtagcacttgtttgttcttatcaaagtctctagaatccttccaggagtttttatagacaagggaagtgagttgctttaaagccattaatttttaaactctaaaatttttcagaattttcaattgttacttataaattatatgtattttgtctgccaaaatgataaacgctgttatcaaatataaacaataggtttttactataaacaatagatttttatatatatatactttttttccttttttttcctcttttcccaagttatatttttttaaaaatataaacccaggaaccttatttattttttttttccttacaatattcttttgtctaaactagtgaggtattatgagttttggttgggaagaatgtttatcacctagttcaatttttggattttatagaaacaagactttattcactagatttcaaagtcagtgaaggaaaggactccttatctaggacatagtaggcattcagtgtacattaattgaatgattggatgaatgaaaaagttaatttttatcatgagtaactttagcctgttaaaataatttagaattctgattcagtctcaaaaagcttcgtgtatgccttttttccttctgaattgggattgagttgtcagaattataattgccctttttgtccttattcttgagtaccatttaattctattatgggatttttacatacagagagagagagaggggggaaataaatagaatacacaatttattgttctaaggattttataatcttagtacaaaagatttttcagaagtcttaacatgcaaatgaacccaaattaatgtattatattagaagtaaatgcataggtatctaaatgaataattataaagataatgggtaataaatgtatcaataaataatgtgcataatttttgaaaactctgtaagtacaatgcaggcctttcagaattttatgactatattctttgtgaggccagggactgttaatgttcatcactgtattcctttt

SEQ ID NO: 122973 - DNA, 1351 bp, Homo sapiens
tgtaaatagtagttaaatacttatttgtaaattttttcaaatattttcaatttgtgtttggtctaatccatggatgcagaacccaaggatatgaaggtctgactgtaatatcttttaaagtaaagtctcttaaatattcctttctctatctccattgctcttagatcactgtagaatttcttacatgtatttgtacaacaatcttctaactgctttcctttcaatcttgcctccacaatccattttctattctggggtcagagtaagttttaaaagtatgatatgtttctccaacgcttaaattccttcagtggctcttatgtttcaagatcaagtgaaatattagacatggttctaaatgagttacctgcttttctaatcttatgtctcaccacattcttgggtctgtttatttcagtacctagctcagtgtcacacagttggcatttctcgccttcccttcatgaatgaatatgtgataggtagagagtaatttgtgtttgtaaatgtcctggtatcacatgagaaaaagaagttggcattttggtgactggcagagacccacggactgtgtgctttcatatgtgccagtcattacatgtactttacatgtattggctcatttaattctcagttctcctaacatctttgttaggcagatactattattttatggacgaggaaactaggcatagagaaaagttgagtgattcacttgaggtcatgcagtggcaaggcctggcttcaaactcaggttgtgttgcagcagagtctatgtcttatctactaacctaactggctggtgaattggaggcatttggtgtggaaagcttgttgggattctcctttgagggtatgaaaagtatgcatgtaactttatatgtgctttattctgttggtaattacctcagaggctctcagtaaatctttgtgaaatgaatctaagagtctttcttcatacattgctggagttggcctctgtgattcatgcattaccaagaagccatggcttccttctgttaataatcacaaatcttggcacaataaaattaaagtataattttcatgaaagtagtggcttttgcatgaaacatggaaatagatgagccatggccatgcatgtgagaaaacaagagtgtttatgtcagggattttcagtctgtttatgggagtttgcaaggaagaggtggatcttgaggggtaaattgcggtcgtgttaaagactaaatttacaagtagattttttctgtacagagctacagagtatattttattagctgagatgatgaaaaccctagtggacagaagtagaacatggtttgaggagctagagatagaaagcagagacacc

SEQ ID NO: 122974 - DNA, 1048 bp, Homo sapiens
gagtacagtggcatgatcttggctcactgcaacctccgcctcccgggctcaagcaatccatcttcctcagcctcccgagtacctaggactacaggcgtgtaccactatgcccagctaatttttttgtggtttttttttttttttttttttttgtagagacagtttctccgtgttgcccaggctggtcttgaactcctgggctcaggtgatctgcccacctcagtctcccaaggtgatgggattacaggcatgagccactgtagccggcctctatctgtatgtcttaaaggaatctctgaccaaatgtgtctatattcatgaacagtgtctaggttagagtcatagcagtcattgaggttcctatgttttgccttcctaagatttaattaatctccatgttctattaatgtattgactctcatgtctgttccttcttactcatttccggtactatagtacttgttcagctgcagtcacagtggttgtggtctcctagaaacttatcttaatttctctgtctctttttttcgtttcatcttatcgtactgttcatcacatctgttagaatgaaagctatctaaaaacagtctgtcactcacctttgtgtcctcagtgccaagaacatgctataatttaacctgaaaaactctgaagatccaagatcgtatctaggcagtctttcataaaataaaatttttggtgacagtttctgcttaggaggaggaagcagagttcctttatggactgttgtaattttgtgctgaatgaaaggagtaagagaaataagattctgaccagcagacttctcttagtttcctggaaggtatttcctgtttgttcatggcatcaccatctaccctttctttcttggcagaaaatctgaggactgtcctttctctcatctcctctgttcattcagatatcaaggattcatgattttaccttgtacacttgtcccttgtttccttgggtttcggctctggtacccccctccatcaagcatctgctgatgcttaaatccctgatataaaatgtcatcgtatttgca

SEQ ID NO: 122975 - DNA, 1089 bp, Homo sapiens
aagaattcttagtgctatagaatggtcataatatgataatttaaattcattgcatgtattagattataaattttgcatatactacctcaacgtatataatccaatgtaatatgtagattgaatttatttaaatgtctttgttttaaaaaattgctggttcagtgttatttacataaaattgaaatctggtctcagtgaatcttttaggttgttttcttctagtgtgataggaggctggatgctttataatggatttgatgaggcaagttatgctataaagctgctttaaagtgagaaaataattcataacaaataaatcacagccaatgcaacagtgctattgaaggaagtggtttattctccatagccgaggtggtgtactttctgaatgtacatctggtaactagaatttaaatgtttagtcagattcagtgaaatgatttcatattttaagtagtgtttttttcattggaaatttagcactgatttctttgaaattttgaaaatcttaatttgtgtgtgtgtacgtgtatctgtatgtactggcatattgaaacatttataggaaaaatagcaattgatggcaaaagtgtacgtacctggaaaacccctgttttttttttttgtttgtttgtttgtttttaaataagcttgaatgttgttttcaccaaggcattttgatctgaatgactttaaattgtgaatttgtcttagattaaaaatctgttgtgaatttgttttgaatgtttctaagccatataaatataaaaaaattccccattttgaaatctttcagatcaccttttcacaatgtcagagtaatatattaatgtaataaaagggaaaaaggtcactcatgattttcttaccttgagataacataatttatctttgccttattttttcagtttttgtctatgcgtttctattctttatgttgttaaggttatattatacatacatttctgtatcctatattttcctccttttctttatatatttttaaatgtggaataaatttttagatttcaatttgattcagaatacttccaaaatattgattaagagttataaaggcatttttaattt

SEQ ID NO: 122976 - DNA, 1054 bp, Homo sapiens
gtatattagtccttttttttaagtggtcacctgcctttttgaaaaaacccattttaacttaatcatgtgcaacattaaacaactcttcattttgccctccccctagtttctgacaaccacacatagaccctttttaataccgataaatttagatttcatagtattccattgtctagctgtctggttattataggaacttaagtctttcaatttattatataaaagatatgattttagagtggaattgctggatgaaaagggatgggcatttttaagacttatagtacatattgtacatatagtacttttagcacacttcttcagaaagattatactaattgttaaatttaattattattcataatagcattgatagtgttatttcataaaggataattatactccactgaaggattttgtatttgtattgaagttttcattcattgacagtggataaaagataaattatgcagtttttcttgggcctgtttatggcaattaccttgtgtccctgaaaattgtgtccctagtgcattgaacatgctgttataggttggcattgccaaaaataccatttatccatgagaaaataatgtctaccttacaagtttctgagaagtaaaataacccatatgatgcagttgtcataaggtcttgctcatggaaaatgcccaggaaatgatcattgaacttagttcaaagaaatagtgttcttttattaccacttaaggagcaaatgctgttaaaaagtggattattatgttaaagtctaatgaattgaggtactcaagttacttccactgattttttttttttttggagggttttttttaatcattcataatgtttttatataggcccttttacctgttgcccctttctccatttagccatttcaacagtctgatatatattctttcacataaccatttataaaaatagacacatacatatagggatttttgattatgcttttgtaaataaaaggcctattatatttttcattttccttttttccccataatacactgtcaagctagatcaaactacaata

SEQ ID NO: 122977 - DNA, 1194 bp, Homo sapiens
gtaattgcagagatgacagtgcaaggcaaaggaaatgataagctgggtatggtggcatgtacctgtagtctgagctgtttgggaggctgaggcagggggattatcacttgagtccaggagttcaggttcagcctgggcagtgtggtgagaccccatctcaaaaaaaaaaaaaagaaaaaacaaaactgataaaatgcgtatttatttccgacattgacatgcctaatttatattggatgagtgaaggaaagcagtttagttgcaggatataacccaagatgaacaaagatatgattcttacgtcaaaggggaggaggatatatgcacacttcagcacatgattatctttattgcagtgtggcatattatacccttcaaagctgacacctttgtcttcctcatccaaggtgccaccttctcttctgtttcccgtctttgttattactgtcaccatctagttaaccaaaatcaggaatctagtatcatccttggttcatctctcttcacctgctactcataattgattaccattcctgttattcccaccttataaataagtaaatgtatgtgtgtgtgcacataatatgcatacatatatagtcgactcttgttatttgcagtagttatgttttatagtcactacgaacactgaattaatgaatactgaaccattgctcctacaagaaatacagaggtaggttcctgtgagcctctcataacattttcatcaatcagtgaatacataacattgttttatatgtgtctctatttaaagacaccttatttaatggatgtgtatagcatggattcattaacaccgaactcatggcccacagcactggaagtcatgccttatctaatatcttttatttgttaggcacatcctagccttcttgtgtttagaatactaagcactacacttacaggccattttaaaaattaccaacaaaaagtacaaaattaccaacaaaaagtacaaaactggaaaaaatgcgacactaagtagaccatgaaaaggacatttgtttacagtatgagagctgtatcaaaaaggccgacgtcaccttctgtgaaattgcatgttggatgactcaaatttttcgctgctctgcacatgtccacaagtgattgcaaaagtgagtagtgattttgggattacaagtaaattgtgattaggtgaattcacaaatgtag

SEQ ID NO: 122978 - DNA, 1031 bp, Homo sapiens
cgcctggccaaatattttttttaatgaaaatgaaaaggctggtcttttcctagtaaatattttttctctggcagctactttactgtgcatttgataattttttgtattacttttgtttctgtttattttcagaatgacattctaaaattttaatctgtgtcatgtttttatattcagtattttgatgggaaaagttaagatggcattatgtcttttttttttttaaaccaaacacttcttgatttcttgtgttgtcttcaggtttttgtttttaattgaatgtatcagtgcaccataatactaatgcttaggacatcatttaaatcacaagctatattttgtgaatgattttaaaatttgagttatcccagtggttgagattgtttttctggtcttgaaccttgatcaaacattttagtaactttgaattagtatatgactgaactagatgtatatattagcagtctccaacttaggagtgaattaattgaattataagagtttgtaactgatgataattactgataggttaggtgctgcacaagtggtccacattgcacatgaatccccaaatacttatgtaatctacactgtagttgaatagcagcactattgtgttaccttcttttataacaaagtaattttcaagtggaaatgcaatacttttaaaaccatatagtagaccttctagggtgaactaggtctccatttgttggctgattagggttgtaactactaggtatgagattcttttggtggggaaaaaattagatattatagggtggtaagagaaggcaacaataccttaaataggtttccaggcttcctattttccttggcttggctgctggtctgtcaggcatgtacatgacaagtacttgccctgttgactaagggaatgtcacagtctctttgagactgcgaaggtggaactgagcagacctttccaccttccacccttggccatcgatccttggtaaaaagccaagtgtctgcttattcatgaatacactccttgtgatgattgttgg

SEQ ID NO: 122979 - DNA, 1053 bp, Homo sapiens
aagtctgtattttccgtgaactcttagattcaggcaaaattagcacttcatgtgttttcttttctgttttttttttttgttttttttttttgagacggagttttgttcttgtcacccaggctggagtgcaatggcgtgatctcggctcactgcaacctccgcctcctgggttcaaacggttcccctgcctgcctcagcctcctgagtagctgggattacaggtgcccactgccacgcccagctaatttttatatttttagtagagatggggtttcactgtatttgccaggctggtctcgaactcctgacctcaggtgatctacccgccttggcctcccaaagtgctgggattgcaggggtgagccactgcgcttggccaccttgtgttttcttaattatgtaaattagaagtttgatatttggtttgaaatatttgtattgaagagaaaatttcagggaacacagaatagtatacaaagaagagatattaggaaaggtagattttggaaaccagggagaaagtaggctgagtggaatggtttcagagattgggggaaagaaggaagaagattataagagaataataaattgtaagcaccttcgagtaggattttaggtatatgttttgatatgatattgtttttgttttcatcccttatgaaatatgggtaactataggtgattgattagaatttttaatttttactttaacttttgtaaaaaaaagttaataggaaatggctataccatagcattctttgatcattttatattctagctgctcagtttatttattcacggcgtgacaaaccttccgttgagcctgtggaagaatatgattatgaagatctgaaagaatcttccaattctgtttcaaaccatcagctcagtggatttgatcaaggtatagcaaaaagtagtgtatctgttatctgaaagtgattaatgaccaaatacaccagaatttatcagttttattgtgtttataacagtgactatgaacagtaatgatgtaaacatatctttcatattcaaggacagtttatgttttat

SEQ ID NO: 122980 - DNA, 1048 bp, Homo sapiens
tccaaacagggcacatgtccaaactgagccaaggggaggaatgtggagctacgtggcattacaatacaattatcttgcagcataatatttctctgtggttggtgttatcggactttatatgtgttgttattatgcagtgatgcaaaactttgaagttttgggagacaaatttcataaaatttcataacatcctcaatgttacactttcatagcccattgacatgagctaatttgttttaaggaaacgtgcattatagtagaacggattgaattctctcaactgctctttattaatatttctcttattcttttctccttgttcaggatctcttccacctcttcaattttccctatattcctacctcctttattataatgctccagtcttcattggttacttctgtgcttccgcagtgcttgttgtctggtattactcatttggcttttagaataagtcattacgtttttcttctttgccctcccttctaatctgtaaggccattgacttttacaatgaatagagagtggttatgctttaaccttccgagtataggtgttacacatacactgcagctttatgttctatgcattatctatacattttgatgtctttttctctacccctcaatgtgattgtatatctataaattttgaatgtagcttccctttaataaataatatcttcctgataatctatacacaagtcaatgaacttaacatgttttgtgctcttatagaaagctagataatacctctaataataccttgccttttgaatattatatctatatttctgtccttcttaacatattctttaattttgttcctttacaattgaacacagtgtccaggattcagttcagtggccatccagtagagctggaagcattagtactgtggatatgcctgtgattttctcctttgctcacttgtatttcatttatgatactcaggcatgtattggcatttagataatctgcctttcctttccttaatgagatacatatgaatacccagttatatattgagtgatgatgtttggcagtat

SEQ ID NO: 122981 - DNA, 1505 bp, Homo sapiens
aggaggagcacatccctcttcatgcagtagataactataggcatcaccaagcatcacataaactaaaaatataaacaaaaatgaactaatgcaggagaagaataaagaactatgctttacgaagtgcagaacatgtagtgcttaatatgttggtgattgtcattggcaccccagtagattattatagaacatcagtatgctttaactagagtgagggcagctaacaccctgttctccatttggaacctgtgacctcagtccgtctagaacatgtgaattttctggtggttactttagaatggaggcccttttaaataaatattgcagtggatggtattgcatgtggaccattgtcacctaagaaatgactttagattgagagagatttttgcaaatataaagtacatgaataggcctatttattattcattcatttctttaatagttgtttatcatttcctcaaccaccattaagttagtgcttagagtactgttctaagctttgaggactgaaagtaagatatttgagggtggtctaaaaggagaagattatacgagttacagattattagagtatgaaaaatgctacaaaaggtactgagaaaacgctatgggagggatacacagatgagaacacttaattcagaatggattggggggaatttaagcaggatttctacgttaaggaatgcttcatggaggagaggtggttggcctcagggagcaccttggcttcttgaggttaggttgtcatgttgtcatgcttctttgaaacaattggtgacatcataaccaagctgttcctgtaacattaaggaggttcatccccttttcttgtttataaaagttgtactcattaaggtccagtttatttctcttcttcccagttaggctttctcttgaattctcagaataataatttaaaaattctgttaagaaatataacctcattagagagagtttgtgttctaaaacctactggttccgctacttaactcccactttgtttttctctgtaatttatgtaatactttacatgactgcctcagtcactgatttaaaagtctcaggaaggcaaaatccatactttaagtagctggcacaatgttctttacatgtggtaaatatttcataattttgttgattgaggaaacaaactatgaagattgcaggaaagaattctcttcatctttatatgttgtggcactttagggtcaacttcagcattgacaaactgacctagtaaaaaagagttttttttcttttttttttttttttaagagacaggatcgcactttgttggttggccaagctggagtgcgagtgcagtggcatgatcatagctctctgtaacctccaactcctgggctcaagcaatcctcgtgcctcagcctcccgagtagctaggtctacaggcatgtgcccccatgcccggttaattttttattttagtagagacagcatccggctgtgttgcccaagcgagatcctccctcctcggcttc

SEQ ID NO: 122982 - DNA, 1589 bp, Homo sapiens
ttttgtagttcttgttcagaagttgtttagtgcctcctgttgacagtggaaacagaactaggctattgtttcaaaacacagacactaaatgaaaggaattattacagattataaatatatatttcctgggattttatttggtggtggtggtattttaaatttggattacatcatgtcgccattcaacctggactatcagattgttgcttaaaataatagctttaaattatgagaacccccaattcaggatttttggtaagcacttcagcttcacttgtagggggctggtaatatgcataccagtgagttagtttgggaagacaaaacctgtaatgaatataacttttctttttaaaaacaatgatttacattatgatatggctttatatcattgtttttattggtcttagtttaatgggtttcccaacattgcaatgacaaattttagtgaagtttctaagatagtatttttcctattttaagttttataagaaaaactataaaataaaccgtgtctgtaaaattattgtcatctgatcagttgattagattaacaaacattatgattatgattaacaaacagtaagcatatagttacttcttcaaaagtcataaaatttcctaggttaggttaactaaataaaagaaaaagctttcgaaaatagtaatgggttcttttaaatccatggcttttttctggggaaatcccttctggattaggttacattttataatatttcaaacaccattccatcagagacagaaaaaacaagagtaagtaagactctgactaacaagtggcctaattattcacttagttactctagaaactaagtattgtaaacatgggcacaagttggatcaaccaggcctggagttgtgagcaatttggtattaattttatttacaaaacattaaagcttgatcactcaatgttcttatctttgctttggttttaaaatcctttcctcttagattctcctaatcctctagactttatgggatcactataattctgttttgcgctgtactacttcttgatttttttcttcttttaataaaacaaaaaccccattggaatagcatagttgaattgtttattatgtttgagaaatattatttaaacgatgtgacagatgccaaagattttgagtgtgcacttatataaaggacatgggttcttgttccttttcttatccttaaccttaagttttcaacttaaaccttcactggttggaaggtggccaaatgtgtaacttgtccctggtctaatagtaacagcaggttcagacatgcaggggaataggaaggtgccaggtccttggccgtgtctgtggatacccataacagcagaaccagtttacaatactagagcaacagaatgcagcaaacaatcttgttgtgcaagttttcaaagttttgtcttcataacctttgaaaagattgttgaggagttttgtgtaagttttgtaatccagtagtagtctaaatcctcttgtttcagcccacgtctacccattcttatttctgcagcatatatagcagtgacgaggatgatgaggactttgagatgtgtgaccatgactatg

SEQ ID NO: 122983 - DNA, 1036 bp, Homo sapiens
cagagtcttggccagcaatctattaatcttgtcttctagaatgagtttgctctggaattttctgattctttgatgttgcaaggtgaaataactcatcagtcagcatccactctagcctgagatttcacatcactcccttaagtctgaaataacattcacaaagatttctgcaggagccaaatttggttggtggtgttgtcacagtgaggctctttgggctgtgcggcacctcatgaccatattggctacacccattgtatttgcagcttccaatcagacctttgtctttatttcccttactttgtaatttcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgtagttggtatcagattatatgctgattaaattggaagcagtctttttgtaattgcaataaaaatgcaatatccacttatgattgttatcatcaatttttttcttcagaaggactataatcagtttaaagactagcaaagataaaatgaatgaaaatctgcattttctacagagctatgtatctatatggtaccattttggtttttttctattattttgttaacctatattttcatattttataatttcagacatgatttgatgcatgttcagtatatacatgtaaaaggttatatataaaacctcttcataaataacattagctgctctcttttatttgcatgtgtgaaagttatgtgggccattactgaattctgacatctttagcgactgggcagccaactgggatggctccttgtgctttgcaacatacatagttaaccaacaaagacaataaaagagaagtgatgc

SEQ ID NO: 122984 - DNA, 1054 bp, Homo sapiens
tttatagttcacttctgcccaggggcaattaaaggcacattacaggataagcgagatgactccccggccacaggaggaggatgtgtgggtaggattattaatgttgaaatgaattatgatagagtgacatgtctgcaagagcaccatgggttagtaacttaacaagaattcatatgcagaaacccataattctcagcagttctttagggtaaatgaaactaaagtttagggagagagaacaaggagaatttgcaaagatatgtatgacagtatttaaaaatgttcttccagcacaaagacattaatcttcctttgtcaaaataattctttctgcatgaaaagttggcatggggctcccaggcttcaggtaagatgggagaaagggagcgtttctttttttttgtaccaaagtactcaatcttctgatcttccttgactttcacgacataggcatatgtctactctgaccagtttgtttcatttattgtggtaagatgtgcttgtcttgtgctttcctggtgcagaaaaggagctgcctcgctcatgcttggtggcctttttgttcctacacacagtggttctcgtacatggtggctaccacatcctggtgtttgtctatactgggagaatcaggcgttccaagtcatcttggctgccctagctctgagcttcaggggatatatgactcagaaatgctatgctttctggaatttggatatttcatttttatttgtttcttggtaaattctcttttgacttaggagaagctaactatttggaaaggtctctcagaactctaattacaaatatatggtaccttctttatattgatctcatttttaaatacctagtcctggaggaagagctaaatatgaatacagtgatgagctgtgtaggggatctcacaggaacacagtcagatttcaagttgaaaatagattcagttgataatacttagtactagattctcctgaatcgactttgggaattctgagtcaacctaaggactatattacaaaggatcagaccttgacttttaggccaggtgtagtgg

SEQ ID NO: 122985 - DNA, 1056 bp, Homo sapiens
tgttccattcttcagttttcctttttttttcattgtttttgtgttttctttctcctaatataaagtgcattactacacactcatccacaaaacatttgttttatattttgctattgccattgaatcatttggaaagctacattgttcattccacagatcaggatgttacagctttcttatatataaatttccttcatttcttttcttgtcatgaatgaatgtcctatacttttgtgtgtgtgtgtgtgtgtgtgtgtgtgtttgtgtgtgtttccacctaagttgatagaactttctgatttttcccaggcatctaatatttttctgagacagatgaaatttattttattctgtaagtccacagataattgtttaagattttgaaatttattttattcttgtccctttatcatggctaagaaggagcccaaccagccaaaggtttgtctgttaacgttattttaagcaattccttgtctctcatccccgtgtatactcattagttctgccggatgtttttctctgtcatatcctcacatttatccccatttttgtttccactgccacggccctagatcaaagcctcatctgagcttttagctcagctctcttttactggctccttgtttctgatctttccctcctatagttctgaaatgagaaaagaacagagccatgaggaccaaggacacataatggatacacggatgaggaagaacaagcaagcaggcagaaaagtcactctaatagaggtaaggggaaaaccaatagaaagttgcgctatgttgtcaacaggaaaagatttaggaaagcatggtcagcaaggacaaataccagagagaggcaagtaaaataaggactgacaagtcccatttgggatctgtaaccgggaggccatttgcgaccttggagaagatagttttgatggagaaacctggaagcataaatcagattgtctccagcccaaagggaaaaagactgtaagaatagtcttattctctttagaagctggaatttaaaggaaagaaaaagctaggcagtaactagtggaaaaca

SEQ ID NO: 122986 - DNA, 1069 bp, Homo sapiens
acagcatccatttcacatgaacaggcttagcagaattggcaagacctgcacatggcaacatattattcatttttcaggataacaaaaaataattaaaagtaacattggcttaacactggtatatagttcagtatgacttctctcccctcaacctctggaataggttcaaattgatgagaatttctgattagagcccttaatgttgagttttttgaaaagttttatcaagtttcatatatacctatattgatggtaagttgctggtcttgccatgggcaaagagagaaaaatgatactgagaccttgtaaagaatagctggacatggaggcgcacacctgtaatcccagcaactcagaaggctgaggcgggaggattgcttgagcccaggagttcaaggctgcagtgagctacgatcatgccactgtactccagcctgagcaacaaagcatgacccaatctcttaaaaaaaagaaaagaataaaacatttcacatttaatttgactgctgtgtttagaatttatttcacaagtctggaaagaaacaggataatttctgttatgatggtgctttctgaggttttgatgattttctttgcttattgttctattggatgagggcagtctgaattagtagttgaatctgaaatttcccgtgtgtatgtacttttttcccaaacacgttttaactgagtcagagcaattccactggtggagaaaaattaagatgtcatgggttcttttgttgttctaccaaatgggtcacctgttgcaacactcacctttcaccaaaaagtctccttgctctttaattcttgtttttattatgcttgacttaaagctctacagctagcagtaataatcatataattatggtccagaaaagcataatatcctcttgaaatctgtaagaaaagtaatgcttgtttaaagatagtgccaaatcttgctgaagaatgatcttgcagaaatctgattgtgaagaaggaaatctaaaaaggccaaacaagcttcagtagagataacaccaggaaagcagttactcaaacaagactgaaagagaaggttgta

SEQ ID NO: 122987 - DNA, 1050 bp, Homo sapiens
tttatgaaactaggatcatacttaagattctgctttttcttttttcaatatatctttgacatctttttttttttttttttttttgaggcggggtctcgccctgtcacccaggttggagtgcagtgatgggatcccaactcactgcaacctctgccttcccagttcaagtgattctcctgcctcagtctcccgagtggcttggactacagatgtgggccaccatgccctgctaatgtttgtacttttagtagagatggggtttcaccatgctggccaggctgatctcaaactcctagcctcaagtgatctgcgcgcctcagcctcccaaagtgctgcgatgacaagtgtgagccaccactcctggcctcttttcttattagcagagacaatcctattttttaaccatttttaggtaccaaaatacccagttttctttttttaattcctaaaatctgtttttttaattcctgaaaatgctgttttcttttttctttatttctaaaaaacaaaacccaaagtagtaaagtactatttaccttctattagtgtttcaacattaatacagtcaagtatgtttttatataaatgctagatgtacagtaataagtatgcacagaaatgttagattatttttgaagatgtggagaaactactgttatttttgcttatattcttctctaaaaattcactaaatgaataacagttattggttttgctattcaagataattataaaaatatctattatagctaatcttcacatgagcagaggaatgtcttaataattttcattattttattaagcatgtagagtcaataagagcatgctggcttaattccaaaggacagactattctaaaccaaagtgtacactctggttattttcaggaacagctgctttcttgcctagttcaaaacaagaacagagaacccaaaagcattagataacttcatggtagttcctcttccagccaaacacacatacacgcaaaattttacattggtaaatctgtcagcctctcagaaaaatggtaggcaataaatatattgc

SEQ ID NO: 122988 - DNA, 1041 bp, Homo sapiens
tttagactgtagttgatttttcaaatttcctatgacttttgcccctcatagagtgatctccatgcttcaaacataccttcatattcatattgcagcagaccagttcttcagataccatcgtcagtcacccttgaggtctacttcaggctaatcccactgatgcccaaaccttaattctaatagatttaaggaatttagagtcatgtaaaggagtggcagaggataaaactccatttgggcaagggagtaggaatgttctcatggaggatatggaactcaaattaggctttaaatcttaagatgcgtggatttcttttgttgaagaacatgatttgatcttctctatctgaatccacgtgttagagtagaatcctgcatatatttttttctcttaggaatgtgctatgtgtgtaagacagtattttacttcccagtgagagaaggtataacaaatgatctatgtttatggaaaagaagcccctaagaaatataatgttgcctcgagtaattaaaatgatttgagtgcactctgagtcatggaactaacagccaacttttgagaaacgtgtaactgagcttcttagcacctggctagttgcatttcttaaatttagctcctttattaaaatatatatggtttgattttatcaagaccttaccttataaacctcccacagagtctatcagatatttaatttcatgttcaagtcttatttttattatcacttttttttaagaaagaacatgaaaagtcgtctgtgataaagtgactaaaattgtggggcatctaagttcatagaattacagaactagtgacatggaaaggaccttagagaacatccttggtgattctgatcaactccttcattctacaggaaattgagatccgggaagctataagaagttcgtttaaaatgatgctgctaattaggagcatggcctccatattctcaggccagtgcccattttcctccaccacctagttagcaacacacacatacagttggtacctgcacagttagccaggttctgtatcacact

SEQ ID NO: 122989 - DNA, 1074 bp, Homo sapiens
aagcctcttaaatataccctgggggagtccatgaagagttcccaaggaggaaatacttgacctgaggcatctaggatgcaaaaatatgtgttaggtcagtgaagttagaaaaacctttccagcagagggaataacgtgagtaagttatgggatggtatgattatgtctgggcataagttctaatagagagaagtacaggagaaatccaggaaccaggccacagaagagcgtagcatactctactaaaacacttaaattttatactcctgacgaaggggatcccctgaaggacgtaattcagggaatgacatgaacagatttgcatgttagaaaggtcattctagtgcagcagaatagttgctgaatttgaggtagctaaggacctagcacaaggaaattaggaatccatggaaataaaatacaaaaacctgaactaggggggatggaggtcaggggacataagctgtaattgacaggattttatgattgattggattttattagtgaagttggaatctaggattttgctaagggtcttagacaactgaataaatagtggtgccatagaagtaatgaaataaataagaaagatttgggaagacagggaaaaggaatcaccattccttgcagagtaagatatgataagctcagttttagatatctcaatttgttagtagtatctgtagtgctcccagatagaaatattcactgggagccagaaatgcaggattggaatttgagagaatgtagagcttcaaaatcaaatgagaattagtgtgttagttctattatatcagtaagtggaagcttgtaatgaaggcagagcccagaaagtatgtcatagagctataagaggagaaggccaaggacagaacctaattaaacactagtattaagggacagtcaaaggaagagaaaattaagaaagaataaaggaaaaggaaaaaaagaaaaaataataaacagaaaaaagtgccctggaagccagaagaggtagagaggttcaagaagagtatagttggaaacagccaagcagttaggttgtcgaagcatttggtcatcaagaggaccctg

SEQ ID NO: 122990 - DNA, 1369 bp, Homo sapiens
tttgccagaatggggcagcatttcattccataaaatagaatatatgttccagtgagctgagcaaaagaagttggttttatagacagagaaggaacggggggagaaacaaagaataaagagcagattggttttttaaagttcctttccttgtatatcaggaaaaggaaaacagaataacagaagaataactggttaacttcaggttactttttgttgtcaagattaaaacagagggagcttcattaccatactggttggaaatttaaactggcctgtttgggaagttggctctctttctctcccaatttcttggaaggtgaattaacaagttagttttggtttgatgacatagaacttcagcacgagtgacttcattttgattgttagtctggtctgttggggcctagttcaggagcttagtccaatggcttgtaatttttattcaatattcaatatacctggggcatcaggtagaatcatcaggaaggtcacaccttgatagtggggttaatttatccctagagtaaagtcttctctgaatatgctctatcaaaacctaaacctgggccaggagcggtggcttacgcctgtaatcccaacactttggaagccgaggcaggcagatcacgaggtcaggagatcgagaccagcctgaccaacgtggtgaaaccccatctctactaaaaatacaaaaattagctgggcatagtggtgcacgcctgtaatcccagctactcaggaggctgaggcaggaaaatcgcttgaacccgggagacggaggttgcagtgagccaagactgcaccactgcactccagcctgggtgacagagtgagactccgtctgaaaaaaaaaaaaaaaaacctaaacctgaaaacggatatcaagtaatggcatgccagaccaaggtccaacactctttaaagaaatagaagaaaatccagcactcaccaaagtaaaaatcgtgtctattagtttcctagggctgttgtagcaaactaccacaaacttggtggcttaaaacctaagacatttattcattcacagttctggaagcccggagtctgaaatcaggttagtcaaggagaaagcataaagaaggtggtgggatccagatgccatattgccttattagactggcacagagaagttcccaaatgattatgggcccaattgaagtagggctgaaggaaaaagtgctcaagcgtgtgaatttattcagtgcttagcttgtcgaatgacttggaggtattacgaacatcaattattggattgcattgtggataaaactgtaaggaacagctatgctgctgaactctactggttggtgttccctcagtacactggtttcattgaccaggcgtcactgag

SEQ ID NO: 122991 - DNA, 1526 bp, Homo sapiens
tttccaagaattcatagtatgtaaactggggtgaatgggcccctataaaactcataaaatagaacccatggccaatctcttcctgtaggtaattgcagggtggagagggaactgataaactataagcttttataacttgtcataaaagaacttgttttcccttatcaataaagtagcaattcaaagcagttctatcgaaattcaaatataaatgcaaaataggttctctttaacaaccacttgtagtcttccgtaatataacatgtttaagtataagcacatcagtttatttctccagacattgtaaattgtgaagcttatgttgatttttttcccattagcatactccactggcatttatgtttttcttagactttttttcctccatttctcttttggttttgctaaatttttctacctgaaaaactcttaaaattctgaaaattttatattactggaagatataacagcagcataaattgaattttctaaattatcaagaaacatgaggtatacaatatacataggatagtaccatacctagcactggtgaggtatggaaatactatgggaaaagtagaaataccaaaaaaaaaaaaaacccacaaaacatggttttataggtctttagatatatgtatacacacacatatatatatgtgtgtgtatatatattgtgtgtgtgtgtgtgtgtgtgtgtatatatatatacacacacaatgtgtctttgagtagttcttgatgtcattagaaaagtgacctgtaaacagctaaatcctaatatatgaaatgaataaaaaattcagagcaataacggaagggatgtcatgttactgaggcagtttgtgcccaaatataggaatatggtgtaaggctttgagtgctgtaggaattcccagcactggagtggtttaggaaggctgtttagagtcggcaagtgctaaaccagatcatgaaaggatgggatttttaaaagaatgcgttttgctagaccagagtaacagtgtgaccaaagattatagaaagacacactgtgtacacacagtttatagatgggtagaaaatttgactgcagcagcgtagatgagatagtagaagattggaaaatgtgatttgggcatcatttataaagatcattgaatgttaggttaacagttaagactatctgtataagcaatagtaaggtatttgatcatgagaataatatgatgaagggagtaatgttttaaaaggattaaaataaaagcagctcatgaaattgcaggtggtggcgttaggaagaaggtaactgagctgtgaagctacagaaatctacatttgtggtgataaggatttaaataaggagactatcgggatcagtgtggaaatagaggtatgcttataaaaagacttggagatgagagctgatgaaagggactcaaaggaaaagttgtagttaaaaagggagatcccatcattggaaggcccaggcctaggttgtgggaagtcatgtattataattgcatgcaggttcttcacaatggata

SEQ ID NO: 122992 - DNA, 1039 bp, Homo sapiens
gggatatgataaaggcaagcctttcagacttcacaattatatataggattggctccatttcgcttcagtttccatggccatgtaggccataagagggatatttatatccctgcacatactatctcagaagcatgaccattaagccatttggttactaatatgtctaacctcattttaaggcgtatctttcttagaaatgtcattgagatatcactgaacagaaaaatttcaaaagcataatatgtggtccatctcaaaatggccaaattaatctcttttattaagaagccagtgtttatgaaaaaaaatcctgccttaggaaccaggtgagctagttttcagacctaactctatttctaaacatggaatcttgagcagtttcttcaggccagagttttctcatccctccaaataaatgagggctctggctatggtgagtttctgctttaaaaattctgtgattctattcagtgttcaaatcagtttgtaaagtggataaataattaagtgttgattgtacgaataatctattagaatctgaaatacatgactacaaaaacaaatcatgtaaatagaatgtttaaaaataaaaatctcactgaaaacctatctgaaatatacaagtcacatctgtcgatatttgcctttggacagtataaaagaaagctatttacacagagctagtaagtatgagcccattagcgctcatgctaggagacttaagagtaggggttgattttatatatatgtaagtgggtttacatgctagagtgctagactctgcagtgggtttatgttctgttgtaacttttattgatctttttcaaggtgagttctaggtaacggagactgctagaaaagtaagcatttctctcttctttgatttgtattcctcacaatttctagaatgcttcatttattcattctaaaatcattttaagtgaccaccttgtttaaggccatctatttagcatgtggagtaaatgttacagtctctgccttcaggaacctctagtctggctagggagacaaataagta

SEQ ID NO: 122993 - DNA, 1049 bp, Homo sapiens
aaatatgttcttttccatttgaaagcacagaactctgaaaaattggctacatcatcatatgacatcataaatacctaattacccttacttctagtgatgttaataataactaatataacaccttatttgtatactactttatggtttgcccttgccaagatattctatttaatctatttcttatttaatgttcattagtgctttatggttaacatatgaatagcactttatgatacccgttcatcattattgctttcctggcacattcgcattgaagtatagatattatttttcttatctccatttaaagatggaaagtgaagctcaaagatatcaaatgagtttgttgttttaggtattgtatcactataactggtcagttttgatctgtatttaatggattttgatagaatttttaaagctgggtgatattttaggactgatgtggtatttgacccccccaactactttggaaaatacttttattttttattgagatgacataatagtttagttactttaaaaccatattaacatatggtcttaattgactttttcactgaatttgctaactctgctctaagagaaaaacctaaactaagatatactgtttattatcactgtttaaaagcaaaaaatagaaaaaaaaatttacaaacatgtaaataatgaatcagataaagggcatgtaacaagagcccagtattgtcttatacagaacatcaaaaggaaaattttaaatgcttgcacagtagaagtcctctgtatggttttcattatttaacaaaaaaatgggaaaggggctgttttaatatagtaatatttatatgccataaattatcattttgtttatttacagattacatttttgaagtgaattaggaatcagactgtcaatttctccaaaatagatcacattttattgtgctttttgaaagtaatgaaaaagattaaatgattgatttgttaataatgaaaaaaagatagattttttttctgaaacgaattctgatttacaagatgaatttgcctataaacatttcaagctt

SEQ ID NO: 122994 - DNA, 1050 bp, Homo sapiens
ttttaaaaattcatcagaagaatatatgagtataaaaattctatccattagtttagtaaccagctcaaatgctacttccataaagtagtctctcttgctctatagctagaattaatttctcttgtccaagtttgaaaagaactcttctgtttttcttttgcagtatgttctacatccaccttctattttacgttgacatgtttctcctctcttgctaaattataaactccctgggctcttgggactagctctcctttattctgcatccattatattatagaatgtctcccatatggcagattctcaaaaaatgtttgttgaatggaaattaagtatttaagagaaaagattttataccaccagtcatttacatgattaagacagttacatttgtaaaatcttttttgcttgtagattagtagcaaggaagtttgtaggagcagcaaattatcgggagaagattcatagtactttgactccatgtgggacttttctgtttgctggaagtgaggatggtatagtgtatgtttggaacccagaaacaggtgaatgtttattgaactttaaaaatcatttggggaggtacaggggtttgaagaagtgtgaaaattctaccattttatggaataattttcaaggaaattctgattttgggttttcaattatgttttttaagattagaaagcctttaaaggaactcagctacagtctaaacttgtattaaattttgttctctattgctttaatatctttatggatttagaatttcacattataattcaaggtttgttctttcatggcctataatgagacattgctgatcttagaaaagcgtttaatggaggctaacacaaagtacaaaatgttacaagctgaatttggaatatgattaggtagacaaattgttaaacatctatattttcattagtaacggaaacatacctgtgaaagttttgatgtctgaaacttaaatagcaagttgcctgaaatactgcagttcagtttttttccaataaacaattacattgggaagctcacttgtgcctcacc

SEQ ID NO: 122995 - DNA, 1053 bp, Homo sapiens
aaagtgaacatactacaaaaacacatactaattaaatgtgcatttgcacattgcataacaacacagaaatacaattcatcagctttattttcagccctaaactgacgttactcagaatccttttgctaacaattttaaagcatcctatacagtggaattggaaatgatattttaagattaattttgtacccccaaaaaagtttaacattagacaaacttttcagtagtagtattttttttaatcattttaggaaattaaagaaactgagtttaagggaattccaataagttatttggagattcatcccaatggaaaacgtttgttaatccataccaaagacagtactttgagaattatggatctccggatgtaagtatatttcagtgttgacaggataagtactcacagagtaagtaatgaattaaattatatttataaaattcggtagtggttctcaactaagcagtgtccccacactcaccaaggaacatctggcagtatctggagattttttttttttatgttgcttctagtatctaatgagtcgagataaaaaatattgctaagcatcctacagcccataggacagtccccctaaaacaattatccagcccaaaatgtgagtagttctgaggctgaaatgtagttagttgcttttattttcacaattaaaaaaaagaaacttctaccttcaacaatgatattgattgatactgatattatcactatgatactgttacagcattagtataatatgatataactacaggagagggcttttgatttatatgtccttgtttttttgtttatttccaaataatcgcaaatgtagggaaatatccttcctgaaaaaggtggaagcagtgttctgggaaaatcaacatggacttctagtgcacttttgtttgatgttagagatgataataatacttacctggcacaaagtgtgtgctgaaatggtgtttactattttttcgtgagtgaaaaaatatggaaggctatgtaccatatttagcagatggtttaataatatgttttatctaatttttttt

SEQ ID NO: 122996 - DNA, 1053 bp, Homo sapiens
tttgtatattattggattaaggatcttctgtctggaaacctaatttctaaatattttcattagtatatgaaattccttctggacgtttcatgagagaattgtgtggccacctcaatatcatttatgatctttcctggtcaaaagatgatcactacatccttacttcatcatctgatggcactgccaggttagtatccttgagaagtacttatgtgcatgctgtttgctgtcaaggaaagcaaagagaatataaactgatgtaactactcttatgctccagtcgtattttcccaagaagggactgtcataaatatgcatcatgcagactgattccataaattatagtaacactttttaaagacatttttcttaaatgtcttttatttatgtagcatataatatttctagtcctcaccatctttaaatgatcattatgtaaactgattaatgctttgagatggggttaggggttattaaacacttgagattttttcctagagcataagctcttggtggcagggatactgtcttcactattggctggatttgcagagggtagaatccagtggtgctcagtatatcacagtagaggaaacaaatatgtaccttatattttaacagttttatagattggttaaacatttacatttttcagaatgtcaatcttaaaaataatttatcccttttcaatttaataagtatcacaataaaacattttaaaagctaactttaaaagtttcatttatactttttttagttgcttgttctaccttgaatgtgttctaaaaatactgttagttttcagggtgcttttagatacatcacttaatttgattcttacagctattaggtaagacattattctctccacacactacgaaactgacatgtaaacagttgagatccatgctgaattcattgtcatttacttctgccttctactctcttaacacttcgtgttacttttagtgttcagaccacttcttctactgatcttgccaacctccttttctgtataaaatatctaatcaagatgttaccattattggttag

SEQ ID NO: 122997 - DNA, 1075 bp, Homo sapiens
atgggaggagcaaaatcttcccctcataaaaccccatgatttacatggtagaactgtgctttgtatcttgtacacactaccaccaaatgaccctattctgcttctaccttcttccttccgcaaaaccagatacacagcaggccccattatggttttagggtatataagatggtttctcatatattacatttctgtagaggagtgagcattgttactccctgtactctacaatgagttttgaaaggaaaagtcaactctgactaagatcacacagctgttgaggaataggtttgggatttgaaccccgatatactcagttctttccattatgtccaccaatctgttttcttttcttttttgttctatattgcctcctgttttctccaacacaaagtgtctatggacttcaccttttaaaaatgactgtatataagtgaaatgtgtttggctttagttgtttgccttcacagctatctttttgaaaacaaagtgtggctaggtgtaaacccttgggattctgagacaataagtaaaagatgaaatagcattgcaaacttctgacatttttgaactgtgtatcaagatttgtggcatatgtatttgagtctgctacaggaaaattcccagagcacataccacaattattcccaaagtaccttgaactgagatgcctagtcagttcctataactgggtgcaccagagatcgcactgtactccatgccataagccttcacaggtacaggtttttctaaaatggagcttgtgcagaggctatagtcgttttgcacaatgaaagaggctgtcttcaatgtgcatttcgatgtgtgctatgggaatcaggactaaccacgacccatggagacaatgctgcatgacttggagagtgcaacgtaagacgcaatgactctgagcctgcaccacgccatctgacctcaggatctccctgcagggatacgaggagatcttagccatatagcctttctattgccctctactgtctagggataaaatgacagaaaacacagttctgcattttggaagtttgcttaataactaaaaaaataaaaataaaaa

SEQ ID NO: 122998 - DNA, 1049 bp, Homo sapiens
acaactttgacatgtgtctaagatctttattatcaaaagattctctaagaatttcactttggtaattttttttcatcccacattgaaattttaactacatttttctccttctattttgaaaattactttaaaatgattgcatatctttctatttataggatatgcatactaactgatcctgctctatttgcttatttggacctctgggtctatctactctttgtcctccatgatcttcctggacctattttgtggtctgctgataagatttcttgtattctgtgttttctgagacatctttgcatttgacgttaacattcttttgtccacttaggtgcaaggtaacatacatctgtctttgacttgcatatgttcacataccttgctgattttatgtttgtgcgtctcaattagaatatcaagagtcaacttcaagccacagataactgggcttttaataaatgccttttaaatgctgttattactttttttttcctgctttcaaactttgaggaggcaattgatgaggctactattaaattgtgtttttcaagtctctcgttaatcattgaaaacttcagttaagtcttatttacctttaaaagttatgatattctggattgaacataatttataatcatgtcattttcaaacatgtaacatgaaaagtaatggcaatattaatactaatttgatgcaaagataattattacttataaaactagttcaaatccctttcttgggcattcagcactttcaaaaataggctcccactcacctagtcctgtaaacacattcaaacttacattgaatatgcaaaatttctgtggaagtcatattgttgcacaaacatgtcagatgcatctgacattatgtatagtaggcagaataatggccttccaaaggtgcccacatcctagtcctcggaacctgtgaatatgttaggttacatggcaaaggagattaaggtagtagatgaagttaaggttgctaatcagccatcattaaaatacagagaatatctggattatctggatgagaccaaaata

SEQ ID NO: 122999 - DNA, 1099 bp, Homo sapiens
gtatgcgtgtataaaatgtaaagcaatctaggtactgaatgcttttcacaacagatttggctgtaaagggctgtgtgtaaatataattgctaaaaattttttaatacatatgtatatatacaaatgcataaatacacatataatttaagatatttatacagtgtatatttataacatttacatataaacacattatataatatacaataacttatatttatacataataaataaaatgatatataactatacacagttttcttaagcaatcgtgtttacccacagtcctttatgagcaaatcttaaagtggaaaagttaaatactcagtacccatcttaagctttgcttagaaaataatatgcttatttctccaatgtcattatacagtgaatacatcaatttgtgtttctaactacaagttgttgatttctgttttagcttttttaaaatagaggatgaagttcagagtgtatgtgaattactgaaaaaactcttttttttgtttgtttaagatgcattctcctccccgctctgctcttggacctacactgaaaattcctaactggattaaaaatgaattcacaatttgacttgactcttaaattactaagcagatgggattgacactctttccttgctaccatatcgctactagcattacagaaattgctcctgttttggttctaattagtgttattaatatatattacgttagagataattgtgcatgattttgtaataaaccactttgtttgtaggttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagct

SEQ ID NO: 123000 - DNA, 1044 bp, Homo sapiens
tttttttttttttttttttttttttttgagacagagtcttactctgtcgaccaggctggagtgcaatggcacgatcttggctcaccacaacctctgcctcccaggctcaagtgattctcctgcctcagcctcctgagtagctgggactacaggggcacgtcatcacaccggcgaatttttaaaaatatttttagtagagacagggtttcgccattttgaccaggctggtctcgaactcctggcctcaggtgattcactgcctcagcccccaaagtgttgggattacaggtgtgagccactgtgcccggcctgagagtagcttttattttgttttattgtcttttgattttcacgtaggagtgtaagagtttatacctcttttgattggaaatatatcttccctccatttcctattttttttcacccacagaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagtaagtaacagtaggatttttgtttcagttagatgatactcatggtatagcctataccaacctgtacagcatgatactgtactgaatatagtacgtatagtagcatacaggaacatctagtatttaagtgagtacaattctgaataagtaccatgaaaacattaaatgtacataaaaggatgttgaatatacaaaattattatatctgatgtttattcaggataaattaagacacatttgtagtgaggggatggctttgatttaaagaagaactagctttactatactagaagattgtatttttgtattaaaaagtctgttgtcttctaagtaagctttttttttttttttttgagacgcagtcttgctctgtcgcccagg

SEQ ID NO: 123001 - DNA, 1022 bp, Homo sapiens
ggggacacagccaaaccatatcataagcaaatcaaattttatctacttgttgaaaatctgctgtatctaagacaatatgcttgtttctgcaggtaatacagaggagtaatacatggttgtattcataatgcttaaaatatgaggaataagaaacaataaagataactgtaatatgagattgtaaggaagacgggtggggtgaattagaagaaagtagtcaaggataatttaagatttttttaaagcaaaagtaagttgaagaatcatagtaccattattataaatgggcatcttagtatgagaaactagtttgaatatggagatgaggtgagtcagaggtgatgttagaacatataagtagaaatatccttcagacaattggatatatatatggttttagtatgtaggaaagaaaaagattcagttttgggagttatctgctttgttttgatatttaaagccatggacttcgataatggcaaatgtcattagatgtgattgaaacattctaaatatcagtaatcgagagactgaagataacagctgaacatttgtttatcactattaggttattggtgaccttaagaatttctgtaagtggagaatgggactgtgttggagtagtttgaagaatatcaggaagggaggtgggatcagcaaccttcttttgaaaagtttgcttgtgaaaagaaattgagagaggccatcagcctgaaggggccgcaggatggaatttttctttttcttttaaagttagaagtaacttcagcatatttgtcatcactctggaagaaacagacaggaagaaatttaagatccacatgagagaggattgagcaccgcctttgagaaggtagttgggcaagggatctaattaaataagtcttggaaaggagagagactgtcctgccttaaagaacagaatgaaagtgagagagagtgaaaagagattttttttttttttaagatggagtcttgctctgttgcccaggctggagtgcagtggtgcaatcttggctcac

SEQ ID NO: 123002 - DNA, 1657 bp, Homo sapiens
aaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtca

SEQ ID NO: 123003 - DNA, 2087 bp, Homo sapiens
atctagatttcaatctcagtagatttaaaatctacttttatatgtaaagtataaaattcataccaccagtttcattttagtgaatgttataatattttaatgatatttttatgactttctgctgcatctttatgactaaggtaattttgggaaaaacttaattttatctcattgcatttggtgtaataataagtggacttggattgacataataaaaaaacaaaactcaggattctaaaaatcagtggtaatttagcagttgagatcttccaaatgattgtctgggtaaccttcagtgcttgggttgctaagtagtaagatgtagttattctcttgatgatggaatgtatttttgttgaaaaattcagttttactggttttgttttattgtgttttagaatattaccaatctcatatacccaatcttcagaagattaatactgtgatttatgattggagaaatgatcatctttacaagaaacatttcattgacaattgtttttaacctttctgtagcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggtataaaatttcaacttgtgattctgacagattttttttgatataggtttggtgggtgaattatttcatttttaggaacaattattaatatggttccttttcactctccgcatcttttgttaatctttaattttttctctctcttttaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctata

SEQ ID NO: 123004 - DNA, 1458 bp, Homo sapiens
agcaagtgggaaagtactgaagtaggcagattctcagtgttgagttgctgtcttcaaaggaagagaaaatcgttggtggggaagggggttcaggattggagttttggttattattcctttgaaacgtgatccttgtatggagaagagaagatgattcagaaggtcttggtttctaatacagactcctttgttaacatgttcttagctgtgtataaatatctaacttctggcccttttaaatctgagataattaaaaattaaacattttaataatgagactgaaatcttcgatataaaacttgagtattaagaatatgtttagcatcaaaaatctcaattaagtagctgccaggatgccctacgaaaggcacagtttaattgtttaggtgctgttgtgtttaccaagtttcagatgattgtatattaaaagcaatggctagtttaaccctagtgtctagctttgctcttggcttttctatttctgctaactcttagctacctggtgtggtaatcatatactgccaccaagatatctgggaaatgtgttttatgggtgatggtcacaaggggtagaagaaagggctagctctgtgaccttgggcaagttacttaatttctcagtgcctcagtttgtttatttctaaagtgagggcagtaatactatcttagagggttgttgtgaggattagttgaataaatacatgtgaagtgttcagaacagggccagatccatattacacactatagaaacatcatttttgccaccatttattgagtgcttgcttgtcagacactgggccgggcacttcctgctgatctgtgttccctcaaggcacacattattaaaatgaagtgaattctagagaggttgcccaaagtcacacagtttctgataagatttaaacccatgcttctactccaaaacctcttcccagaatccatggtgtattgtgtaaaaatcataaaaaaacacagcctctggagttgggtatgttaatgtgataagggagcatgaaattatgtagtggagtgggcattatttttagtggcagactattttaaagtagtttattttgggtttgtaataaactctgccgtatttaaatttacacttttgatagttccaaaattcattcattatagagtcatgtacacctctacctagtaatctttcagtggtttggtaaagatagattattagcagttggtaagttctctttcatatggtctgttagttacccatataattgaacttttcaagtcatgaagggggttaatcagttaaatgaatatatccaaaggcacagtcttatgttttggaaaaaaaatactcatatgccatattacgtaaaaaaaagttttagtggcttttggatggttgctcactactggtactctatagattacacaacattttgtttgcattataccccttttctaataaaggggcattttgct

SEQ ID NO: 123005 - DNA, 1406 bp, Homo sapiens
cgagtatctagttgggttttggtggagttcatttattagataatttgggaaagagaagagctttgcttgtatggtgataggtatggctgaatacttggggcttctatgataattcaaagaaattagacaacttttgactagtaaaaaggaaaaacaacttgattatttaaaaatattagttcagtccatgaaagtacagtattctaacacttaggttgatcatttcttaacctactcaacttttagttggcagaaattttttgcctatgatataaaatggccatccttttcatcctcaatggccatgagatttagataggaaattagggcatatgttttttgttactgcagtaaaattagaatttgcatgtaactaaataccttttgattgcatcactaaacaactttgttaatgttaatcagtttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttggtgggtgttagacatctgtgtttatttggtttgcattaattttcgaagcatactaggtgaataaatttgagtacagataaccactactataagaagattcaccgttatgtgggaaaccttttttaaaataattacccagacgatttgaaattttgaaaaatgtgggtccctttagtcctgttcatactttcttgatattaaacataggctgatcagggtaagcaaaaaatatacctgatttgttacccacattcagagaaaaacattatattatagttgagcttaatgtttgttttatatctgtctataagacagtgacagttgtagaaacttcacattaagatgtaccttccattatcatagctatttgtttaaatgaaaaggagaataattttttcaaagtacgtgtaattaagaattttagggaggctgtcaactttcattggagaaaaaagatgatgaaaaattacattacagaaaagttgctgctagatacactaatttggtgcttcctgtggtagaggtgcttttccctctgaaatagtttttcaaggatgaagctagaggtggtaggtcctgaaggattctctagataaggatgggcattttctgctgtttggcatggggaaaagggtctctcctgcattatagaggtggacaagaatataccgaaactattaccagaagtattcatttttttgtcatggcttttcagagaatttatgcttcagagactagttctgaaaactagttccttccatggaggaagattgtattggacttgaggaattgttgactttttcagttggctttttatgagtatatttgaataaacc

SEQ ID NO: 123006 - DNA, 11277 bp, Homo sapiens
aatagtagttgatgctcattctttttcccccaccaggcttaactttatattatgtatgtatttaattaatagtatctcactgatagttttttgtaatcttttcccccatttaactatatattatgccatgccattaaatattcttttacaacatcaatttaagtgcttgcctagaggtactacaatttgctaatatgtcctaatgcatgtgatatatataacacatgcgtgtgtgtgtgtgtgtgtgtgtgtgtgtgtgttttgtgccttcatttgtaaggtctttaaggtattctctcagtatttaccttagtgaggctttttgattggaaaccattaacttttgtacagatgagttttttaaaaaagtgtatttttgcctttactgtttatttacatgttatattcaaccagagtatttagaatggtagcatggaatactttatttttcttgcattgatatttatttcatttttagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggtaaaaactaaaatacagaatctagattataatattgtttttgttctttgaattctgtttggaattataaacgtaaaattgtgatatgtatttaactagcggtttttactcttgacttccttcattttaagataattccaaattgtttttactcttatctggtgaactttggaagctaagtgttttaataaaaattaatttatccagctactcaggaggctgaggcgggaggatctcttgagcccaggagttcaaggctgtggtgagctatgattgcgcctactgcactccagcctgggcgatagagcaagaccctgtctctttaaaaagaattaaaaaaacctaatttctatccctcctcttaattttaccattttcggtccagaattaaaaatacagatgaggagaagttgagtagcttagagcataactaaatgatatatgttgctaataactgtaaaccttttagaaattaagtttcttaaagcattgaaggcttattttgttcttttcactattagaatgtgacctacataaataatgcagctatattgcatgttcttaggtggcataaacagtctggctgtcaatatttaatgatttcagcctgactatacaaaaggtaatggtatttctcactgactaatgacatttgaaacagatacattgtttaaattctgatttcaagtgttgctgaaagttgctaacagtgaaaattggttgcttcatgtattgtgatttgacttaaaagtgagaaaatagaggaaacatgctgtttgtggaatagcactgcacaatctagaatttatgattgaactgatcattagtttctatgaaatagtgccagaaatcattatttttctagagcaagtttatatgaactgttctgtgattttcataaagtattaaattactgcagtggtaattaaatccatttgtgtgaactcttgtttatattaatagataatatctggaattttggggataattatcaatagaattctaacaatgtattatctattagtggttcttagtttcaaaaattaaatttaggcaatctctagaagttcgtgttagtgcagaattgtggattgtgactaaataggacaggtttttgtgattggctttgtgttttaaacttcagaagtcaaatgtaaatttattttaaaagtcagtacataagttctatatggatgctttcaatgatttttaaaagtggaatctgaaaaagcacttttcaatagggttattttctctcttgctggtcctgagggattgggcaacacatttaaatatggaagcgatctacagtgaatgcaatccagagttactatcctcttctttgcttattcgcaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacaggtaattccatattgatgcccagtaaataatctgtgggcagtcagtattccagttaattatcttaaactttctgaacataccatttttatatttaaaccaatggtatattttgtgtgtgtgtgtgttatcaatatgttccagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaaggtatgcttagtatgtttagtatcgtgaattaaatttctcttgcatgcaaataaaaaaatgtgtaattatgcttaataattcatgtaccccagggctagcaaatatacatccaatattattaaaacttggaaaagtagtttcatagaagagagtccctagtcttgctagcattgaaacttatgaagatagttaataaaaagtaattgaaatgctggagaaaccatatgctaaaaatctgtatcatggtagaacatgatgtagatttgttgaatgctaaaagtgttttttaagtatgtcattgtaatgtacttgaagtgcagaaggcttacagatagtctttcattgcatgcctatggcttgtgataatcttggcatagatttataacaaagtcagacagtattgttattgaatatttctaagaatttcttttcaacttttaaagaaatctgaaatggtggaaaaacactttttttgcgcttaattttttatacataaaaatcttaaaatgataaaacaagaaaatttatcaggatttttaaaggaaaaacgttcaagaaatttagaagtatattatataaatactgattacatgaatagtgactaattaggataatgatgacacttctttaggtcctaaagataaggttgtttatttcaactaaagtaatgatttttttttttaaatttttaccagtatgtaattatagttgcagagttactaataattttcaaagattttcaagtatgtcttttgggcagttaggttaagttttgtttttgttgttttgtttctgtgtttaaaaagcaacttactatgagacatattctttctcaggaacttcaaagactgttggcctttaaaattaatcccctccccgcttttaaaaaatctgtcgtttgacatgagaacagctcaatgtaatagatgaaacttgcctctagcagttctttatgcagttgatacatcagaacagtgaatagttagatgaatttcttttgggctgtaattatttaaacacggtaacaagacagttttgctatttggctctgagtaggtttgtgaaccagtttatgaccatattactgtggtacataaaatatgaaacattcttttttttttaattttttaatcttttttggcctagctccacattttacaatttattactgaattttgagatcaggttttgataaattttttcctttttcttttttctttttttttttttaaaagaactgtagtaatgtttcataattggtattgtgcaaccgatctgaacagctcttactttatatagagctgaaaatgcccagtgatgttttctttttcattgtaactaggtcctggaatatgttttgaaatggcaaaatccatgtttcaaagtaaaatagctgttgaaagatacaggcaaagttgaatcttctgtcttcctggcaaaaatggcataaaaactgagttgctagctcaaattcctgggtttcatggaattatgattgaggcactacccttgtagtggccgtttcaagttttaatgattggttatgagacatgtgctggatattgggcggtaagttgacaacagatgtatgttgacctgttaagcagatagcttgcttcataatgtgacatttcatagctcatgactttatacgtctttctattttacatttacaacatatcttgaactggttttaaaaataatcagtattgatattactagtttgaaaattgtttaaagagagacaaaacagcaatatcaaatttgctgttgggtttgccaagatgccagatttttggagtaattattgaatgttaattgatttaaaaatatttttccaatttgggtgataatattcagtgtttttataaatccatttttgttgatatggcagcatatagtcactgatgaaatttaatagttgacccaaacaagctttttagttaactccatattttcctgttttttgttttctgcaaatgattacttgaagtaatgtcattggttcatattggcaaggtattagagcatccatagattatgttcctttttgttctgaggaagtagtgtattaatgaagtggaattagagactcttgatttaatctattaattgctcttggattagatgtagtattgacagggacctgtgagcaactttcgaaacactctcctgttgaggtacaagaaattgaaagggtaggagttccttgtaacacttgattctcttttgctaggtttcttatttttattttcttttcacctgctacatgcccttctgtcacaaacaaatctctcttaaagtaaagttaactaatcggacagtatttcttctaaatcaacagagcaatacttcaagtcagctgcaatgaccctaaacgagcggttcacttcgtatcagaaagccactgaagaacatagtactcggcaaaagagccctgaaatacacaggtatgtatcctgctgaactggcatataaaaacgttgttttgataggaagacactgttaaaacaagattgtattggaagtttgtttttgtcattgatacaagtattattcctcatttatactttaaataaatatatttcaaagtcttgaaaattctataattcttgattttcagcttagttgaaactggttgttagaacttgaaatattaactcttattactttgcagtatggaattaaatagttatcaattagtttggtttttgggaggggcagtggaggcctagagttaccttcgaatttctagtgaaataaatgtgaaataaatgtttggtgagagagagagaacgaaagcatgagcattgaagtcagatagttgtgttgaaatcctgactttgtctcttcgttgcattgtgatgaacaacttaatctctggacgtaagttttttcatatacaaaatgtggataatcatgccagttttgcagggtggcagtgacagtgatattggctatgaagtatctgacttggtactttgtacacagttggtgtgattttggtgatgactgctaaagaagcactgggtagttgcagccaatactgacttagaaaggaaaggtgcagaataaaactaaaggggcactgaatatctaaaaatactgaagacaggagcaaataatcctattcatgtgtgtttgttgatgcttaaaatcatatccagtttaatcaaaacacattttttctatttttgatggctaaaataagtttgatgttttaaaggccagacttcacttctatataaaaatatctggttggagcattttaattcattctttgtgggtattttttcttaattgtgtattataaactaaattaatagtcttggtgtgctaaattagttgattgggagagaaataactgtcttaggaaaatggataatcgtgtggatgtttttgaaccaaaaagttaataatatgactaaaaatatattttattttacattaaggagaattgacatctcaccaagtaccctgaggaagcatacccgtttagcaggggaagagagagtttttaaagaagaaaatcaaaaggtatgtttttgaatgtaattttttttcgtgttaagttcagcttagttaatgatattgtaccaaatatagtttctcaaggcaaaatgtctatagatatcttctacttttaattcataactatattatggtagtgtacatactgtttcttcctggaagaaattaaggtgacactatactaagtgtcttaaatttaaaccaagagtgttttttcaaaacactaatgaaaggaaaaaaaatagtcctaagaaaagtgtaaagaatcagtgggtagacaaagggaaattataaaatcaaagatacaaattagaattttgagatgagattcattagccagagtaaatatttctcgatttgtgtgtctaaattaatatctctaggttcttcacagataacaagaagtaatccccatgctactgagcatttttgatgtggattaagaaataagcattctaagaactggtttacaaatgaacgtttggaacaaagacttgtcactcttggaatgtttggggattgggggaatgtcttttaaacatgagagaggagcctgtgaaagatattgaggggtcttggtgagaatggaattcagtggttaaggggtctccaatatactcttgacaattcaaaatgacctttgccaggtagactaatctatatcaggccataaaatgtctagtagtagaaatgtggggaaaggcagaaagggagcaactgttttgaagagattaggggacttggaagtactgcttggttccaattctggctgtcactaagtactatctacatgatatttggaaaataacctcttgaaccttgcttttctaattagaaaaatgagaatgcatctgttttgcagagttgttgaataattgggttattttgaaaataggcacgtttgttactagaagctgttatggacagtggtagtatacaagtttaatagggcatgctattaacttactagatgtggaatctagagcttacaaacaaggtttttttttgttctgttattttttttgtttttgttttgcatggggcgtattgatgttgaaagaacagattctgagtagtgaatactttttttggtttttaacttaaataatatcttgggttcaaagttgttaatttagttttcccaacagtttagtctgtcctcgtgctctgacagtgagtatcttctctcctcattacatagaccagattttgatccagaggagaaaaagtagagataattgatgaatagacaagaggatatgccattggtttttatcctcctgtctggatgaataacatgttaatatgtaattatgtatatatcgtttgtaatttacaaagtagtttcatttacattatcttgttacttgtggacttggtaatacctaggtgaataggaaggtttttttgctcttgattagatttttttctttgtgactctgggagcaaataggtgagtagttgatatcatttggagatacgtactttcagttttatgaatgcttatgaatattatagccagacttcccagagtaaatactacttattgttgaatactagcaaggatgtccacattgcttagcatcttactgatgtataatttctcttcattcctagatgcctctttccatcttcctaaattatatagtatttgaaaaagcaatggaacaagaaggaggtgaattgtgacccagttaaactaatgtccgttgcaatacctgaattgagaaagggcagtatatggcccaagatactgagtacaggattgcgaatatctttctggctttgtttctacccttgttcaaccaattggtttcattaataatattttacgtgcatgttatggaaattatagaattcttacttctgaagtttttttttttattgggttggtcagattatttgggaagagcttgatcataatgaggcttaagtaatgagaaccattatgttaggatctcttttatttaggtagaaggctacattacaactacagattataacatctgtcattgttcaactattgaaaacagcatttggaaggatgagggataataaggatgtgctgagtggaaaaaatatttgtatcatttactgtacaaaaatttattatagattgttttggataaaaacctgcaaaattctcaagataattagcttttaataatttccccagtcccactgcactttgtatacacaaatgtttagtaaaaatagtcaagtacattttttaacaaaaactaagtgatagtatcttatatgattcattattttctgatactaaaatgccagtttagaagctggcataaaatttaactctataatatgtgtatatatattttttctatttctcccctgaaatctgtattttatatctgtcttttatagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacaggtaattgttcaaactgactaagataggttttagcttctaattagcctttaataattgtcagcttaattgctttcaattttgactgtgtaatcgaatgtttaaatttaaacaattaaaattatttgttttacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgtgtaagaactttggttcgttatgcttgattccgcactttttcaactcataacacccagagtacaagaattttaaactgatatctagtggtttaacatgggagagatgggggggaggaaggactagaaatagcaatgtgtattagtctttcaaaataatatttccttggaaactgttagcagtggtaagagttaaccacaggtatgaccttttcgggtgttgcattaaatcatgtaaatttgatcatcatagagtcaaataggaacacaaagtattatagataatctttttccttgctattcattaggtaaatggtggattttgtttgtgttattaaatttatggctgttatttgtaatgtcatatgctttttatttgctataatggtactatagcccaaactataccaactattttcacccagggtgtacaaactgcagtcattttgaaacttggccttaagaacatccttactttttcctactcttctcttcctttcattaaagtaataaaagacataacttaatttaaaaatactaaagaactgaaccttattcttgacctttacagactactattttctaactggcaggccctagcatgtttttcattattgatgtaaaacacatattgaaggagaatggaaacagactgtgtcaaagtttaacacccaattattttatttacataattttattaggggatagtgttgttgacttgaaaaatatctcttctgttgtaagattcagcagggtctttatctttttaaaagtatcacattttttgttttctttattttgcagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttgtaagtgaaaaaattatctttgattgtttggtaggagtttatcttagagtactgtacataaggaaggtcatatacatgatttagagattgttatgtgtgtcattattcctaaagtcagagatagtattgaaacatgaagtggtgtttgaagtgctgtcttcatttagaaatgccattttgaggt

SEQ ID NO: 123007 - DNA, 1126 bp, Homo sapiens
tctaattatagcattggataccatgtagtgtttagaaaagttaaactactggtgcccaagttttttttttcttgtagttctaataaatctttcttgaagtaatccctccaattctttatcttttattctttttaaatcttcttaacagaaagcttcagggtgaactaggcattgtcacataagtccactttattctggagtcatgagtactgagagcagagccatggctccagctgtttagaaacttagtgtcctgtattgttctaggatactatctagtaccactccagacaggattgtgtatatggagtggtcagttcagtctcattttcaaggccataaagcactatgataacagcctggtaggtttattttttgttagtattgtgacactttattttatttcagttgccttatctgtagtacctttattatttatctttcttacaggaggggtaggcatttgtattgggcgtggaataacacataacatgctgctgcagtctcattgctttttctggcttctgcagctgctgccttttaggattgaggctcataagtggggcagtccgtaaaaatcttcagttgtgtctttaatcgacagtacctgtcatgcaggtgaaaacagttttagtcagggataattgacttgtcttctgaatactgatttgaaaaggatggtgaataatagcctttgagaaacttgtaaaaatcaaattttatctgaaaataagtaataatgtaaaattttaaatatcatattgtaattttaacctttttttgccctatcatttgattaggagaaaagaaatgggtcgctccaattctagatcacattcttcaaggtcaaagtctagatcacagtctagttctcgatcaagatcaagatctcattctagaaagaagcgatacaggtgatttaatgtgctttaaatttttaaaataattatatcagttaatacttgttgaatgagtatcgtaaacacagtgctaaaccccaaaatgtattttattctcaaagaaccctgtgaaatggatctattgttatccttattgtaagcgagaaaatgagaatgtccaggtaacaagctctagtaaatggcagagcttggattgaaatccagtt

SEQ ID NO: 123008 - DNA, 1207 bp, Homo sapiens
cacagtgcattgcagtgtcaaactcctgggctcaagtgatccttctgcatcagcctcccaagtagctgggactacaggcttgtgctaccttgccccgctaccaagatggcattatgttagctacgttggaattttctgatggaacgacatatcatatgttttttaaggctcaaattactaaaattagaattcaagtagttaaaaagatgctgtcagtttcatgatacgctactgcattgtggtttacaaaaaagttgaattttaagcttttacggttaaaagtttcctatttcctgaattagtttttccttccctgaaattgtaagtgcgtttattagagtttatggcagtgcccattatatgcattgtaaataatggttatttaatttaacataaatcacaataatggtttttttgtctttgctaggaattcgaatttagagtttaatttctcagagcattctctccaggaagaatttttacagtatctcaaagacttcacttgacttcttgatcctgcataaaaccaaggtaaaagagcattcatttttctagttttcacttttgacttttttgaggaaatgtcactactgaattgatgattcagatggagtgattaaaaatgatgtggtccgaagctttgttttttgtttattttggtggcttgtatgaagtaagtcagatgttaagttagttttaggaaaaaggttctttttctgtcttcttccaggttgtgctcctgctttttctatttctataaacacatctactaaaagactcaggacatacaagatagaaagactgctacttaacccatttccctaatgtaaacaagaggagattcataacttgtttctctctactgtagtgtttaggtaattcaaattgattgctaatgtgttagatgtattaagtgaattaagttcatcaactcattaagtccactacaagtctgtgaagtaggtactgttattttcttcgttttacagttgaggaacaggctcagagagcttaaggaatttgaattcatgtagtttaaatgcagagaccatgttcttagctttttccctgtttttgcagtagagcagaagatatcaatccatttcttttggactgctaactatttgataggcatgctttctttccgttagtttttgaagtttcaggtgtagcttaaagcaaaacgcaaacctttaaaaatgaactt

SEQ ID NO: 123009 - DNA, 2121 bp, Homo sapiens
acccgcagcaaagtgcgttgagtaggtctaccccttttcgcgtggtctttaaaactgccctccggcttcagaccacccgtcagttaatgcctcgtttttgtgatgctactaggttttagtgctctgttctgcctctcgctgctgaccctggttctctggagttaatttcggtacccgcggcaacctgctgttttgaagcgagcgcgcgctgttgactggtgctggttgcctagttacggttccctagcgagaggattgggtcttagctggtggttctgagcgtggccctgccccatccggctgaaagtgcggttcttcatgagtactagcgaagccgagtcttttcaagtgattcagcccatttagtcgtgtcagaaatgttgcagccacgattggtggacagctggtgtgagaaatgggtgggagtggcgaattggactttgccttcattttaaattcatgagttggcttgattcgcttttaagatttatttcttcagaatcaagctgaagtaccagcagctactttgctacctcagacttttttaaaaagcattttagaactggaaacaaattaagactgaagttgaaagcaagtgtggctaacactgacgaaaaagatgagctacttcagacttgtacctcactgcaacagcctcttttaaattttttggtgttacaaagcaaaacaaaatttcttgttcctcttgtgaattctcatttcagttcgactttagttggaatggttaggatactgttcaggcagtaaataacctttacgtaggaaaaactgctacaaggcttttgtatttttgtttgatcatgaccaattcaggataggtaatttgatgggagggaaaaagtggcccctcggcgggagtttgaggctgctgtgagctgtgctcgtcccactgcactccagcgggggcaacagagcgagaccttgtcacttaaaaaaggtagctcatggtaaacaaccttggagcaccttctcttagtgatttcatgtttcaaccagtacattgtggtgaatactgaaatatcttgtttaattcagataattaaaatggtggcaaaggaagctgtttagccagagcccttcttgactttgaggaacagtggtagtataagacttgaagacagacgtgtaaaaagtactactcactggtaggctcaggtctggttgattgactgattcttgagacggaatgtcgctctgtcgcctaggcaggagtgcagtggcccagtctcggctcactgcagcctccgtctccgggtccaagcgattctcctgcctcagcctcccgagtagctgggactacaggcgcccgccaccacaccgggctaatttttgtatttttagtagagacggagtttcacaatattggtctcgaactcctgacctcaggtgatccactcgcctggcccacccaaagtgctgggattacagggatgagcccctgcgcctggcctcggttgaatttattaaacaacttttgtgggcagcaagctgtacgaggttaactatgtgatgagaagacttagaaatggagaaaagttttatcagttctacataggacttagtttgggagtttctggaaactacgttggaaatcagtagttgcacactagctgaattcagctgtgtaatttacagtgatttgttatttaccaaataagtagaagagggaattaagaagctaaaatctctgggtacttgtttgatatgaatttgttaattgtttatactcaggtaataagtgttacctcagtcatagcatttaatattttatctgactgtccctaaggctgaaaaccaacgaatatactaacacgaagataatactagattatatttgtgtaatattttagagttttcaaacactttaattttatttatttatttttttgagacagagactcgctctgtagcccgggctggagtgcagtggcgccatctcggctcactgcaacctccgcttccctggttcaagcgattctcgtatctcagcctcccaagtagctgggactacaggcgccggcccgccaccatgtcctgctaattttttttttttttcttgagacacagtcttgctctgtcgccaaggctggtgtgcagtgg

SEQ ID NO: 123010 - DNA, 2886 bp, Homo sapiens
cctttaatttctttcagcactatcttctagttttcagtatgcagatctttagcctcctttgttaagttcattcctaagtactttattcctttggatgctataggaaatagagttgtttttcaaatttccttttctattttacttaatttgaattaatttagatttaaattcaaataggcaaatgtggttagtggctaaatttagaacatcttcatcatatcagaaagttctattaaacagcactgcgttaaagtatctgtcagtgaatcgtctctgttggaggatatttatactgtattctaaacctaccttaattataaaattaaagtccttttcctgctgatatgttgcccagaccattgacttgctgagtatgtgttccccctcagcattgtggaaactattaataggaaagatgattgtatagatggtgggctattaactcagatcaggatgagaattgggagtgcctttacatgtgtggtacccaaatgggtggttggatataagagtaacaaaaggactgaaaggtttaaaaaagaaagaaaaaaaaaaactccctggttgggagggtgttaagtatcgagtgtttttccaaaccattcctcctctgctcacctacccctaggtgattaaaggagataacttttaaaaaagaaagaattggctcaaaggtactgtaattctaggattatatacctttatataggttcattccctgatccctgtattatcaaggcacagataataataatccccaaccacccccacgccacatcaaaaattgtccctcttgagtctttttcccatttacatcacccattgatctgatttcagccaaatcaaaatgttttgagaaaaagaaaaaaaaagaagggctacttgaggtacttaaccccagtctcccctgggaaaagacctgggcatgccaccctgtacaccagccaggagtgccccatatggtggctgcagcttttgatacccaaagcccacagcagctctgtgaggccccacctcctacttttggggacctaaaatgggagaaatggtggttgagcagctggaaatgatgcagagctggcacacaccttgtgaagctcttctctgcctctttcttcattttttctgtttagaaatcccagggagacaatgagcattatttgacacttaaatgtttttgctcctctgataacccagaccatcaactaggatgctgctaaggaaaatggagggaagcaattaaaagggacactgaggggaacaaaagggaaaggaaggaaaagaggagtcgatgcttgagccaggcagaaaaggagagaagaaaaggtacagtactagttcatgtgacctggggctagataatactctgccccttcccatgtacgcttgcagtctgccctcctgacaggtgttcacataggtgcctccagcacgtgcccctcccacctgagggcattgtcaggtttcagatacttggaatgggtctgttttgctctgtacaatttttgtttgtttgttttggtcttcattgactttagagtagtggaacacttctctgggcttccctttgcccattttgacttaggaaagtgtcatctctcaagctgaattcctagttggcaatcagggaggggtgatgttttggcccaccttcagatttcagtttattcctggtaaggaagagcaaaaaaataaatagctgaaattcctcactttaaacctgacttttcttcaaaatcacctattgtatcagttatctattgctgcaagaggacagtaggtgaagaaggacttgattccattatacaacatcaatataaaagaaaaaaatgagtttatgtctaatatagcaggcatataatttttttaaagactgagatatagtgtgtttggggggaaaatgttgaagaattaaaaagaaaaagatgtgttttaattaaaattttttaaaaaatgaaagtaacatttgacatttgtgggggataaaccagaatgggacgttttgcttcaggtaattaattttagacacaaagtataggtgctttctaaaagtatgtacacacatatgctttttgacaaatatgactccaacacatccggaatcaccttattagtgtcacattgtgttaattcagttatactgttcagtgttaagctaacaagggccttttgttgagatggaatgggtatatgtgacatagctaagaaaatttcttaaaagtcattcaatggtttctagctccactgttgagtattgtgagtgtgtttgcctcgcttgtggaaaaatctaactattgagtttctctgaacttagagctataaaaaagaaagagagagagaaaatgtactcttcctcacatctggcacccgaagggctgtatctccatctaatcccaaagcaagacaaccagctcgctcccgactttggtaagtgaaatataagtggctggctgggttgtttcatgttagagaattagtagctctctcctctgaaagtgaactgttcttctcatgctgtttggctttgacttagggaatagcattcttcccaaaaggaaagaaaaaagagaaattggaatggttccctaaagcaactctatttctgtatctaccacataaaaaacaaatacacggagctaaatatctgcattctcttccatcgagtcgtgttctaggttctggcaagcctgttctcatgtgtccccttttgtctgccttgtttgtttgtggcccaggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcct

SEQ ID NO: 123011 - DNA, 1013 bp, Homo sapiens
cttgtgtttatttggtgtcagttgaaagatataaaccttgttctgtggtctttagacattgtactttagtcttaaaggactcaccagtgaactagaagatctcattgcctctctccaggataacagtatgacccttttgatgaaaggctgaaacagtttcttaaaatcgtaacttcccagagcaattcagatttataaacctgatggacacttaaaaggattttgcttaaaggataattcagggttgtgagagcttgatggctttgcctacagcctgtttttctttcaagctccatcggcctttctggaatcagtgtttgattcatgattgagtcaggcctccaaccctctaagccacaggtgaaacaatctttgatgtctggaaagttttaatttattagagtgttggtgtttcagagatcctccttagctgtagacagaaagccgtagttaaacagaacaggttggccccaaagttgggtactcactgggcaggggaaaagagcatttaccatggaaaaactatcttgttctgggtaaaaacaaaaattaacactccttgagagaaggttgagggccacctgtggctgacaggttaaatgagagatttgtcatcacatgatccagagccttgttttgttttgtttttattaccttcctctttctctatttaatcacatagctgtctttttacctctttacaaccaagtatttaggcaaatactaacagaaaacgactcagagtcatttataccctggagctgcactgtggaattcagtagtgactggccacagtgagcacttggaaagtggctactgaaactgacaagctaaattttaagtttttaaaaaatatttagttgtgttaaaaaaaaaaaaaagcatgtaacgtaaaatttaccattttaatcattctaaagttcagcagtgttaagtatattcatattgaagtgcaaccaatgtccagaactttttaagtcctgcaaaactcaaactctatacccattaaacaa

SEQ ID NO: 123012 - DNA, 1901 bp, Homo sapiens
tgccaggcatttaatgaaagagtgcattaataaagatgcaatctgattgactttctgtctgtaaattaaacccaaatagcaaatcttttttcaactctataatcctgaagttaagatcaccccaagtttgtcttgtgaacttttgagttaagttattaatcctcttacattcagctggcatagtggtttctttaaagggttgctacaaagactacagttgagaagtccttttataaccatgtccaaatacatagtattctctatacttgtgtttaattgtcttatttttgctaggaaataaaatttctgaatgagatctgaaaatggaccttagaacctgaatactcacacttttgatacctatgcagtgttatatgaatttccttaaacccactgttgtttgcaataagttgattcatgacagtgttccttggaaggtaatggtcagaagctatgtagtttttcataaaatattccatcttgagtaaaactgtaaaggttcttcacggttcaaccttacatttggcagatctaacatatttctgttctattcaacattttaaatagatatagctaatctccccatatgctctaatgctgcttcttatgaactatcaaatgccttggcttttgggaaaacccggaagcatgcatttggtttgcctataaataaataagacatgtacagaatattttcctggaaaagtattacttatcctcgtgacaagtcttaacacctggtaagacttgttcacttaacattttttaagtttggttgcttttttcccctgctggctgttgaatttgaatcctgaaacagttgtagtatatcttgcttgcctgcttgcacgcttcctctctttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgctttgctccttttcctgaacctgcttttggctttcttcaactgctcctctggcactcttgtgtgtaaaaccaatcacctgcaccctagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcggtgagtagctgttgggagcagctgggcaagtctgggagccagtgctgttcctgtgcagactgtacatgaccctgagctgtggtgtgggcgtaagagggggagaccgtgacatccaccatcccatctttcccattgatcatgaatctggctagctgggcagtagtgtcccctcacttcctcttcacttggggattttgctctccctaaacatttgaatttgaagatgaaagctgttctttgttcaagcatgtatgagtggacgccctaccctcctggagcgtccatacacataagtacaatgccagaatactttcatttttgaaagtaggaaaaccaaatggcctttgaaggggaagtgggcttggactgctgccttggcattttatttcaaccatatccagaagctggctgaactctaaatgtggttcactcaaaagcaagataaagaatttttatcctgc

SEQ ID NO: 123013 - DNA, 1073 bp, Homo sapiens
ttagttatactttattatctcattagaaagcattcttaccagattgttaaattagaggaccttatagacaaatgggtcaagcaggtatatacatcattattagattgtttgagctttctcagtcctaaggcataggccttaaagctgagattaaattgaggctccgataccatcagggctcatgttctgctgtaatatatccaaagagctctactagttattaaaaatactgaaatatttccatatcacttttccaagatgtgcttccccgggccctccaaagccaagggaagccagtcattagtgtagtgtctgtgccttgtcagtttttaaatattttaattattacacctgaatatggtgttacatggactgataagattactttggttaaaagaaacctctgattatgaaaggtttctgtaattgctggaacagaatgttgccactggaaatttttacattaaaagtatatattattatctttaagctatctgcttaaccaactttttctcaagaaagaatattaggaagttggaaaagagtaagaaaaattgcctactttttgcttaaaatccatcaatacattttttccccagaatcttcatcataggactcagaggtagacctcgaaataaattctgctcacaggcttgttctgttttacctgagcagtgttgtttgttcttgttttaattagaattaattgccaacacttaaaatatagaatacttcatgtaacatttcagttttctacttctaaagaaaaaatcaggacctggcaacatgtgtctaatttcttcctggcacctattacctgaaatggaatagtgatgtcacgcttatgggaggaagtggtaaggcaggtatccataaagtttgtttagccccgatcatttatttatgttaacttgcatggcccccagaggcctttgagtttgcctctcttcatctgggtggcctataatggaaattgtcaatatctcaattttaagtgcttaaataggatcgatgccatagcgttgttccatgagagttaatatctctcccttcggtttggtaatcttaaaatc

SEQ ID NO: 123014 - DNA, 1176 bp, Homo sapiens
tgttccttcttttggagatttcaaaggcattcgcttttatggtcctcttttgcttcatagtgtgcctccactattttagaagcccttcactggccttccttttgtcttcatccacttgtatccttgaatttccatggctgacaagctggtgaaataaatatttattttatcctttaagagaaatgaattttatttctaagcctttaagttacctttaaaatgtccacttagaaaactgtgttattatgacagatctagaaatagagcagaaagcatccaatcctagtttttccttccatcagtgaactaggaaattgcaatcctacatgttggctgtcaattagcattatctccatttgttttagatccagacaggcggtcagtttccaccatgaatctttcgaaatatgttgatcccgtcattagcaagcggctctcctcttcatctgcaactttactaaattctccagatagaggtacagtccaaaggaaaacaaaaaagtgtctgttatttacttaatgcttttttttctggatgtttacagataaaaataagcatctgaagttgctttccctacgtttcttaaataggaagaaaaaaacttcagagtaaaaaagcaataaacggctgagcagcattttccttgcgacaagaacatttctcattttagaacttggctgagtgattgcatttagcagtgacgaaagcggtgcttctctcaactttttagtaaatgagtttacagctccagaaatcacccacttatccaccaaaatgcaaataatctttgttatgaacatttcttttacttcaatcatactgtctttggcttttcatctatctgtactttgggaattccaggctctgactttctttaaaaactttttaaatgattcagattggtagattttattttgccaatttacttctcatttaaccaaattatttcttactgcatttcttatgtgtgctgttggttttttggtgtccattcattaactcttgagggatctggcctaacttcaagaaatcatcataattacagcctcctgaaacatttaatattcatagtcctttattaacatcttgtttgaattttgagttttattcatcccatggatttacagtacatgaatgttgagttatttataaagcaaaagttttgttttacatag

SEQ ID NO: 123015 - DNA, 1030 bp, Homo sapiens
tacaaaaactagccggctatggtggcacatgcctgtaatcccagctattcaggaggttgaggcaggagaattgcttgagcccaggagatggaggttgcagtgagctgagattgtgccactgcactccagcctggctggcagaatgagactctgtctcaaaaataaaacaaaaacttgatacattaaaaacttattcttttgtgtgttttgttcggtgagaaaaagaaatgaataacaactgtcttatatattaagtaataaacaaattcatggtgtgcctccataattttaacaatttatggcagatttagatgctttactactaatgatactttttaggatacaaggatccactgtaactcattttttccacttactctgaagcagaattaaatgtttttaataacctgttgagaatctgcctgaggataggcctgcgtgtggacacaattttcccccaactaaagcataacatataaagcaatatcagaaaatgtactgctataaaatcacctggaaatgactttcgtattcctcttcctaccctgtacctcacatgtcatcactaggatgttccttttgatgtttgaccctaaatcctttctttatgtttggattgccctaagagtccatcagctaagtataaatttgaggcacagaagtggttttttttttaataataaaattgcttcagccattaaaatgaatcccagctgaagatagaaatgactgatgttaatcaaagacttgcttattaccagtgtgctataaatagtagtcaaaaatacacagggaaaagtttgcagcaattttttcttactgccaaggttagaccaacgggtactgagttttggaagcatctcccacaaggagtatttttgttttagttttagaagcaggtaacaacagaaaaataaaacaaaatacagcaaaaacccctttcactttggctactgtagatcagaacatccacctgcctcctggataaattaggaataagactttttagactttcattacatgcagtgtt

SEQ ID NO: 123016 - DNA, 1260 bp, Homo sapiens
ttattttcctgaaagtaacagggtgtttccttctttcttctaaatctatgtttgcgaaacaaaaatcctgctgaaataattaaacaacaatgaaatgaatctttcactatttgaggataagagggtgatggagataagaagtaagggcctctttcccttaacacaggccaattttctcatgttacaaaattccttaaagggagaaatctatgtagtgtttctaaataaacatgctagcttcaacactacattattttagtcttctatttgcattagggtttcaggattatggaataagttaactagttttatctttttctctggaaggattatagttatattgactgaccagaatcaatactatgagcttatgtattctgaccctaaagtatatgcaacactaatgctctgtaagaaaatatataggtttattgagctagaaatagtaaatgactaagctatttcctcctttctgaatggacataaaatcatattgaaatttggatttactgaaaggctttatttttgtactgtaaattcaatacccctggaattttacatagtgtgtcagtttttatttttttatttgtgtgaatctgataaccttttttttttaaatttgctttgaaaaatcattgttttacattctgtctccaggtggttttgttgaatcatcattctcctctctggatttagcaggcctggaccaccacttcataacttttggtggtactagaaaagctggtacagacatccctgtgattgccaattgcctgacctgtagctagcacctcagacctagggccgatgcatcaatagctgaagcatcaccaccttagtcatcaacgcatgcctaataccctagcgcatagacgtagatctgggattggaacagtgtttcttaagtgtgataatatgactcaggtgacttaaaggtgttgaaataaagtaattacatgtggaatgtttgctttccctttaaacaatcattttggttttctatttatgttttttatttcttttttcaatgtcaggattaaacctttaaaaaatgttttttagctaaaaaaattacctgggatcaaagtacttccagtttagcttttttccccgtcaatcattactgctgttgccacttttagttttaagctaaataactgtggacctctttttgtttgcttattctgttctctttcattgttaacattctatagatctcttataactgctttattaaaattaaaaatctaggatcaggtg

SEQ ID NO: 123017 - DNA, 1037 bp, Homo sapiens
acctgatcaactgtctatgaactgtgctttatagaagctataacagcagtggaaattttttttaaaagaaaaaaagtttaaaagcagacacttaatattaaggaaatctttggactgtgcttaatttgaaaacaaaaaaaaaatagttggtaatgtcaactcttaccaactttcaaactttaaagttttcaagttaaaaaaaatcggacaccattccacaaatgctggcaaagtaaagtttaaaatgaatagccagggagactggttatttactgttggatgtaggttgaaaataacattgaaatcattaaagattgttttaatccacgtattttaaaaagcaaggtagagagagggagaataaaggtctgattattttgttcttggtgttatggcatatttgtactattttgcaaacaggaaggacttattaataactttctgtgggttaaatctctgagtcatgctttgatgcttttatagtaggattatgtcatgtggcctgctttttctgcattatccttcagtttttcacaaaatcaggcataattcttcatgtatgagattattctgtcgttgggcacttgtactctgaaagctttatttttcttccttaaacgctttatacgtagaaaagtctctaaccaccctattccatctgattctatcccctcaaactctctctcttgacttctgcatgtttttcactctctctcttctaagcttttattttttgttttccaagggtggggtggagaatctcatttgttctcacaggttcactctcctttttaaatattgattccacatttccagctactcggaaggcagtagatgcctgcctgtttcccgaaactctacttctgtacaactaaattgttcattttctttcactccaaaactgactcatcctggtaatttctgtgtcccaattaattgcaccaaatgtttgggtttttttggccccaagacattatttatttccgtcatttttgatgcttctgctagagaccctaggttctttctgactagtagct

SEQ ID NO: 123018 - DNA, 1071 bp, Homo sapiens
atgtcattccatacactttctcagtgactccatgtctgttctcagcagtgaagggagaacagaggccactctgcctgactgattttaaatgatcgcctttttcagatgcttttagtatggaaacaaaatcagccataaccttcagggttttaaatgtcactgttaatgcatcaggaagcccaaagacagacagtctggagaaatagtatgtaatgtttagatgattttggtaaacagctaagtttttaatgtatgtttaatgtgcattctgtttggggcctctgagtttgaatccctgagaccgagctgatgtttagcaaccatttcttaaccaggaaaagcctcccctactcccagcccatagccatttgagcttcactggcttttttgaacagaagcatttcccagtttttgcttggttcagtgaacacggttactgtttaaaaacagtggctgtcgagttgtatgtctcaccaccctttgctctcctcttgagctacctcaagctgtgtgagagataatagttagcatgattaaacggccccttcactgatatttggtctttgcctggctgagggacacaaagcaagaagagggagacatgcagatatgttgcaggatattcaagaaagaaggattttagcatggaagacactaaactgtactgtaagttcttgggctcaaaatgtgttttgaaaaccttaataaggacgttcaagaatcaggcaatctttaaatccattttgacaaattaatacttataacaagtggaagtacagagtaggaaatcttctaatctttttttttttaatcattgttttaatgtccttagaaaaaggagtgggaatttaattaaataaaatgatatttattatataaactatggatttatacttctaccttcatgtcctagagccgtttgatagtttccatgaaaattaaaggcaaaccatcatcattctctattttccatacttctttctttttttgacaaaaacaaagtgagaagctgaacagtagcaaactagacaaacatacacaattatgctgctgtccaaaaaaaatttcagt

SEQ ID NO: 123019 - DNA, 1127 bp, Homo sapiens
catttttgaaacattcttctgcaatggttaagatgggtatccacttatttaggatttcttcattaaggattcaaacatacttttccacctctccccaccacttgtcaatgtcatgggcaaagaaatggtggtttattttatgtttttgatttttcaatcctgccccttccataggtggtttatgttttagtttgcatttatttgattactggtgatgttacatattttgtatacttgttagcactttcctttcttttgtcaattacatatttcttctgacatttttattgggatgtttaaccttttataaataaagtttacttaccttttgtcaaatgtgttatagatacttttccattttaacatttgccattttgtttatttaaatttttgttgttttgagaatgatgatttcagatatcttcctattacagagagttgattttgggatagccttaggtggttcaatcagatccgcaccaaaatggtttcaaatacccaagtgacctgtaaactgtaaattcacaagacccaatgaaccctaaggtctgagctctggggcataaccacagcctcaaagctagggcaggattaagccagctcagatgcactcagcctgcagaatctaactaggtcagtctgctgtggctctctgagattgtggggctatttttgtcagtgtctcttctgcctatgaaaattagaattgaggaaagctacagatgcttcccatatggttgctattagtgaaattatatacagagaatttaatttgaaaacagttgatacactcacattatttagagacttaaagggctgtgaaagatactctagctatcacacctgcaactctcctgtttgcagggagccttcatcttacatgtggtagccttctgtcctgttcttgcttttgccagggaaggagccttcattctggtgttcatgattttgccgggcacataatgtagatcttcattaaggattcaaacataattttttcacctttctttcccctccccacatcacttttatttaaatatatagctcctagattttggcattgactttagtgaactcagcagatagctgctctagttcttcctgtatctaggatttagagaattttc

SEQ ID NO: 123020 - DNA, 1143 bp, Homo sapiens
ctggaggagacactattattttttcttttataaacaaaagtagaattttgtgtgataagttttttcttggagcatattgtcttcataaaataaacatggaaaacatattgttttcttctcctacagttgatacccaaaaaaagctttgtgaaataatgccaagatagtgtcactactaccataaaactttaaaaagtgaataaaaatgtgagagaagttaacacttagcatatggtttttcccaaaactggaaaagcttgtacaagaatattatctagaaactacttaaaactttaaaaagtgactttgaaaagaaaatcgtcatagaaatttgccttttgtaagatgttacaattagctaaatatgaacataatgtgaaagtaaataaagcataagccgccctttcgcaataatactgtccttttgaaattttttgagaggcccttttcccagaataagtatgactcttaacagaggactttccgctctgtatattagcgtatgaagtgcgtgtccatgttaatggtccaacttcaagcatcttttgtgccatcattaacaactggaacacagaaaattgtgaacagaaatcgcctctagacatctctcagttgttaactgcctaaatattgtgaatgtaacatgcatttttctgatgagaaaagaaatacaatttttttttttttcctggagatcaagtcatgctctgtctcccaggtgggagctcagtcgcacgctcatagctcattgcagcctcgaactcctgggcttaagcaatcctccctgctcagcctcttgaatatctgggactacaagcacacaccaccatgcctggctaattttttttttctttaaatttttgcagaaacgggatctcgctatgttacccaggattcctggcctcaagcagtccttccaccttggtctcccaaagtgctgggattacaggtgtgagccactgcacctggccatatttatttagaaagtaaaaaaatttaaattgtttctaaatcatctataatccctaccatctctgtataactatgtcaacattttggtatttattattctggtctttataaactctatcgtatgtgtgtgtttacaaatctggcatatcattacatatatgattttacaac

SEQ ID NO: 123021 - DNA, 1024 bp, Homo sapiens
atttttttaacagtgaatttttctgcacaagtatttctatcttgcctagtcagagatttctccccagaaaaccatatatcttaccccaaggacaatataagtaaaatatgtttgctaaaataactgagcacatcagtgtaagtttttacaataaataaaagactcaatgttacaactgccaccaaatctgttactaaatctgtcagaattctaatttagctactgcatatcacaccctatgaatgcagcctttcttgtagcaaatcttcacatttcccatttctgtttcctaagtaacagtctatttctaggtaggctgcaagactgaaggcacacaactcagcacgcttggttctactaattcgttgcaatgatactgattgcctgttacactaagataggctatttccagttatcttccatgtcatagatttcagcctctaaaaaagaaaagtggttttatatggtacaaataaaaatggtaaggtattaagaactctaaaggttgtaattacttataacctgagaggtcggtaggttgtgccttccccattttacagacatgaaacctgaagctcaaagcttaaataatagtctcccattacagctggatttcaacttacgttgccttgctatagagtactatagggtgttagagtctaatgccattcttagacttatggggagataaaactgcagatgggaagcctttatcacatatgtctgagagttttgaaaaataattgaatcccaatgagaacgatacaatgctctcggtatgggtttttcaacatgtttcataggaattactttgcaaaactttgagataatcattgtagaattatgacttctaaggggagggtttaactgacagatggtctcttagtctcccttcttcaaaagttgaaaatagaagccaggtgtggcaagtgcgctcctgtagccccacctgatccagtgtctgagacaggatcccttgagcccaggaagtccaggctgtagtgaacaatgttcaagccattgc

SEQ ID NO: 123022 - DNA, 2497 bp, Homo sapiens
ctttctcctcccatcctgctgcgctgccgctgagaggaagagggagctgcccagcggcctcacgctgtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacaggttgtgcagtggtgggaggcatcagaccctgcgtgtctgtagtagggcttttctggaaggagtgtgtgtgtgtgtgtgtgtgtgcgcgcgcgtgtacgtgcatgcatgagccggagcaatcaccagcgcatgtgcctgtcggggagtcagtgggagggggctggtaggggaggtggggaagctgctgctaggtgaggggaactgcagggcctcagttgccaagtggctggtactatctgtcagctgtttgcaaactgtttacccataggggatctattacaagtgctcaaatgaacaggcagcttaggaactagcagcttcctgggagctgcaattacataagcatatatttttaatataatcacaattaaaaaaaaaaaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaaggtatgcattagctccaccctttggtcggagccagatccagcccttgtctcccacactgcctatagaacgttttataaactgtgctgctcgtgcatgctccagggagtgcttgtgacctcctagcacggtttgctggtagtgtttataccctctgtagggttgtgtatgcatgaaatgggaaacagtttttgtagattcggtgtatttcagatcagttgccttttttgacttaagctactttcttggcctagagatgtttaatttttcccatgctcacttcagcagtgaccagtcactctgtcctcatcaagaggaggaaatactgagttatcaaggtttaaacgaacatctccccaccttccttaggtgcctcagataatttttgcttattttaatgaagtgagtttctgctttaaaggatgagttaaagtgactcaagagtgcaaccttttctaggcagagggtcaaaatgtcacttccctttctatactaaaatgtcaagagtaaagaggagcacagcaaacattgagggcgaatgtggagggtgaagctagggagcagggaggagatcatgaggttgtataactgttgatgataactgaattcgtgtatggcagttgaaatgcacaggttacagaaaagggaagtctgacccttgtgttgttctttcacagtatgaaaggtagcagcagcttaccagcttcttgagagcctgtgtactgcatcattgtcagcattgtctcacagctgccctcccagggctgtaattatcagccagagacagcaacatcagacatttttgaaaaaggagctttaaggcctgtgttttacattttccagcatcctaagtcttgcttccccttccccaaaatatataagctgttcttaaacagatgggttatgagttttcttgcttttatgtgctgattaatttttagcttgctcttaaattattctgtcactgaggtatcaaattttcttctgtgatgcagagaggtagcatgacaaagtagaaagcaaatatttaagcaatgataaagtgaagagtgttaaatagaatccagtgtctgaggactcgttttctttttcctgtttctcgaattaatcttactttgcttttcttaaatataattgaaactgtctacattaaatccaaaagcatattacttcatttttatgagacagtacacagggaagttctaataagtagaatcttactactgtagttgatttttatttactatcagacctggctcctgtctgagaaccaaatgacctcagaaatcaaatgatgctatgactggagggtgacttaatgtgattcttttatttgcctgtgaattacatcattgaaccagagtgtgttgctctggatgaaaactcaggactttaaatttttagcagcaaatcattttgcctctgaaaagttggtaacttttaaaattaatgtagatttgttgaattgttctcatggggtatttttggaaacattcttgatttgtggtacttttccttggatgtcttggacagtaacttaggatagccatccattttattcttaataattttcttttcttttcttttttttgagatggagtcttgctctgttgcccaggctggagtgcagtggcacaatctcagctcactgcaacctct

SEQ ID NO: 123023 - DNA, 1004 bp, Homo sapiens
ttcacctctcttgtttctcctcaccgcatgctgctgtgcccaaggcccagctggtaacctctgcggtttttaatgtgcatttttttctcagcaggattattcaacttgtgctttgattatcacctcaaattgtcatctctggctctacacactgaaatgtctacaggcacttctggttttgtttttgagacagggtctcgctctgtcgcccaagctgggatgcagtggcacaatcctgacttactacagccttgacctcttggtctcaagctattctcctacctcagcctaccgagtacctgagactacgggtgcatgccatcagcctggctaattttgtttattttttgtagagatgagatttctctatgttgcccaggcgggtttcaaactcctggacacaagcaatcctcctgcctcagcctctgaaagtgctggaattataggcatgagccaccacacccagcttacaggcacttctgagttgcattcgtgcctgctcctgaggttttgtggtgccatcttttgtgatttgaagctttttctgggagggcttacctttggcagcatgatttcctatccttttctcctctttgcagctagcatatgtctaactatgaagtccaaggcaaaaatgaagaggtcagtagtggatattggatgggactgattcctaaataagagtatctttgatttctctttaagattatatggaaactgagcatgtgtgaggctgtgaggtctgaagctcaaaactaacactaattgtttaggggtaattctaacctactattttgtgcaaggtctctggagtctggctgcctgggttccaatctcagctccaccacttggtacctgtgggatcttgggcatgtcatgtaagcattctcttcctcagtgtcttcctttttaaaatagggtattggtaatatcgtcacagggattaaattagttgatactaaagttcttagaacagtgcttgacacagcataggcaccaagtgt

SEQ ID NO: 123024 - DNA, 1024 bp, Homo sapiens
agtttgtgctcaaaaataaactttctagaatctgcacgtgaacaacttgttcagacataagtgaactgactacaaactgtaggatattcagtgcctgagcatgttaaggaataggccgtgcttccaacaattaatatacaaatcaaccatgtgcctgtcagtgtaatattttcttttattaaaaagggagttaaattggctgttatctccttcatagaaaacatttcttccacacttttgcctaaaaacttcattttccaaaggacattttttatatatggtcttgaataattatactttataatttcactgaaaacttaattctggccccgcatctctttcctatttttctaccccaagattactattaatgtttttagtgttcagaagcatttgtgtcagcaggtgccaaagaaagaaggaaggtgtaaatgtatttttttgaatctaggtggtagttattttgagagaacaagtgagattgtttgaatttcaacaacttaagttattccatatatttaaaacacatgacctatatctgaatatgagactttaatttagcacttcattctggtgaacatatttcacattatacacatccaaatactgcaagtctcatttttttaaacaatcagaagtttgtatggaattgttgggggggtgggggggggtggtggtggtgggtggccgtggacagagaaactattaccatcaagagttgaaaattgccaccttaaatggcaacatttcttgagggattaattttatttctttttagaactcattattatgaggtagagtccactcttaaataactcttagtttttgggtctctatacaaagactggtctaattttagggcactttagatgagaatatcaggttattataaaaatgatacctgtaatgtgttcagaattatatgtgtgagtgtgtgtgtgtgtatatgtgtatcaaagatgaattgacagtggtggcgtgtggcctatgaaatgagaccgttcttaagcatattgaaagctat

SEQ ID NO: 123025 - DNA, 1028 bp, Homo sapiens
tacgaatttggaggacacagaaccataatacctgggaaaatgtgttccctggaattctgtgtacaaacacaaggaagaatccccttcccaaatatgcaccaggagaaaaatggatttccctcagccccaagcttcttgtggatacaacctcccacagacacactcagtccctggtatgacacttctcatcctcttttagttcaatgggtactgggaactcatctacctgcctcccttgccgtggcctctacctgtccttcatgatcactgtggactactgcacatagcttcttccctccctgtgtcctgaggaaatagctgcaaaaaaaggttggggctagaggagtctagccaagtttttaaagtctctcagtacaacagtttacctgttctcatcttttattgagatgtaaatggagcaaagctctctcttggctcttagtaaacaatctcagcctgtctctgccttgagaaactcactgtgcttctttgctaaacattttatcgccttaggaattccctaatgtccacctctttagatctcatagaaggagctgaaaggccatatatgtgccagtagggcctcagtacaaggagagctgaaatgagtgttttctacacactctcaaaaaccttgacttgggtcctaaaggaaagctgtctcgggcagttactctgaggcccaggaagaaggtgctctagagtgaggggtagctggcctctgagtccagggaggatgagtgtcatgcatgcttcgtggcggtggagactggagtggtctcgagccatcagctttctctctggcctttcctttggctcacggtgatcattcaaagactgagaataggactgggttgacccaagaagaggaaccaagctggatggagagagcagctgggcagcccttggagttctttcatttattcattcaacaaatacttattgagcatcagtcgaaggccaggcactgtactatgtgctggggatgctgtggcgaactgaacaaaaatatctgcatccccttgaag

SEQ ID NO: 123026 - DNA, 1031 bp, Homo sapiens
tccagtatagctcctgggccactgtgaagaaccaatgactgttagcttaaattactgttacattattaatacactttaaagagctcatttgaatgaggatttatttactatttatccctactttacaggaagtctttctgctctccttcgttccaaatggggtccattaaaagacaatgagcaaacaattggcttttatacaaagcaaatactggaaggattaaaatatctccatgacaatcagatagttcaccgggacataaaggtgaggtacaccagcattcattttcatgagttctttctttgctgggttattattttacttgcaaaagtcatattgtgttatgagtattaatttagaatggtgaataagtaaatcttagaaacagcagaaatataaaatatcgttcaaccctgaatcagttatttatgttcatgtcttaacgcttctgctcaaggaacacactgcttaactgcgttcagccaacaagattgtgctcccaccacacaatgtttcctaggagctctgtggtgtgggatgcagctgtcaaaagttaaacaggagatggcccctggtcctgaggagcttataggctggttaatctttgtatccttgcccatagtagctactcagtaaatacttattgaatcaatggatgaatggttagaagaaaaaaaattcctcttttctcacaagtatcacatattcattgatttaactataattataaggtatagattctctaaaataagctaaaataataactttacattctctttttaaaaagaaaattcagaactaatacattttttacaaagtctggactgttgaaaataagttaatattagtaccctaaaatcaaccaaaaagcccatttatctatcatgtccctacatattccaggaaaagaagtaaagaaacatagaaaagaaagtaaggtaactggaaagttatgaaaatcgtaatttaattatacatacatcattatatatctgtaaatagcaacaagctctaaccaattaggaatcat

SEQ ID NO: 123027 - DNA, 1017 bp, Homo sapiens
actgaattagtaaggtaacagttgagaaaaaaatttaatataataaattgtttgttttttgagaccggctcttgctgtgttacccgggctggaggtggagtgcagtggcacaatcacagctcattgtagcctcttgacctcctgggctcaagcaatcctcccacttcagccagagcatgccaccacacctggctaacttttttttttttttttttttttttttggtggagacgggatctcactttgttgcccaggttggtcttgaactcctgggctcaagcagttctccctcttcggcctcccaaagtgctgggattatagggataagcaccatgcctggcctataatagctagttgttaactctgcccgtagttaagttctatgattatctagcaattgtatagctttgatatttgtagttaagcctaagcctctttcattaaagatgtaaaaagatgacaggcctaatttggaaaaaaagatttcctgtgcattagcttgctgtctatagaagtaatagatactacttcttatttatgtatgttttatattttacaattttttatttcttattcaagtgattgttaggaattagctttcttgactcctacttcagggctcgtttgattataccttgttatctttgtttctgtgttaaattttgcatcacttgatacatagcaacttgccaaggtaaaacttaaagaaattgaaaatgaaacaattctatcaatcatatagaattatgaaggggatgactggaaaattcatgaagtattcttcaatgttacaaatttctggctttttttttttttttttaaaccagagatagctatcctttgtttcatgccctcctttcaggaactaactgcatcttaccaaaaatatgcatagcctagccaggctgtggtggcaggtgcctatcatctcagctactcaggaggctgaggcaggagaatcacttgaactcgggaggcagaggtttcagtgagccaagattgtgccactgcactcca

SEQ ID NO: 123028 - DNA, 1040 bp, Homo sapiens
caccctagagcagccctgctctgcagagatgaggaggaggacacctctcggaagagtaaatcattttagtagtgtggtgcaggaagtatcactttttaaagtgctatttataacttcttgttataaacaacattgatataaatgggattgaatttaaaacatttctttttcatcataggactgtagaagaattgatagttctctgaataatgcctttttgtttgttggtttcagtatttctaaatttgaagaaagatgctgctttctttatgtgcttcacaattctgatgatttccaaatctatttctgtacagaacttcattgtaaaaagtacgtattagtcattgtgtgtgaaaaagattcttcttacctgatcattattttcaagtaatgagtgaacatgtacctcctgtgaagaatgcatggctatgtggttatataaatattttatttgggctaatattttataattatatcataaatttaacagattttgggggggggttttctttaataagtcaaactttatcttagtcataacttattttcccacagataaaacattaactaagacttattggttaattgttaaatattataactcatattttaagtgctcacttactgtatatgattaccagaattttcattctcaaattcttttaaatcgtctcagtattatctacaatagtacctctttaccttggctcatattagttagatccacctggtaggctttaaaaaaacatgcatggcccccacctcagactaattatattggacgttctggtgggggtgaagcctgagttaagagccactgatctgatctataccaataaaagagatcatccaaaaatccatggactgcattgtatgtttgtgtttttctccattgtatgtttctcttgggctaataattaaattcttcttacttctttagaacactatgattgactgtgggaaactagagaagtgagtgataatttagaagccaaagtgtaggtgaaagttagtttggactcagaattttgctggggatt

SEQ ID NO: 123029 - DNA, 1179 bp, Homo sapiens
atcaaaacaataaattttaaaacattttcatcactccacaaggaaaccctgtacccattagcagccccccttccatttccctcccaaatcccccaactctaggcaaccacgaatctactttcagtctttacagatttgcctattctggacatttcatataaatggaatcatacagtatgtggtcccttgtgactgacctctttcacttagcataatattttcaaggtctaaggaatgataactcttatagaatttttatctggttttgtgaactgtctacacatactattttaaagcatgctacataaagcaacttccttagataatcagttagtcacacgtagaaatcaagcagttcttgggtttgatttgatttttggtatcatctgtgaatgagtttgctaagttttggagcaaaagccattgaaacctaaggtcagggttttgtccctacttggctttatttactctaccctattcaaagacacagactacaactctaatctcgtttcaccaacttgaacctgcatataggctgcagggaaattggaaggattgtggatgagtaagtacaaatccatcaccattattaacacagaaactcaaaagaaatccttgttagacctagtagacatacaatgggataaaacaaaaaattaggcttaggacagaggtttacagaggactctcaaaatctaattgtttctgtcctggcaaatttctctaatatgaatcaacatgttaaatagggtttttaaaaaagaattgatctatattgcttctgtaatgtatattgaaacaacaatgttttctgccttaggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggtaagtaaatagtatataaatgagctacttacttagtaaatccatggcataaaaaagtatttgcaaatgagagtgttaaagtattattataatccataagattgtgtattatgaactaaaccttagattttattttattttattttatttttgagatggagtcttgttctgttgcccaggctggagtg

SEQ ID NO: 123030 - DNA, 1049 bp, Homo sapiens
atggaggttgcagtgagccaagatcatgccagtatactctagtctgggcaacagagtgagactctgtctcaaaaacaaaaacaacaaacaaacaaaaaatcataggtacatctaatttatttagaacaatttgtactggaaacagtaaaatggaaaacaaagttttggcattttaagtggttttttgcaggaaaatttattaatatggagtacctttacctttaattctttctgaaggcagagtaataaaagaaatacattggcttctaaatttcttaataatgccagatatgtaagatatttatttaggcatctgaatgaactgaaaactacaaatgctttatagctaatgctgcaatatcattcatgtctttattaaaattattgcttttcattgaaattgtttctaatgtcaaactctttgaaatgtgtgtgtttttaccagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggtgagaagatgtttaaagtgaaatctttgttgtgtagcatgttggagggataagggagtattaacctcaaatttcagtttgctggtaagcagttcatgttactacacgtaattttttattgactctcttaagctttccatcctataattttatgatgaatgaaaaagactcatgtgagttaaccatcagtgattgtgaaagacttgtatggtaaaggcctgactttttcctccaaaagaacaaaaagaaaaatctgctggcacagcgaacctgtggacacagtctattctactgttagcctcaggcacacctgtcagtgaaagctttgttttggcaaatagcagacatttttagagctttctggacataccttttatcccttgaaattgtattgcttgaaattgatagtgctgaatctaactcgcctgaaggaaa

SEQ ID NO: 123031 - DNA, 1012 bp, Homo sapiens
ggaggttaggaataatttgctttggcaatatgagaatgatttatgtttgaatcaccatgcatacatttattagagtttagtgatgaggaaatcatggaccagaatatactgttgatatatatttgcatcattttacatggtataattaaccaaataacacacaagaaattaaagggaggctgatgaagctaaaagagtagtcatttatagtagggattgcccaactgtgaccagttcaagaccttgatgatagatgattcttatgtccttcttgaaaatttcaacattcctagctgtataacaggacttttgcagtttcccgatgttatctacttgccaaactttagaaaactgacttggagtctttaggagactctaacaggacatgacttttaggtcaaatttcagaaaataccaattaacatcttccctcaactcttctcttcacaagcagcagcaactcatgtgagatatttaactaacagataccttattatgaagggaaaattcaatttaaaaaccccacagactaccagccactgccattcgatgaccaaaatgcaattaagcttaatagcttaatgttattaccctaaaaattttattatgctttaacaaacccctgataaaccttgtgttatcctccacttaacattaactcagtcagaacaaggaaacaaattataccttaggtaaaaatgtaggagatttttgtgtctttgtctatacttttaaatgactaactttcttaaatttcttttttttttttttctttgaggcggagtctcgctctgtcgcccaggctggagtgcaatggtgctatctctgctcactgcaagctgcgcctcctgggttcaccccattctcctgcctcagcctcccgagtagctgggactacaggcacctgccaccacgcccggctaattttttttgtatttttagtagagacggggtttcaccgtgttagccaggatggtctcgatctcctgaccttgtggtccgcccgccttgg

SEQ ID NO: 123032 - DNA, 1036 bp, Homo sapiens
cttcaccttagtgggaaagctagtttctcaccattaagtatgatgttagctatagggtttttttttttttgtaggtatttgaacacttttattattttgatttgactgcaaattatcaacatcttattcaggcttctccagctgtgaagttagcaattagaagtggttgtgattgaaacattatctataattcaattttgaattgataatatataaatcaataatttgaattttgctcccataccaaatgggcatgtgtatgtttatttgtatgcataataaattgtataggaaaacgcttagagtgaaataccaaaatggttagtatctccgtgtgctagctaataacaggtcattttaatatgtatatttatttgctactaaggactaaatatattatatttttgagggttgtcaaccattaaattgtttatcatttgcctggatatagtttcattatttcttacatttagttaagaggctcacattgctactgtcatggtctatatcgacaaccaagacagtcttattgatggaaaagcaagtgcatatattataatgaaatgtggtgagaactattgggaattcaacatgaagaagtaaatagtctctccaggagtgaaaaaaattcaccatcttaatgtgaccctcattttcaaaacaagtaaaaaatctagctctcgtacagagcagtaggatccaattaaatggtagaaaattgcccctttgtaatttagcactcaagctccttctcagaagtctggtttatttatgatgacaggcacaaagggaagattcagagcagtttaagaaaataacttatgtagcactttttctaaaagtaagctaacataaaaactcactcgagaatccaaggaaaaatgtcatctggttaatggtgggattatggatggtggaatttcaggtaacatttcttctttttttaaatctttctttttttttattgtctcagtcttgctcttaaataaatcacacggaggtagaaagagctggggagaagtctttcagatatgac

SEQ ID NO: 123033 - DNA, 1022 bp, Homo sapiens
ccattctcatgcctcagcctctcgagtagctgggattacaggcctgtgccaccatgcctggctaatttttctatgttcagtagagacagggtttcgacacattgaccagcctggtctggaactcctgacctcagatggtccacccacctcagcctcccaaagtgctgggattacaggcgtgagccacagtgcctggcctggagtgttttataagggcactaatcccattcatgagggttccaccctcctaacctaatcacttcccaaagccctcacctcgtaatattatcaccttggggggtgaggatttcaacatatggattttagggaacacaaaaatgagaccttagtagtatttattgaatcaataaattaacaaataataccattaattacattcactgaatatatgtgaattaaggacttgatcattttcataaataatacctcatgtaagagctttatttagaaaatcttttgccttttcttttagttgttatggcccaaagagagagctaattaatatataagatggcatgtgccttgagatttatgataggatttactagtactaaatggccttatgtttgttgtttctataaggaaaaaaaattgtagactggtgacaattatatatataactgactgctgactagtctttactatttaagcatgagacagcatgtttatgccaccttattgcaattggactatcctaattgaagaaattaaaaaatactctatcactctccacaagatgacagaggacaaatcaacaaattgaatagtgcaatgtgcattctgtcctgctttctttgatgtctgtaagaacaggattcaaaaattattttcatttctctcttaaactaatatggatatttaccatgataatattagatagaacctattctttgaaaatagagggctgggtcccttgagaatgcactttgtgagatccacccactgcccccaaaacattgctcttaactccaccgcctatcccaaaacctataagaactaat

SEQ ID NO: 123034 - DNA, 1013 bp, Homo sapiens
gcccagtcctccccaaatgcgttatatctgcctcaaacttttgaccttttctggtctcaagtgggccattcagtggctttcccttcttcccttccttctccatcgcttctctgtgctgtcggagtagttactatgaaattatcttctgatcagtgcagtttcctgcttagagttcactgggctcctgaccagctgtgggaggaaactaaatttgctagcacagcagcaaagccttttgaggtttggcatccatctgcctcatcgcagcccctctcacaaggccccctttctgtgaccagccccagccgcagggttgccggtcttttctctaataaagaggttgggatctcctcaccctggtgcacatctgtccttctgtgcttattttcccattttcccctttcaagttctgtagttttattgtgttgacagttgctggaaccactgatttgggatgcgagaacaattcccccaggctcctggcttcttcccaggctgcgtggcatcctgcaggacagctctgagaaccttctgtcctccacacagccctgcccagacacctgggatctactcttctgtcttcccacagtgcctgctgcatgcactcttgcattttagtggccagcctcctggctgactgttcgtttttttttttttttttttaaagttagggtctattttctttattcttgtgcccgtagtgctcacatgtaataggtgctctacaagtatttgtcctattcagttctggctgccataatctcccataagcgaggtggcatataaacatcagcaatgtattttctcacagttgtggaagctagaaggtgcatgatcaaggcaccagcagattcagtgtttgtgagggcccacttcctcataaatagctgtcttttctctgttatcgcatggggcaaaaaaggagagggatctctcctctctggagcttctctctggttttttgttttgtttcgttttgttttgagacagagtcttgctctgtcacccaggct

SEQ ID NO: 123035 - DNA, 2050 bp, Homo sapiens
ctggttaacacagtttatggaaccattcaccattttaaacattcgggaaaattctgtttctgaaacctaaaaccgggacttttcttgtattagagcagtgacttttgctttcatccacctctgagtagcatcttggccagatgtaggagaagcatcaacttggagtggtgaaggtggtggggctgtggtgaggaaggggacaaagggaagatcaggtggctgcagggagaaccgggatgctgtgtgaaggaggaggcaatgccagcaggagatccagcaacactttcacttcctttaggcttcttccctttctacttctggccgacgtaagacccagggatgctgctgtgctcaaggccacctcactccttcagtggacacagggttagcttggctgcctgcttcccatttccttaccaccagccttcacatccgcccgggcctttcagcttggctcactgcagattgcaaccgcttactcagcctttcaccctgtagcaatcataggtaacaggaaggaagcacatgctagttaaaattgtaagaacttagcttttctattctcatccatggtatgttcccactttacttgagcttgtgacaaaagtcgcccatgtgttaatatgccatcttgctggagaggcatctgaccttgccaggctttggctccaacttgcttccagcaaagctccttaggacttctaatcttatttggtaaaacaataaaacaaaacagaacataaccttgtatcccatctatcccagatggagaagttcttgaaaattgtccagcccacttctgcatttctactttcaatatactttccgagtatattgtctcatatattttgaaggagagagtaaagtctgtatgtcctaaatagtggttcccacgaaccagttaaaaaaatttggaggactgacatgtgtttgccaacatttaaatttttccaagtaagagtattataagtagagaaagtgaggaaaatcgagagagagaaagagagacagagagacaagaaaatcaacaaccagccacctattgccatgatttcttaaaaaggaaagttttatgttaaaaaaaaattagtgggggacataaccttagaatgaagggcagatcttcacatacagaaaatgtgtgcaaaaactcatgacttgttatttatttttcccatttctccaaggatgagtgaaaactttatcacaccagtcaacagagttgtgtttgagagcctctgattggaaccgccctgcagccccttcccacctttcagccactgcttcacgtgagaaacgaaccttagtaaaattatcaaaagagcaaacgtagataaactcataagggaaaactctagttagggaaggattttttaaaaaaatcccagtggtgtccaacacatggtttttctctgagctgttcacgttccctggcacaccattgtagcagctgccacccaccgcacacaaactgacagcactgctgcttcttgctttcttggataatgggtcaattaaggcaaaactataatttttttaaaagagcttaactagaaaatcggacggaaaaaagcaaaatcaaaaagaaaactccagagcacaaaattagtttttagagtaccaatttcttaccccacatcatcagctgcatgttgtcatgaccggctctgcttcctgggctgccaggatcctggtttctttccttaatttggtcacctgttgtctgcttgagacattatcagttggtagttcgagctggttccatctctgggtgaagcctgtgcattatataagcgcataacacaggcttgtctcacccgtggccttggctggagccagccttttgggagttctctgtttatagggcagttcccctctggtggctataagaactgtgccctacttcctgtttcagaggtctggttagaggcccattcagttcctgtttctggtttgcaggataaaattggttcacactttctttgtggagcagtgggagatggacaagcacaaagtccgggaaatgtgcaagtctctccagcatgaggta

SEQ ID NO: 123036 - DNA, 1028 bp, Homo sapiens
ataatgttgagcgaagatgctaagttggagctacatatagtgtgaaaccactgaaaggctttgcacaggggagtgacatttaatttgtattttctaaagattactttttatgcagtgtggataatggattggaggtaaacaaaaatggatggggagagcagttagaaggatgttataatctaagtggtaacttatggttgatggttgtaacctcttaagagaaatcatagacaaattcttagccatagccctttaggatcttatccctcccagctattcaaccttgctcttccctgaatctggcaagcttgttccctgttaaggtctttccctgttctctgtaacctgagcctttcatctcgggtctgcagagttcagtctttaactgcactcaagtctctgcacagagaggtctttcctggccattttgttgagaagtgaccccctgcccttgtcattattttctgttctccttactctgctttttctttgtagtttttaaaaaaattgcaacttgaaattatacatttatttatagcatgtttgctgctgctaaaatataagatccatgggggctggtcttatctaaaattgtaacctcctttccccccgtgcctagtacatagtaggtgctcaataaatatttgttgaatagatgagtgaattgattgaagttgggataatggaattcattcttcccttttcagctgtttctcaaacatctctctggctgtgaacttttttcagagcttgaggttaatgcccaaaccctgtcttgctgtcacctcaaactcagtatatataaaattacattattttccttcctccagtctttcacttttgttaatgctgccatcactgacagtcctcaggcacaaaaccttggtgttatcttgcagtgttcactacccccgatccctagggtgctgtatattcccatttatgtgtttgaggaagttttctggttactgtttcacctctgctttttgcctattgacattttagccagccctcagggccctgcctca

SEQ ID NO: 123037 - DNA, 1313 bp, Homo sapiens
tgaggcggtaggactgcttgagcctaggagtttgagaccagcctggggaacatggtgagacactgtctctacagaaaataagaaaaaaattagctgggtgtggtggcacgcaagcgtgactccagctacttaggaggctgaggtgtgggaggaccgcttgagcccaggaggtcatcgctgcagtgagctgagattgtgcccactgcactccagcctgggcgactgcgcaagaccctgttttggaaaaaaaaaaagaaaaatctaagttgtacagcttagggttttgatctaaatatatcttgagtaatgattcctacagtcaagctaattaacatatccatcacttgaatggttaccattttcttgtgtgtgagataagaacatttcagatctactctcagcaaatttcaagtattcagtaatacattattatttataatagttaccatggtgtacattgaatctctagaaattattcatcttataactaaaagtttgtatcctttgaccaacatatccccatttcccccacccccagcccctggcaaacactactctactgtatgtttctctaagtttgacttttttagattccacctataagtgacgggatcagtattactgatgttttttttcctcagcctccaacatggctcaatatagtactgggcagcagagagaaagtaacccacatgtaagcggcttaagcccagatactcatacttcctacgtatatgtgggagagagtagtaagattcaaagtaacctgctggctgatcaccaatgtgatataccaatggcatatactcaggtccttgtcaggactaatttcataaagtataattatgcacatattttgttgaacttagtttacagcagtgatctgtgtataatctgttgtataaaatgaaagaatgaaaacatttccaaaagttttcaagtagttcatttgaaatggttcactgagagcagtgaagcatatactttagaatagcagcattggataactaaaactgtttaccaagagatctggaaggatcacctggttcctgcaagctttttctaagaaaggccagatagggatattaattgaattttaatgctttccaataaacattgacccagcaagcttttttagatgactaactttctaatctgctttgacatttcttcgtggggctgcaaacagtgatttgttggtaggttttaaaatatgtataatttgttttagtgaagaaggtttggaagtatactgtagaattctgtgaaagcagaatggagtcttatctgtaaggaataagtctggaggaatg

SEQ ID NO: 123038 - DNA, 1197 bp, Homo sapiens
tactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaaactgatggtttttataaatagtttcattgggatgcagctacgcccgtttattaacatattgtttatggttgctttcacactacagtggtggagttgagtagttgtgagagagactgaaaggtcctcaaagccaaaaatatttaccgcctgtggcccttgacagaaaacgtttgctgacctctggcataaatcctcaaggagagagtaagaagtggaaactcttttgtgcagttggctgtttagtagagaacagaagacattagctagaggaggaggtggtgctcctaatagtgtctcctctttcagttatgcagcatccaaagatagacaataggtaggataattgttcctttcttgctaataaactataccaatgccctgagttgttgaattatgttgattggctttcttaggaaatataatatcacacacttttttcccattttatttcattatttttaattttaaaagtaaaaaatgaccaaaccatcctaaattgtgaaagtactattaggttgaaaatactcagaaatggaaaccttcaggtaaattatatacagacaagtatatccatttagattatgcaactttctttttacagggagcatgactgaggtgaaagattatgtaattttttgagatcctaataatgaatactagtaatgcctatgtatagaggcatagttaatttaagaaaaaatatttttgttctctgataaaaattaatagctttcttttctagaatgttgagcagtacacactgtcgacttataaggttataaactattattttttgaatttttaagctaagtcatagctttttttgtccataatctgaattaaatcttttctaatatatgaagtcttttgggatgggaccagtaatat

SEQ ID NO: 123039 - DNA, 1054 bp, Homo sapiens
tttcttcttatgttgcctttcccaagcctgcatccttctttggtcttttatccttctgtaacatagttaacctttacggttagtaaggctgagtgtgcattaagtcagtggtagcaatattaatatatttaatttgaatcaattaaccctttcatttacatgtataacttgagttaatcatcttttatgtttttattattattattgagtcagagtctagctctgtcgcccaggctggagtgcagtggtacaatctcggctcactgcaacctccgcctcccgggttcaagcaattctcctgcctcagccttctgagtacaggtgtgcgccatcacacccagctaatttttgtatttttagtagagacagggtttcaccatgttggctaggctggtctcgaactcctgacctcaggtgatcaacccgccttggcctcccaaagtgttgggattacaggtgtgagctactgcgcctggcctgtgtttttaatttagtataaatggtaatgagttttgtgcttatagtgaatcggatctgtaagttgaccacagttcagtttactggtttatactgttaccattttgtaattttaccgttggtgaaagattctaccacagagagtattagtccaagtcgaattaaagttcttgtaaggatgtgaattagattgacattagcattattttcttaggggagggatgccttttggccttatatcctacagtttcaaaggagtcatttcaaactctagattgaattagtggtgtagaatagatccacctcaaaaatgaactgaggccaggcatggtggctcacatctgtaatcccagcactttgggagctgaggcagatggatcacttgagaacaggagtttgagaccagcctggccaaccaacatggtgaaacctgtctctacaaaaatacaaaaattagccgggcatggtggcacacacctgtaatcccagctacttgggaggctgaggcaggagaatcacttgaacacgggaagtggagattgcagtgagccgagatagcgccaccgtaccccagcct

SEQ ID NO: 123040 - DNA, 1036 bp, Homo sapiens
ctcttaaactcaaacgacctgcctgccttgaccttccaaagtgctaggattacaagtgtgagccaccatgcctgacctgttttggtactttaagtcagttcacatactcatatcttattagggtgaacccaagctcattgatcttgagacaatgctatagctatagcagaatttatacttttaacctagtattagatataaattcctgaaagttagtatatattatttaggcattttgtatgttttaatggaaacctcgagcttaattaaatggtttttttttagctagtttcaggagactgacgctttaggagaatacccttcgctcccttatgataaagagtgatttcctttgcctgcaagtgatagaactgggactatgttagatctttgtgaaatttgttaaaaagcatactccagaaagggaagggctgtttgaaaggccccaggacacattctgtttctcatctggacttttctctacttgttgacttggctctgcagactggctttctccacacagtgagacacatggccactagtggctcctgaatttatatatatataaatatatataaattcactatgtttatatatatattcagtgtataatgcagcgtgacatccacgtcaccctgcattatacactgaaggctggagaaggtcatgagagatcatttcatcaaagctatatatatatattttttctgtatttatatatatatattttatatatattatatatatatatattatatatatatagttttttttttggggggacagaaacttgctccattgcccaggctggagttaaggggcgtgatctcagctcactgcaacctccacccctggggttcaagtaattcttatgccccagcgtcttgagtagctgggattacaggcgtgtgccaccatgcctggctaatttatttatttattttgtatttttagtagagacagggttttgccatgttggccaggctggtctcaaacgcctggcctcaagtgatccacctgccttagcctcccaaag

SEQ ID NO: 123041 - DNA, 1307 bp, Homo sapiens
tagtttttttcattaggaagagcagcattccgtgtcttccacattgtagcaaattctcagatatctgaagattttaattgataaagctaaaatgaccagtttagcctcagagtaacactccagtttcatgatacttttataaatattataacctttaaaacttttttatcagtggtcttaatggcctttgataataataagccagaccaagcacttaatttttttagacatatggatttgggggcaagaaaaatataaagtgaattttaatttcagtgttgtcaaactgtattcagccacagtttgcgtgatgtgagtctctctctgcctatgtcagcaacattaatgtttccaactcaactgttaagctactttttggtgacaaaattgtacaactgtactctactttaaaattcaggcatatttacagaatgtctgttatctgccagccattgtaatagacagtttgaaatgtctttttgaggaaatgataaaaatgaaggcttggagacaagtagtaacacacctaggagaaccctaagcctgtcagttttgttggtatcgtgggacatatgtagtcacaaatgtaaatagggagtactggaagatatatattcaatagagtaattatgggttggcacattcccaggtaacatagtaggaccacagactttggagccagactgccttctactagctgtataaacttgagcaagttattttaaaacttgatggctcagtttccccatccctgtaaatggagatgctaatagtacccaccacatgggattgttgtgatggttagaagagctaatatacacaaatactggtacatagtaagtactatgtaagtgtttgctacttttgtcattattaaggctagaatggatggtgacagaaggctgtctccttgggcttgaggccatttcagcgctctagtcttcaagagtgaggtaattttattttacagcagtaagagcaagcagccccatctagccttttgttgccctctgctccttggaggtgaaagagaagtacgaattggggataggaagttatctagaatcagctctgtccttccacatccctgttctttggagatatttagaaacgttctatagattagacatctattatgtagtggggtgagcatgtagacctttgagtgagtcatacttgaagtgaaaagctgactcctctatttactagttgtgaaatatgggaaatgatactgtgatctaccttgctgggatgttcagaggattaaatgaagtagtatctgtaaatactctggcacataataagag

SEQ ID NO: 123042 - DNA, 2672 bp, Homo sapiens
acttgttgtcatgtcactgtaaatatgttcttatatttctgatcaaagttgctgaaaaccagcaaaatgacaaagacaaattatgatgtctgcagtttatttttaaatggttcagcaaaaatattccttcatatgcgtatgtgtagagagagaaagataaaacaaatgtggcaaaattttagcagttggtaaactagacaaaggacatacgggtgttcattttattctttgaggtttattgtgggttggtaattttcaaaataaaaacatttgagaaaaaagcaaactgtatttactcatgcaaaataagaccctaaaataccttctagttaatgttattatttaatgatattagtttaattgtagaataagataactagctttattatattgtgttaagtgggaaaatgatctttaattggattgtagtaaacttaaaatcttaaagcagaggatgcagaaataccttttatctttgtcacagatactctcatgggatttgcccttatctagtaagtgtcttaactttggtgtggctgatgggcttttttgatccttatgtttattagcacagagatttccacaggcagatacttctctttcttccccttccccttaaaaaaaggtcagccaaagtaaacagatagtatagttgaatatgtactctgcctcacaaacctttcatttcaactttgcctagtccccgttaccaacaaaaaaaggtcagtcagagtaaacagataagaaatgtggctgaatatgagctgccacacagcttcaaatgatcattttacctcatcttttaagatagttgtttttaattcctctacttttgttcatcaaaccataagaaatcatgtggctaatgatatgatactgattgttaacatttgcaggaactacagttaaattcttaggatgatcagagattttcaaaatgttctgtgccttcagatatcttagctagaaatgtctttgtaaccctatcaccgttttttgctttgtgagatgggttcaccacacctcaccaataactttagaaaagcatcttaatgtagtcatctttggtttccttttaagaacgggaatatttgcattccccgatttgtgtaatccttgcaaggatattttagtactgaatttattctgtgttaataaagcacattgcctgatgacagggtaggacttgtctgttttattgttttgtccctggctcctgggatgtggatatgctaagtacatgtttataaatataagtgaatttgaattaaatgaaaaattgtgataccctttggtcactctgactgtagaagctcaaacatttgtattttaatgtggtttccactttaaatatttctgaagcagtcattaataaaacaatttaaagtagaaagtcctgttgggatgagaaatcttttccaaggagaagacttgctgttcagttgtggttaagtcagcactgactgactaatagaatgttactatttagcacatttgggaccatcgcgtttgttaactaaagtgacagataaacatttttatttttttctacaaatcaagtgtaatatgcaatatactgacacatctctaagcttcatatatctttgggttaagatacatatttatatgtatgaagcaataactcccaagtttgttgatatgttcattttttaatatgtcccgaaagagtttttccatttgacttgtttaaattagaaaattcttgtgttaattactgtcatactggaaagatcttttcatgaagtgaagtatacttttgtaagttaagtaccagatgaaaatgaaaataatttcctataaaatgaaacaacatatattaattggaaagaaacttgtaagacttttgattttaaatagcttgctttataactgcagagctttttcagaattatttgttactaacatttttctttaagaatgaaaccagatccgtgtctaattcataactgaatgcaagcacatgaataaatagataaatctaaaaggaacaaggaatgttaagccttagcttaatgcagtataagtcattgctttgaactttgaattgtgctgattagttccaacagaacatttatggactttctaaattaatttgcatcatactttttaaaaaatcctattgtgtggtttcaataaggcaactgagtagattttgttgcatgtatttgtattttttaaatgtagatactgctttttctcatttttcgtagtaggaagtcaaaagataatatctgaaaatgacaaaataaatgagctccatgagcatattctttagaaatatagagtaaaacattagaagaagcaactaaaagaatttagagtgattgcctctgaggtgaaagattgaggaagtacggcaggaagctgctgttttctgttacaaaccttgtagaattagttgactctaatgtgtgcaattatagtttttaagaaaaagataattgagcagaaaaacctgtctttccctctctccgttatttgcacacatagtaagcctatttacttagaccaactgggtactgccagtcagctggtagtagtttacacagttcccagagagcataaggatgaataatacaccctttgaggtctgtcctgaaaccctagtcaagagtgtggcaacactaaatattctaaaatggaattcttag

SEQ ID NO: 123043 - DNA, 1021 bp, Homo sapiens
tactgtatttaacaatatttttgatatttcactactgaatattatttttaaattatgcatattaatattgattgaaaaaattttcctgactcctgatccccttgaggtgaagaaatctgaagcttaggttgtctctgtttagtaaatcctctcaaggcaaaagctggcttcatttttccatttactgctctgggtttcagtcttgtgttggtttttactatagtgttcctcactaatgctttaatgaagttttaaggttggttatttgtttttatgtttcgtccagggtttttagttgtttttaaaatgttggtctagaaaccaggtcagccattctgttggaaatgaacctctcttagattaggcaccataatgtatacacttggtatgttacataatttctaccagagctgtgaaatggtataatgaagtgtctttatgccattcagtagactaaccctcccttcaccaaagagtttcagcatgtattttctttgatgaactctttgcaagatgcagataaatactggatagtttttcccaggttaaaattatgtctgtgattctgtggtgtagaactctgtgaggctttgactacccattagctgtatattagagcaaattcaggtggactttttgaatagaatcacagttctcctgaatgtgtgacttccctcatcacactttcaggctgaagttggatagctgcacacatgtgtctttgtgagacatcttaattttcataaggcccaccttatcttatctcagtgcagctttgtcctaagctggctcaaaacaacagaagctgcattccaggaatttatcaggagagtataaataaattctcgttgttttgtattatccttacgttctaaaagaaaccagtttttatggtttacataaagaatatttagcgtatccattctgctgaaataaaatctaaatttcaaatgaagtcagagagctaaatacccggattacatcaaattgactttcccttagacccattcttttaaactgc

SEQ ID NO: 123044 - DNA, 1051 bp, Homo sapiens
tttggtggtcccagggcctgggtgaactggttcatcacaggaggcacttttaggctcttgtagaggataactctttgctgctgcagcctgacatagtggggccatttcacaaagtgggtgaggtcccttttgggctggatgtcctgtccagtgccagaattcttaggcctttactcaacaggggattcaccactttcttggcctgttgcttcaagatagcaggggctggggccccgtcttgcccttggtcttctttcggcatcttgggcagctataggagagagataatttgtatatttacaagtcacatcaaactcttttctaggggagatatgaatcaagttctacatgtatctccatgtttttccctctcacttttgtcagttatctattactgtgtaatgaacaacttccaggacttagtggcgtaaaacaacaattttatttgctcacaattctgtgagtcagcaatttggaccagacacaccctagcagttcttcttttggtctttcctgtggccacccatgtggttccagccatctggtggcttaactagggccgggtggtcctattaggcctcgttcaatgtgtctggtggatagtgctggttgtcttccaggccgtgtgtctctaggtatgcccaggtctctgcacttaacagttgtgtgtttacaagagggcaagagcaaaagctgcaagtcatcttgagaattggacttggaagccacacagcattccttctgttgcaaagcaagttgcaaggccagcccagattcaaagagtgggaaatagactgtaccgtttgatgggaggacctgtgaagaattcatagtcacttaaaatctgccacactaacctgtgttggtatagtaggtggtttaagttttatttttgtttgtttgttttgagatggaatgttgctcttgttgcccaggctggagtgcaatggcgtgatctcggctcactgcagcctccgtcttctgggttcaagcaattctcctgcctcagcctcctgagtagctgggattacaggcatgtgccaccacgccc

SEQ ID NO: 123045 - DNA, 1040 bp, Homo sapiens
ttttaaacaacacacatttatcatctcacagtttctatggtcaggaatccagaaacaactgagttgtttgagctcaggttttctcatgacatcacagctattcacatggttatcaggcctcaattactcaaccacatgggattttccataggcagaatgtccctacaatgtggcattcggcttccccagactcaatgatacaagagaaaaaaggacatacaagatggaagtctcagtataacctaaagtcaggagtgaccgtcatcacttctgccaggttctgttagctacacagaccaaccctggtacagcgtgggaggagttaacataagggtgtgaataccaggaagcgggtatcactggagactatctagaaggctaattaccataatacgctttttaaagtaggaaattatagacaaatatatatgatatcctagttttgttatttttttaaaggaggagtttgcgtgtgtataaacatacatacaaaaaagactgaaagtttccacactgaacacagcaagctctgtgtagtaaggttggggatggtgaacactgaagagagcgcgtttacttaattataaatttgtttttcttttatgtaccacaatgagcctgtgttacttttataattagaaataatgaagtaagttttcaaagacactgtaattccttctccaggaagctttgtctgctactgctgtcaagctgatgtacttgccctcctggcgctccccccttttctgccacacaatcccactgttgctaaggatgaaggcgctgtgttcatctttaagtcctctgtggctaacagaatacttagcacaaaatacttgtactatatgtttgttgaatgaatggataaactaaaggatttatttaatgtcattaatatttattaagtagctccaaaggtgatgtgcttgagtctagacccttggtaccctgataccaataggtcaaatagctatttaacctttagatctacatttttattcatctagatcatttaacctcgctaaacatggtattcttaa

SEQ ID NO: 123046 - DNA, 1128 bp, Homo sapiens
aaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgttgctgaaaaaaaaaaaaaaaaaaaaagcttatactgatagtaaagaattaaatggtgccttggtcttctatttccttctacagttatttgtctggggtggtcccagaaatgtctggctctaaccaatgtttgcaattccctatcctagtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaaggtaagctttaaaaaatctttgctggtctaggaaggagatctgctaaaactagaagtcggtatgatggtttagacaaggttttgacaaatccgtgtctaacagaaacaggttgaggcaaaggcagaaacaactaccaccagaaatgcgtggagcagcctgggactctgccattgagcttggccgacgttcagaagtgttctcacaccctcggagaactcatacaggtcccgtgtccactgccagcttctttccatggtccttcggccacctgccttgtgaattaacaatgaagaacttttacacatgccttttttcttctttaaaatcataatcacgctgggcatagtggcccacacctgaaatttcagcactttgggaggccaaggagggaggatggctt

SEQ ID NO: 123047 - DNA, 1032 bp, Homo sapiens
gctctaatctaggatttttcccagtacacctccattgctccactggtaaaatgaggattttcttcctcattggcggtgacgtaaagtaatattaatacttctgtttcccaccagctaaatttctggacaaatgaataggacaaatgaacatttgttagtttaacaactaacaataaacattcctgcaatttgagtttttaaatttaccatttttataaggaatataacagatgcatagtatcgtgctgtgttgaagtaacaaattgacttattgatagtaaagctatttttagacatgttcaagtcaatcatatatatttcttcagttgtttgaccaggactaatatggtgattttttttttttttcagattaaaagaagctgtgcattttcactgttttcttttttcatctagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggtaagttcttgccattttttttctaaatatagagggagcagtaactaaaataggatcatgtgaggaaagcaaactcatttgcagtttcaaaagatctgttttaacaatattcatttgcattagttccattccttagagaagttcaaaattaaaaataaagcagtttctcacacatttaaagatatagaacaactaatttggaaagccatgtgatggccccttgacccaggaaagaaaaaatatataataagtacataaaactacacaaatgtttgcatttcaggattatgaattataagtcagtttgttacttcaccatagcaagatgttgtgaatccactaaaatgttctttatggggattgtaatttaaagactgaagagcaggaacgatcactggttacaactgtatgacgtggactggacaaagact

SEQ ID NO: 123048 - DNA, 1030 bp, Homo sapiens
tctcacatatgactaagggaatttaatatttaaagatatatttgttaaaataataatgcacattattgaataatccctaacatattaagtatttactacaagacacacagtgtgcttacctttttaatgcattacctcagatactcatcacatccatcccgtgagggagacaatgttaccatacatattttaccaatgagaaaacaaaggcttagagaagttacgtaacttgacaatatgcaaagttttgttggttttcattaagaaaaatgcttccaacatctttgtgatcgtttaataaaataaggggtaaattacctccatatttaaattggaattggagaagactattttctggtgacttcaaaagcatctgcttcaggtaatgtttcctgattttattacattatcacaattatattatggccactgcaaaagttgaacaatgcattaaaatgaataatttcttaaaaatacacaagacctaaacagatacctagtattctgattactatgcattaggataatctaaaataaaggcacccctttaataagaaaattacaagtaaattcctttctgttaggaattcacttcattctggttcaaacctcattctgattctttgttcaatcaaaattgaaccattaattactcatctggtttgtaaagcaacttcactactggtatgctgccaaattttgtaagatagctgtttattacttttctttaggttttcatacacaaacacacacacacacacaaacacacacacaaacacgagagacagagtcttgctctgttgcccaagctggagtgcagtggtacaatcatggctcactgcagcctagacctcctgggctcaagtgatcctcctacctcagcctccccagtagctaggactacaggcacatgccaccacacagggttaatttttgtatttttttgtagagatgggttttgccatgttgcccaggctggtcttgaacttctgggctccagtgatccttccgccgatgtgctgggattaca

SEQ ID NO: 123049 - DNA, 1036 bp, Homo sapiens
agacaaaaatgtctgcccagagtggaaaaataaaacaagggggagaagagtttgagtaacggagaagttctgtggaatcctagtgacaaaagttgagaaactacctttaaataagacagtgaggtaacaaatgttaaaaaaaaaaaagttaagggtaatattgcattgtttgccacttataacgtatctgaaacatttgttctttaatcttaagcgtagagtggtccaagacctggaaatctgggcagtgggttttgatttctaaggaggcagttttacaggctgtgcaaggctaaccctaccaatgagatcacactggcgtatccgatattgacatttgcatgtcttgcctatggtttacagctctcactattttagatctttggtgaaaaatctttagattcagaagagaaaaataaaagagtcaggcaagcaaaaagagataacacctcatttgtttaaaatcttcctactgcccatctctttccatctgattgtggcaggcactgtagccacaggtttggtgttgtgggattgcaaggggcaggtattgaaagacctggctcctaggcaaaactttgcccctgaatggctgtgggatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggacggacggacggacggacggatagatgatattgtgaaagagacttttgctgtgccacaaaggaaaggtatatgtgttatttttatcctgctatgattttgcccaattccacctgtagaggacgtctgacatcaaaagagagcaccatctgatccagagaatgactcccactatgcctttcccagcaatcagattaagaatcccaatctaaaactatcaccag

SEQ ID NO: 123050 - DNA, 1049 bp, Homo sapiens
cattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttgtttccagtttgtagtttttccatttttcaaatctggggaaaggaattaaaaaaaaaatgggtaataagaacatgggatataatgaaaagtggtttttgtttgtttttttgtttgaagttttaagggccttgctcattttaggtgtccaaaaccaatttttgagtggagattaatgaattctaatagtctattccctgaacttttcctcaatgaacaataccctagacacacattaaacaatttctctgcagtgctatcaaccagaggaaaatggactaagagatttctggcaggttcagacacccgggggacatgtgtgcagtgtagctgaagcctcctccttgtg

SEQ ID NO: 123051 - DNA, 1033 bp, Homo sapiens
tccttccttaatttcctaggtagaaattatatttctctcccttgtgtcctcaccgttcttcttacataatcctgtcgtgaagctcatcaaccacgttggcagttgtttgcaggttctattctcagaccctagcctcaaggagctcatctagacaaattactcatctttgtatctcttatgtcagtgccttataaatgtttgtgggatgaaactgcttctccagctttacatcacatgtcccagaaagccactgccttcatctcctagattcttagaaaatgcagtatttgaaagaatctgtgccaaaatggaatctcagctttggcaataggacttctaatatcttactgactgagaaggtcggtctaaagagtatacccagaagcccaacactcaattcattgacctcagctagtgtagacttaaatcctgtgccctctactcaactaaagccctgccccacctaatgtatattagataaggggtgggggatggtggtggtagtaatcaggactctgaccaatattctatgccaaaggatgctaaagatacaaagttttcagttctcagtagatttccatgaaaagtccttggccaccctggaagaggcatactgcctgtcctacctccacctccaacatgaatttgacttggagtatttatgttctaaaggactgaagaacctccactcctatcctgtcccaattcaggattgtctctttcttccttccaggtcacttgcaacagtactggtccagatgaaataaaactgtcaagggaatcctggagctattttgtcaaaaggcagccattggcagcaaacctcttgttggcattactcagtgcccctttgggaacaatcccagtgattaccctagccataacccagccattttgcttacctgctccatgatttttcagagccaacctcagcctaattgctttctcttgccagttgtactttccaaaaagattctaacagcttttttttttcccatttgtctttgtatgtgtcccaccacctctcctccct

SEQ ID NO: 123052 - DNA, 1047 bp, Homo sapiens
aacctttgtttccaagtgctggtcccacttaatcttgacagcactcctgtgtgagacagtggacacactgaggttggaggggctatgtagctggccaagctccttgagccagtccagggcagagccagggctgctggactccaaaaatcaccttcctaactcactatggggtattagctctccaattatttgacttaatacagaagattttttattattatttgcaatttatgggaagagctgagatatatacaattaaattttgtgcagtaaatcacttgatgaagcaccattgttgaaaaaacctcctagaaaacctgctatatttcgccattgcccactcacaagtgcaacttaccaataaaggattatggattagaccaccttgtatcaaaacagcttcaaatgcaatttccaaggagccagtgcttttaaaagacagttgtcctatattcagactgaggggagtgtcatgaattattagagctattaagattagcacgtatacctagctttgccaggaaatgacttaaattgactttacctctctctaaggaagaaggaaactttaagataaaagagactctagtctggaattgatgtgaatacccactggggaaacctgagtaattatgtaattaaataactaactcttacctctccaccttctgctaacttgaccaagggaagaggctaggtaacaattgatatggttttttaatgagggttaaggtgagcaaaactgaagaattactgagagaagatttaggatagggctcatttttaggcctaaaggaatccttctagaatattttaagtgagagcagacctatgctaattttcagtttaatgaactccagagagaattgttctatgtaaaataatgggttttttttcctgaaactataactgccccatggtgtgctttattttataaatcctattttgtttttctgtatttaccagctgggagaaaaaccttcaaaaacaaaaggggttttgtaagcttatttcagaggctgttggtaggacagaagccaggaaact

SEQ ID NO: 123053 - DNA, 1035 bp, Homo sapiens
tgctttggctaccccttcagccactgggtgctggcctgtatccatctctggactgaggcatgtcctcttgcccccttgcaagtgccacttccatgattaaaaattaacaaaagagaaaacattatgctccactgagacagggagatggcagatttcctttgttcctctaagagaaagttatgaaagtaaaaacagaagagtgggagaagggaaaaactccctgagttataaaccctttctttgactcattatttattttgatgtcaaaagcttcaaacctcactttgtcataaacgtccatcaagccttcatccctaccctgttatcagggggctgctttctcggctgaatcacagtcactcagtgtttctcagtgactcctatcttcagacagctaatatgccattgaaatgagcctccttaattctacaggattcaggagagcctttcttttcaaagcaattaaagtttcatatggtaggggagtttgaaaatgttcgggcaaataaagtacgttttttataaagacagtgcttgacatgagctgcgattgctgcagaaatgcctctttgatcctggatagaacaaagtgacgtctgtgtaaggtggttcctcagcactaaaggaaggtcccagccttgcacggcaattgatcaagggtcatcggcactgactttggattgctgttccttagagtagcggttttcagttgcagtcttgtgacttactttgaccaaatgtaaggttcgctgcaagcaatattttataaagtaccagatttcctaaaagatagtgtagcaagtataaatctcagttgtacaagatatatctatttcttcacattaaaacaaagctgactgtagcccctcagcctgcctagcagggagaacacttggtctctgccctccctttatttctcatcccagggtcaaaccagaagctggagcttgtgtggtatctgtaaggggaggccccctcacctcttatatcaccagggagcccccattatctccagtcataggctccctaagggtc

SEQ ID NO: 123054 - DNA, 1034 bp, Homo sapiens
cttccaaatagatacttgagttcccatcacatccaggcctttgggtgtgtatgaggccagtccccgccctggaggggggcttacaggatctactcttagctgtttttgtatcttttccagcattatactcataaattatagacaaacaaaaccttattcattaatttactggggttttttgacatcatttatgaaattgaagctaattctgaagattccattcccagttactcagtttctgggaacaacgccttgccatctttcagcttcttgccaagcattttatgagtgcctaccatagcggagctagaccatgagggcacaaagatatttttaaatatattctttgtgcctttgaattaaaatctcacagttagagcagacttgtacacagttagaatagatagaataataccatacatttgtctacagtgtttacacagcatttccattaatcacatcaacaaaattaccataatcattctgccataaagaccttgctgaattgtttccaaagaacacatctctttctgtttgcatccaggctctttgaagatgctacggataagttgaacctcatggccttgggaggttttctttaccagctgaagaaagcatcgcagtctcagcttttccattctgttacagatacagttgattactctctggcaatgccaggtaattctttccctgaataaaccatatgccaggaagttagcaggaaacagcccaggcctctatcaccagcagcgtgcctgaagatttgactccacattcccattgcttacactcacacaagctaagcccaagtatagatttgtctccagattttgaggcatcctgtgtgaggggtggtgtaactctttgtgaatggaaacgttgctgctaccacatctataagaactcccactggagctggactaggttgttctgctaagttttgtgcttgtggtagaaattgtgtggctccttagggtgcagatagcttccttcacatgagggtggagcttttctgcgtatcacaaaccacacca

SEQ ID NO: 123055 - DNA, 1079 bp, Homo sapiens
tcgtggccccctacagccttggcctcctgggctcaagtgatcctcccacctcagcttcctgagtagctgggactacaggcatgcgccatcatgcttggctaaatttttatttttttacttttttgtagagatggctcttactatgttactcagactagtctcaaacttctgagcttaagtgatcctcctgcggttctgggattacagttgtgaacaaccatgcctggcctatttttttttaagattataagtgtatgacatcatgggttgggctgtgttcccccaaattcctatgttgaagtcctaacccctggtacctcagaatgtgactatatttggagaagaggtcttttaagaggtaattaagtcaaaatgaggtcgtgagggttagttttaattaaatatgactggtgtctctataagaggaggaaattgagacatagacctgtacagaggaagtccatgttaagacacaggaagaaaatggtcatctacaggtcaaggagatagacctcggaggaaaccttcatatctgacttctaggcaccagaaatgtgggatatatggttctgctgtttgagtcacccagtctgtggtactttctgtggcagcccggataacctaatatgtatgaaatgtgggtaatttggttacaaggctaacagtttttatgaaaacctttgctaaatgactccacaaatgttttcagtatttctggccaaagctcagattacaatgtgtgagaactggaagtgaatgaacattcttatttataagcaccctatgagttgagatttaggtacttaccttttcttggtgtgtccatttggtttttcatcaggaggcagctcaataatgagctggcaggactgagcgtggtcaaagttgtttggtgtctttggtgagcactgggtgtccagcataaacacctgtatgggggtgcaaaggtacatttcagaactccagtgtcctctgcttgacctgtcagggatcagctggatgaccctgggcaagttgagcctcatctataaaatgaggataatggtttcctatttgatatgtttgttgagagagttaat

SEQ ID NO: 123056 - DNA, 2315 bp, Homo sapiens
tggccacagggatgtacctggatctgtgcttctgcgtctctcaccgagacactgagggagctcccggtggagcctgagcggggcctcttgtcctgtcgcagcagctcggggcctgcgctgaaggaatgccgcatttgcccttggtccatcaagtgctggggacgctgaagcagcggggagtcctggcccctgggacccagtggctctcctttcttctccactttgacctctttggggaacgcggacaggttgtgctgctgtttcctctttttgtattcggtcatcaactttgaaatggtcttgtcggctgccatggtgtagattttgttccccgcattctcccaccactccttcttccggctgggatccttcttctccactttggggctggggggcagcagcaggtccccaccaccggccttcaggctcagggactcgcccatgtgctcccgggactggcttctgtcatcctcggaaggggtttctttcccagagaagcccccggtggatggggtggatgactcggactggaaggagggcaggatgaagaacgggtcgcccttgaagatgggaggctcctccatacagttctccaggtccaagtgcatctggatgtagttgttgcacagttccatgcacagcttgtgcagcctcttgaccagccacacccaatctgcgttgctgacaggctggacgctgagcaagggcatccgtgcccgccactgtctcttctccttgcctctcggggggctgacctgggcggtttcctcaaagatgtcttcatcctcagatgaacactgctgggaagaatccgtgcttctctcgtcgtcctcaaaaaggaccttcttcacttgctcggccgtgatggtttcttgattggtgagaacagcacacaccagggcgtggaaataaatgttaaagctcatcgcagactggcggtagaggttggcggcgcccccgatgccagacactttcttcagcaggcacttcagcccggggctggtgtcaaactccctggcagtcctataagagtccagcagcaggtcgaatatgactgccaagttctgcatagagatgtatctgaggaagccagccagcttggcttctggcacttgtatcgtcttttcctctccaggagaggggcctttgacaaactcttctaacaagatgtcatataagttctggagtaacacctgatgagacagcaggctcaccacaatttccctgaaagacacgcttcaagtgaaaagagagggctcgattaatggttttctgccctatatcaggtgtctcaaagcaatatagacgttacccgtttcagaacgatctatgcaaatttacaaactaaactacctctactcaaatgtcttccatgaaagaaggcatactttttgggcactgtgtgataaccattttaatcacaactagtggagttcttgacacttaaaaaaattcctgaagctgggccgagcgcggtggctcaagcctgtaatcccagcactttggaaggccgaggtgggcggatcacgaggtcaggagatcgagaccatcctggctaacatggtgaaaccccgtctctactaaaaatacaaaaaattagccgggcatggtggcgggcacctgtagtcccagcttactagggaggctgaagcaggagaatggcatgaacccgggaggtggagcttgcagtgagctgaaatcgcgccactgcactccagcctgggcaacagagcaagactctgtctcaaaaagaaaaaaaattcccaaagctatagaatataagttattatgccaaattaatagttgtcaagatatcacagatatcagagagttaactgtgacatcaaaagatatcacagttgaagggggctgggaagtctttttgcccttggggacacagaatatattttgggttttcctattatgacccatcacatgaggtcagatgtggaattttccatttgtagtgtcctgttggcactcaaaaagttggggttagggatgctcaacctgtactatgtttgccaaactttttaatttgccaatgtggttttggtttacagtttcatttcttttcactgctcttataattttatgaaaatagttgtggccattatatggccaattaatgccccaaactggataattataaaattatgacaaccgttattaatttcaaagttctagccatgatgttaataacattttgctttatgtctatgactttgaatgtaaaaatttgtgtaagtaggaaaaagtgcttttctaacagaaaatgacaaatcctgcataaatctcaatgttaactttgccct

SEQ ID NO: 123057 - DNA, 1526 bp, Homo sapiens
taatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttc

SEQ ID NO: 123058 - DNA, 1090 bp, Homo sapiens
taccaaaatttaggaaaagaagagaaagatctcaactttaaggtaatatacttttggctataaatacaggcaactaaaaacaatgtataaactctcattctgcttaggtctgtaaatacatgctaataactgttcgtaactttaaaaggctgccttgaattttgtcttactgttgctgcaaaagagactgtgaggagagaaacacctgacactttcagagactgggagggagggaaacaaagttgggggagtgggcagctgagtcacaggaacagggcaagagactgagctgggcagcctgggaaggtgccactcccctctcagtgttcttcatctcctccctttcttctccacctgctgggaagaaccacctgaatgcctactcattagagactactttgcatcaagctgcaaatacctctgagaagtactgctgtcactcagtgatggttctggttgaaatctgatgtcagtgtggatggctggtaactcgagtgcagagtatgttaggactgagttatagagaagacaatgggaaggtaccaaaacactcttaaaaaattgtaggtcaagagctctgtacacctactcatccttttattcttgggacccataatcaggctagaactagaacagtgtttggacacagtacagggtaaacttatgttcaagaattttggatcccataatagagcatcggggagaatgctgatttccaaacaaacaactaacatactttgggatacagtattcacttttttttttttttttttttagatggagtttcactcttgtcacccagtctggagtgcaatggtgcaatcttggctcactgcaacgtccgcctcctgggttcgagcgattctcctgtctcggcctcctaagtagctgggattacaggtgcatcctaccacacctggctaatttttgtatttttagtagagacgaggtttcaccatgttgtccagcctggtctcaaactcctgaccgcaggttatctgcccaccttggcctcccaaagtaagtgctgggattacaggcgtgagccaccgtgcccagctggtattctcaaattgagacagcttccttt

SEQ ID NO: 123059 - DNA, 1026 bp, Homo sapiens
aaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgtt

SEQ ID NO: 123060 - DNA, 1025 bp, Homo sapiens
aataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcattaaaaatctggtacatgaaacaattgtgtttactgaataaatatatataaatatcctgtgtttacagaattctgtcaaaagaattaggccccttttcatggcatttcataagtctaaatgtaaaggcccattttaaatcctgtaacatggagatagtcattattgacaatttggtatatgcctaaaaaacaaatttgtagaaataatatatcatttccttgtttaaaaaaagggcttattctatgatattatcttttactcataagaacttatatcaaattcctactgtcagtagatattgatgtagatcattcatttaaaaaattaaagtattaccttttgttcataaacaaccaaaaatccaattaataagaatattagtatttaaaagtaatattaaaaaatacagccacttttaacttcctgatcttactagattattgttttaaatacacatatatcaaaatatcacactatac

SEQ ID NO: 123061 - DNA, 1185 bp, Homo sapiens
ttaaatatatatatatatatatatatatatatatatatatatatatatataatttttttttttttttttttttttttttgatggagtcttgctctgtcgcccaggctggagtgcagtggcgcaatcttggctcactgcaagctccgcctcccaggttcacaccattctcctgcctcagcctcccgagtagctgggactacaggtgcctgccaccacgcctggctaattttttgtatttttttttagtagagatggggtttcactatgttagccaggttggtcttgatctcctgaccttgtgatccgcctgcctcagcctcccaaagtgcttggattacaggtatgagccaccatgcaaaaaattttgtttttaattgacatcactaattacattaattgtacatatttatggggtatagtgtgatattttgatatatgtgtatttaaaacaataatctagtaagatcaggaagttaaaagtggctgtattttttaatattacttttaaatactaatattcttattaattggatttttggttgtttatgaacaaaaggtaatactttaattttttaaatgaatgatctacatcaatatctactgacagtaggaatttgatataagttcttatgagtaaaagataatatcatagaataagccctttttttaaacaaggaaatgatatattatttctacaaatttgttttttaggcatataccaaattgtcaataatgactatctccatgttacaggatttaaaatgggcctttacatttagacttatgaaatgccatgaaaaggggcctaattcttttgacagaattctgtaaacacaggatatttatatatatttattcagtaaacacaattgtttcatgtaccagatttttaatgcatttgaatctttattctacaacacaagcaacataaatacaatatcttttaaaatattttctctttagaattttcatttccacctcagataaaatgtacacaaaatacacttgcaagcttgcttacagagacctgttaaacaaagaacagacagattctataaaatcagttatatcaacatataaaggagtgtgattttcagtttgtttttttaagtaaatatgaccaaactgactaaataagaaggcaaaacaaaaaattatgcttccttgacaaggcctttggagtaa

SEQ ID NO: 123062 - DNA, 1081 bp, Homo sapiens
gttgatacaagcacagtgctgccatttcagtactaccctctgctatctgagtgagcaaaaggcatcctatatccagtccatgccctggttagattatgtgttgggagagggaagccttagaaaccccatcagtcctagggtcgcatccaggtgtccactgacacagaggggtgtgcttgactcgcattgctcagcaaagcccgtgttgagatagatacttttgggtccttgttggatggagataacatagggagaactatagttttactactatttttagagattcgatttgtcttaaggattgacttttttttttctcagtacactttgggtaggttcttgtctttgtgattttttttcttttttctcataagctctgttctttcctgggtagcttgaaatctaactgtttacacttaaagtttacctcgtccacgtccctctctgttggcccttccttgtgtttctttctttctgtctttttttttttttaacatactattctctgtttggttgtaaaactccaacgaataaatcatcctaatttgaggaaatgttcactggatcagttcctgccagtttccccaactagaacacaacagattgctgttgaattttgaatgtcaccaacagacagataatggcttcagatggataatgaaatgtttggaacacagatgggcctgtaaatcaattttctttgccttagaatttccttctgacataaagaattaatgtaattaacactgttttataccagtacccctcaaatatggtatctctgtggccctattgttcaattactacattcatctacctttgggaaagatgtgtcactgcttgatagatggtctgcacagtcacccagtgggcgaaaggctaccttgaagactttactgaaaggtgattatttcaaagtaaatcctcctctgagcccttggcagccttgatcttgaagggataccctgagaattccatacgcagcactcaagccataggaggattggaggtacaaattaagagaagtacctgacattcatgacaataattttcattttagagctatcagtaactttttaaa

SEQ ID NO: 123063 - DNA, 1096 bp, Homo sapiens
taagttattcgcttggcgagtgtggatcatttgtgacataataaaaagaacagaccaaccctcttttcctttgggcattttatcatttgtcatgtggaatatgtaggaagcaaaattctattgccctctttgggatccccaccgaacacctcctctgagtagagaagacttctcctctttcacttttacctccaccctaaatggatatcatgttgatccctttaattttatttctacttctctttaggtatttgccttactctgaaacagttttctcacggtgtggctcacaggacagctgcatcagcattgattgaggacttgctaggaatccaagttgtcaggctccatcccagacctactgaatcagatatgggagtggactcagcagtatttttataacaagccctccaggggattctgatgtaccttaatttgggatgccactgctctgtacattggcctgtgaatttgtttaatcaggcagctaaactgtaagcaccttgaaggcgggaatgtaaccctttagtcccactaccctttacaagctacaagttaggattccaagacacagctacccagtttcagagttggtgctcttgactgctgctgctcttctctctcgttggtggcaaaggtgacttgagaaactggtgttgatgcctctgtgtattcattctgtgttttctccaagctagctctgccttgactgtctggaagaagagtattcagaggtttagaaaaaaatggctggccaaagcacaggtcaggagaatcactgaacctggaggttggaaagaaaacataattgtcaccagcttgactttctcttttccaactttctggtggtataagtctagataactttcatcctcctttttttttttttttttttttgagacggagtctcgctctgtcacccaggctggagtgcagtggtgccatctcagctcactgcaacctccgcctcccgggttcaagcaattctcctgcctcagcctcctgagtagctgggactacaggcacccgccaccacgcccagctaatttttgtatttttaatagagatggagtgtcaccatgttgaacaggctggt

SEQ ID NO: 123064 - DNA, 1046 bp, Homo sapiens
acaacctttcctggatttcccctgggtagccccaggaagtccttttctaccttgtcatggaagcttacactccaccattctgctgcttatgatacactatataattgtgtttgcatgtttatctccctacttgacagtaacatccatgggaacagggctttgtcttttcacttgtgtgtccccagcacacagtccagtgactgggactgcaaatactgttgtgtttgtagaaggcctgaaaatgtttggaaaagtcacctaaaacacaggagagagatcagagtcaaagccggggaacaagtagtgagaatgtggagtgatgagattggggatggagagggccagtggtgaggaggggggcggttgaggcttggaagctttactttagggcactgggagggagaagtctgcaaaagagcacaactggggaagaagaaagtttagccaggatgaggcagtcatcatggcgctcacaggtggggagagagtcattgtaagaaaaggctattgaatcggttgttaggtggtgattggtgacctttgaaagggcagtttcaaggaagtctttagattaagaagccagatttcctgagataagaaggatttttataagcagaaaaacaataaaagtaattgttttaaagaaataaaggtgagtgaatgatgccaacagaacagagagggaagggatagtattttgaggtggtggcacggtacagctgatattattacatgttttaaaaactagagcttatgaaaacagggccgtagacaaaaggagtcagcaggaggggaaaggattacagatatggaaagagaatgggaggatgttctctgaagaagcaggaaggaggcagtcaactcagggcaaagcggagggtcggaggttgcggcctctgtctcctagagggaattggggaagcgtgttatgagacggagccagagatcgaggctgttcattacatggtgtgggagccttgcttgcaatgtggcccccgccatattgttagttctttggtgaaaaggatgactttatttggtgctct

SEQ ID NO: 123065 - DNA, 1037 bp, Homo sapiens
agtgacttgtaaaattcagagactttttcttagtacaacaaaccaaacttcttattctaccagatgctgctcctaccagacttctcctaccatgcagtatttgggactttagtataccaaagaagtatttgttatttatctgaaatgtaatttaactggggctcctgtattttatctaattgtggaagacttgactttgggagaaattctgtcattgattcaaggaaaatctagaaaaataattttatcttgtatgtcagtcacttatgaagtgattcattctttaatgtaccaccactatgatgactgataacatttattaaacacttaactctaatgccagatactgttctaagcccactgaatgtattatctcatctaattttcccagtgatcctactgcttactgttactgttgcagatggaaaaatggaagcacaatgattagaaactttcccaagatctccaagttaattagcagtaggaccaggatttaaacttggacagtctgaggctgtggagctcatattcttaactgctacactatactgcctttaacaatgatttatttattgggaatctgttattctggcagaagtgcagagtacaaaggcagggtcctagctctcaaacacaatgtggaaaatactgaggagacaaactaaaaattgctgtatgggaattaaagagggcagataacttctgcttggagagagaaagaatagctatccataggttcaccatagatttggtgttctgaacagaactgtgcagacatttcagatcatggttctattttttgttcctttaatcttttgtaatgcttagattatctaatgtatcttccagtatcttgtatctcatagctttgctattggactatccagaagtgagggcattgttggtttccctttttatttagcctgagtaacctctgtctttagtgacttcagtcttaaataagaagaatggcattcgtttggttcgtttgtaaatggccttggagttgtgctttgagctttgttgctgtcataata

SEQ ID NO: 123066 - DNA, 1063 bp, Homo sapiens
agtcttgctctgtcacccaggctggagtgcagtggcgtgatctcggctcactgcaaccccctcctcccgggttcaagcaattcttctgcctcagcctcctgagtacctggcactacaggtgctcaccaccacgcccggctaatttttgttatttttagtagagacagggtttcaccatgtcggtcaggctggtctcgaactcctgacctcaggtgatccgcccgccttggcctcccaaagtgctgagattacaggcgtgagccaccacgcctggccaagaataaagtctttagagttggtaatgtaaactatttcttttcctgctgtattaaattcattcatttaataaaataatatgaattgcatgcccacagtgtatcaaacctggcactgggcaccttgttgctgtaggttcagtgagccatggcctctgtatcatggtccagatcatgtgtttagtgggagattaaacaaattagtcattgaacaaatcactacaagtagtagtgatatagaagaaaagtataggtttcgatgaaagtgaacaatgggaggtctaaatagagtccaattcagaccttgaagaaatggcaaattaatctgagacccgaaggatgatgggaagagagtgggtaaaaggccaatccactggccctctgtctctttacacagcaactaagataactcttgcttcttcctttacccaccagcccctgtaatcatttgattgccaaaatatctggtattcaagaaaataaaatccaatttcaacacacagggaaacttttcaaaaagttactcatcccagctacttgggaggccgaagcaggggaggattgcttgagcacaggagttggagactgtggtgaactgggatctgcactctagcctgggtgacagagtgagtccctgtctctggaaaaagaaaaaaaaaagttacttacattcatgaataaatgttaggtttattcataaatgtgtggacatttttgtttagtatttgcaaggcgtttcttaaggaaaattttcataaaggttagaaaattatggcactatgtgacaa

SEQ ID NO: 123067 - DNA, 1093 bp, Homo sapiens
gtcccactccctactgcccctccccaccatctgacctgacttcctcccctaaccagccacagaactaacaacgttcgcttcccagactcccttgcagctacagtacaggtatgtgacctaggctgtgccaccctgacccactcattggatgtggatgacaaactgagggatgttaggcagtagctgagtaggttgtctggatctactggcaagcccagcagcactgacctgctctgggagctgcttcagtggctccacaagtgtaggcatccacacttgcgcatgctctgtgatgaccagcaggtggcaacagcagcagtgtttcactgttacagtcctggctgattggcaggtaaacttatcctctggccctcctggagattctgagaactccttaatatctcttaataaataggatttgcttaattaatatgatgaaactggattctattgtttgcctctaagtgctcagacattgctttcatatctgctttaacaaggcactggctgtcttgtttcagtaatctgatgttctttccctaaatactgatagtggttagatcttacatgttctttatcagaatgtatgtgatacttcagaactgtatataactaaaattggggaaaactcagcatttaaaaaatgaatacagagaaagctttttatgtcattgttactttccattcatgggctttaatcatgaccatccagtttctgcaaaccctacttgtagaaaaaaatcagtctgacaatgcaggcaataatcaggaactgaaatattcatccagaattctccaacaacatgaaatcagagagtctggtgagaacagaggctaagtagagtcagaatgtgacagtatcctacctcctggactgttggtgtcgtcttggactaggtaacacacttaagagaggcagaaagtgttatgatacagccaaagagtaggcatgggggaaatcattgtgcagaagatagactgtttacttccatccctttctcatcaacattatagttcaccttggatttaaacattttgtctatttttaaaatttagttttctatgtctctaacgtttttctaaaacacagaag

SEQ ID NO: 123068 - DNA, 1043 bp, Homo sapiens
aagacaaagacgctaatgttagacacatgacagggtagagtgccgttctgaagtgtatctttaagcccaaagaagcgggataaatgctggtggaattcccaaaactaccacgaatgacaaactttatcgatactatcaagatggattctgttcaatttctgacgatgtatcagctgattttgaaattcattagtatagtggttaaaaacacaaggaaaagaggatatttaaattttaaaagcagactttttaaagaaataaatgatataaagttacatttcaaaactcatgggatgtggccaaaactatatgcagagggaaattagtaagctcatatatttttaaaataaaaaagaataaaaattaagcacgcaactcgaggtaaagtataaagaaacattgaaaaagcttatcataaaaataggagaaaaatggcaaacccactggagtttgtttcatatatttacaggtgttctgggtaaaagtagagagggcagggaagtggcaagtacaatataaaaaggaagaagagtgggcactgtgtgtggtaaaataggaagttttgtttatttttccagacagggctcactctatcacccaggctggagtgcagtggtgcaatcttggctcactgcagccttgacttcccaggctcaagtgatcctctcacctcagccttcccagtagttgggactacaggtgagcaccaccaggcttggctaatttttgtatgttttagagacagaggtttgccatgttgcccaggctggctccgaactcctaagctcaagtgatccatccacctcagcctcccaaagtgctgggattacaggtgtgagccattgcacctggctacaaaatagaatgttttgacattatgatctgggaactcaagggcatgtttaaaattctattctttctattttatttttgcccaaatattttctttttttttttttttggagacagagtctcgctctgttgctcaggttagagtgcagtggcatgatctcggctcagtgcaacctcctcctcccaggttc

SEQ ID NO: 123069 - DNA, 1037 bp, Homo sapiens
gatcctaggctaattacctagcatcccttctccaaactctatccagaatgaaaaaacagattgcaactgtttcttctctggttaaaaagtcttcagttccctaccaccactgttccattgccttcaggatgaagtgtaaattccctaacatgacatagaggagcccttcatgacagaatgcctccttattttcttcttgagcttcaattctcagtagcctcttcccccatccatatttcccactgtgttcaccttccttggcacgtgccaggaccctctgccttgagggaatatctgcttctcccctattgcttcaacctgatctttagattagacttacaggattcagttcagatgttacctcctcttggaagttctctataatattccaatgctggttagtaaccccttctctgagttacctatcacagtgtcatacatctgtctgttttcttgtgctaggcaataagaacctagagggtagggaatgtgtattgttcattaccattgataccaagaagcacataaatgttggctatattactttgttaataattgaaaaaaatttaagatataaaggaaaattctggtgtatcatctggtttaatatcagaaaaagaattagccaggtattgtggctcacacttgtaatcccagcactttagaaggctaggcaggcagatcacttgaggtcaggaattgaagacccgcctaagcaacatggcaaaaccctgcccctacaaaaacaaaaaacaaaaagacaaaaaagttagccaggtgtggtggcacatacctgtagtctcagctactgtggaggctgaagtgggaggtcaaggctacattgagccaagatgttgccactgcactccagcctgggcaacagagcaagaccctgtttcaggaaaaaaaaaaaaagagagagaaacaaaatggttgacaaatgaagtagatctaagaaaaacagaaacaaaatggaaagcgttaccctgcccccttatttgaagttacaaaagttacaaactaactgttcttacctg

SEQ ID NO: 123070 - DNA, 1112 bp, Homo sapiens
gaatgtgttttgtgtgtgttttgttatagacaaaagtagctaaaagtttaaaagaaggtttttaaaatcaactcaataaatataggaatagtttacagcagtagtagagaaattttcatgtaaggagttgttcatgtaagggttagaaggagtagaaagggtaaaggattctattgctttaagctttactctgtgaacttaggagtgaaattaatttgactatagaacatacttctaggctgggcgtggtggcgggtgcctgtaatcccagcgacttgggaggctgagtcagaagaattgcttgaacccaggagttggatgttgcagtgagccgagatcgcgccactgcactccagcctgggcaacaagagtgaaactcggtctcaaaaaaaaaaaaaaaaaaaaaaaagaaaagaaagaacatacttcttgttctggccacatatggattataatacttcctaagtactataagatggtgattatatgagtatatgtcgtcattccctgattagtcaaggagtattttctctctttaggcatttattttttccgtcaactctatttttcttccaactcttattacaatgtaattaatgtaggcatgtgagagtgtgtttgtctatgtgattgttgaaatggtgggggtagagggggagatgaatttccttggaactgttctgttcatatctttcagtgtatgtcattctgttgatgggaaattcttgacatcttttcaagttttggaaataaagtggtcctggcttatttgctttgtggattgctcctttgtcctcaaagtctgttcatgaggtatagacgtggattctgtagacccaggctttgcaattttaaccttattttgacatcttaaaacctaccagtctttaatattgaacttggtgtttgggatattcctttatatagtaggtgcaaatttggtgaaattgaaggggtaagaacaaaaaggaacatcacatttttctgtcctcaagcattcaattaattcttactacagagagtatctagttgcagtggatttccaaggagtcatgggctgacatgaatttaagtatttctgaaaaataattttagatgaaaggcattatgag

SEQ ID NO: 123071 - DNA, 1045 bp, Homo sapiens
taagagaggactactgtactgtactttgcagctgaggtgaaacagacttgtgaatgggtatggagaaggatttttccatctttatctgggctttttggcaagagtaagaggatacatagggaggagatatggtttgcctgttttgcttgtataattttgttttgtgttttgccaggaatgaagtcaaattttgagctgatctagacgcactaattctgtgtattatgcaaactaatttctaatttattctcatccccactattttatggaaatcaaaattaaactggtagcacacaagtgaaatcacactggagtggttttgaagacataattatctaaatatttttggctgcatgtgtggataccactccctcttgtagagataataatgttaaactttaacatgatgctggatgttgtaatcctacaagggagagaagtggttgccgccctaaggtcatggttggcaaaggccagacctttgtgctgtccagaggactacaaatcctgtgagtgtgcatcatcttggacctactccctttcacaaagcttcctaggtatttatttttcagtctcagtagcaatgatcaatggtgtcagacaatcataatttcaatggatagttcttattttttcctagtttgaacagtgtgccttttcatgttttattctcagacatacagttgtaaacacaagggctttttaaaattattttattattttttttttggagatagagtctcactctgttgcccaggctggaatacagtggcacgatcccagctcactgcaacctccgcctcccaggttcaagcaattctcctgcctcagcttccggagtagctgggattacaggtgtacgacaccacacctggctcattttatatttttagtagagatggggtttcgccatgttggccaggctggtcttaaactccttacctcaggtgatcagcctgccttgtcctcctaaagtgctgggattataggcatgagccactgtgcccggcccacaagggatttttttttaatatgataactttat

SEQ ID NO: 123072 - DNA, 1087 bp, Homo sapiens
tcttttctccatctgatatgtagacaccaagtttatttactcatttttcatttggttgaaattgcatcccccagatttctatttcatgttcttgtttgtatcctctatatttaaaaagtcaagaaatagtgaaggtaagacgtatttcaattatttaaaaccacttctactctactaaacatttttggccaaatactttaaacgatatttgagcctcattaatgcgaatgggaatgatataaaatgtggctgaaaaagctgatctgaccctctggttttccatgaatttgttaatgaaccactaatatcccagtgcagagaattcacatgactttttactagtttgtgttgaaatgctataatccccattttgcatcctagatccacagtgtttgctcaatgagtattttgatttgcacataggagacctacaaaaatgtttaaatgcaacctgaattaattgaaaatagagattacagaaaattctgtgactcaagaaatggggctcagagaaaagaaaaatagttatttttctacaatgacaatgacaataacaatgacagaagcattgttattccttctgtcattctctaaacattgaagaattgacagaagagtctcactcctgataggaaaagcttttggtactttacatagttactctctattttggttgtaaaatatcagagatgatgatagttttaaagatgtctttcttttctaatgaaatgaaaactcaaagaattctgacttttgtgtttacctaatgagagaaatcaactttagtaattatttagagagagctcttattgaagcaatgaccacacattttcttctctcggtgccatttgaagcattttagtaaatatatgtacacagtctttaaattggacatgtgaagggatccaagtagagttagcttaacaacaaggctaactaacgtgtcagggctggaaggaacctccgagataccctgtctgatcccttgtttggcagctaagaagggaggatgcagaaaagtgagttagcttgctcaaggcctgtacccaacagggcccagtgaggctatgtccttacattcctttgt

SEQ ID NO: 123073 - DNA, 1050 bp, Homo sapiens
ttaactataacatgttctgtcaaattagaggggtttgtttgtttgctttttttttttttagaaacagggtcttgctttgttgcccaggctggagtgcaatggcacaatcatagctccctgtaaccttgaactcccaggctcaagggatcctccccgctcagcctcctgagtagctaggactacaggcacagggtaccatgcctttctaattttttattttattttattttattttatttttgtagagatggggtctctctcttttgctcaggctgatcttgaacatctggcctcaagtgatcctcctgccttggcctcccaaaatgctgggattataagcctgagccaccatgcccagcctagagttttttttgaaaactacagtattttctatcaaatacttcagtttaatctcctaaaggtctgctgtatttgcacctagatgtccgtcctcatagagcgtaggccctcatcagctcttacttggacttctaaatgatcttctgtcctctcttgctttctccactcttgttcccctttgatccatccatgagtctacactgtctccagagtgatcttcctaagatacaaaaaccagctgggaccagtggctcaagcctataatcccagcacctggggaggccgaggtgggaggaacatttgaactcaggggttcatgaccagcctggccaacatggtgaaaccctgtctctactaaaaatacaaaaattactcgggtttagtgcggcatacctgtaatcccagctacttgggaggctgaggcaggagaatcgcttgaacccaggaggcggaggttgcagtgagccgagatctcaccacttcactccagcctgggtgacagagcaagactctgtctcagaaaaacaagaaacagaaaaacccacaaaaacaactggatcacctttctgtagctccccattgcctacagaatggagcttacatcactttacatggcgtgaaactttacgggatctgcctccgtcctctcccctgcagaactagcatacagactcattgctttttcacaac

SEQ ID NO: 123074 - DNA, 2185 bp, Homo sapiens
gttctttgcttcttccagctctggtggctgaatcacttcgatctcagcctctgtggtcacattgccttttcctcttccagctgaaacctccccctgcttctctctttgaaaggacacatgtgattgcgtttatagcccgcccagggctatattagcccgcgctaatccaccatagtctacatctccagatccttaactgaatcatacctatgtatctttttcccatgtcaggtaacatttatagatttctctccctccacccatgctaatacttaaagaattggtaattgtggggctattaattttctaccaagttattgtgtttgccaaacgattgtgttggccaaattcagtggtgtactggagccagcacgtactgactatgggagccagttcttaatttcaagattttagcaggctggttgttaaattgttggtagcttgaaagtggccatggtgggaggctttatatcatggaaactggcaaatatgtattataagtcatggcttcccacgtccctcatccccgccccagagagccagtttactaacacaccactggttggctaaatctcccgactgctagaaaactcagctagagagtacatctcatcccgaagaaattactcaagcccagaggcttgactcaggcctactacttgtttcttgtatttctttttttgcagtatgttgaaagtaactgtgcatatctgtctcctacaacacattttatactcctctaggggagggccctatcttttgtgctttagaatcagtctgcctggcccatctcctagcaagagatcaataaatatttgaactgatccctgtaactgggctctttgccgtttctggaggtgatgcacatactgatgcctagctgcaataattctaaatatatgtatttgcatttctgtctctttccttgtttggaaacgtactcgatatttttgcttcctggatgctcctgattaaagaattttgttactttatattcaattctgttaatagattattaaaagtaaggttcatctgcttcactggaaatcactgcttgtatcaagcaatgtgtcacatatatttagcatgtaggagtagcacagtaaaagtaggctgaattgatagaacgttaaaagtcagatatattcggtgtaagcactatagagccatagtgagtatagttttaaagatagagttaaatagaataaatgctttaaaaggtcacgtaaggtcgattggaaaattctttgtaattttttaaacatctactaggaaaaactgatgtgaaaaaattttccactggcatggagcaattcaattcacctagtagaacccagcagatcccagcctgtgtgtggattatcaggtagaatgtaggctgctttttgatttggctcactgttgattgcactgggctggtctggatcattggattctgaagttctcgtggatggaagcagtgaagatgtcctaataaatgaagaaaagcatacgcctatcagttaataagcttctttcttcccaaagtgaaacagtatggccatatgaatggggttttattattaaccctttaattcaggttgtatactttttgccagtttatacattttacttttgctttttgtgatttagtgataaaggaatgattgctataaaggcctaattatctccttacgctgaaacttgttaagatcaaaataaaaaggtaacatggaaatgatggatggttccatttttttcaccctgtcaaccaacattggctaaatgctggctgtgtataaggcattataaggcaggggtccccaaaccccaggctgtggcctattaggaaccaggcggctcagcaggaggggagctgtgggcaagcgagcattgctgcctgagcttcacctcctgtcagacaggcagcggcattagattctcataggagtgcgaaccctgttgtgagccatgcatgccagggatctaggttgcacactgcttatgagaatctcatgctgctgatgagctgaggtggaagtttcatcctgaaaccactccctaccctgctgtccatggaaaaatggtcctccatgaaactggtccctggtgccagaaaggctggggaccactgctgtaagggacaggaagatgacagatgagcttcctggcctcaggggcattatagtctagcactgtgctaact

SEQ ID NO: 123075 - DNA, 1064 bp, Homo sapiens
ctggtatcaatagccccttacctattccttttgctgattatatcctgcacattctcaagttcaaaaagataggtctgagtgcctcctgagtgctccatgcttgccccatacagtcactaggtggcagtattgctgttctttttcttgagaggaggcgattcccagaggattgcccgagatcaatggtcaatacacaggcctgctgaaatcaggattagaacccagccctgcctgattcaaatatttgtgctatttgcctctctctgtgttgttccagcatatttttgagaggggaaaggaaaagactaaagctttgcttcttacattatccagtaaaattttattgaccatccacaaagttaaattttttcttaaggaactgattatcactgatggacaggtgaggtgtcagtggtctgacatcagtaacccacggtgcaaaggagggaaatcccatatgaccaggcttcctggtactatgccgattctcccaatggagagggtaaacagccgcttcaagggtcagggatgatgctgaagagtatggagaactggggagtccatacagacaggttggactctgttgttggggatgaaatggaaggcagaggagcttgggtttcatgaggcagaggccccgggatagcagtttgacaagatcagggctggagttggtggttgattgggcaggatgtgtaggccaaaaggaagaaccagagggaagaggggcaggggctttcctcagggagtgaggggaaagggagaaaggaggggcttgactctttgtagttttatgcaaagggaggttatctttgagtttgggagggaaggtggaagtaggcttcagggaaaacctaaaggtttggaataaccagagcaacatgaaaggtatgagtaggccgggcgcagtggcttacgcctggaatcccagcacttttggaggccaaggccaacggatcacctgaggtcaggagtttgagaccagcctggccaacaaggtgaaaccctgtctctactaaaaatacaaaaattagccaggcatggtgatgggcacctgtagtcac

SEQ ID NO: 123076 - DNA, 1022 bp, Homo sapiens
ctagagactattttaaaggattatctcatggaagctttcagaacttcccccccacccccgccaattgaatgtgggtgagaaacggacgtgaacttaaaaaacttaccaagcttggttcacctctcaggagcaggtctgcttaaattagctgcattgagctcctcgatgtccttttgcggcgctgctgattctttcaagaaccttggctaccttgccaaatgtatcactcctttataatcttaagcgttttaacaaatgaaatacagttcagtttctgcacttggttttaaatgtcatgatgtgtctcagcaatccacttagtccatcaaaatcacattttgacttgtccacataatccttttagactgtttctggatttattaagtgctttttcatgcagttgatgaaaaagctttcattttaaaaataatttccacatgacgctggaggcctcccattgtagtttaacaatagttgagatgttgtattgtttattcaaaactgccaagtagcgtcagtgctggtggatgggaaccctggatggaatgctgggagagccctggggaggtaatttaacctcttcgttgttcagtcctgatgtccagtgggtttcagcagcgtgtctaggtttactccattgccaggcagaggtagattctgcctcctctgcccctttgcattccttggatcgaccattgactactggaaggcattcagaccattacctttctatgccttttcctttgcataagacctgcaaaggaaaacatactttcatcctggatattttttggttttagcttccaagtagggtttatggcctttttttctcttggggttgggaagaagggcagtgttggagaggaagagacccagaaacaccaccatgctaataataaggaggagaaagtcgggccatgttggagtccctctgccaattatacagatcgtggcacataggtgcaagggtggcatggcaacctctggacccctcactttccactttctcttacccattgtct

SEQ ID NO: 123077 - DNA, 1054 bp, Homo sapiens
gcaatggtgcagtctcggctcactgcagcctcagtctcctgcattcaggtgattctcctgcctcagcctcccaagtagctggaattacaggcacctgccaccacacccagctaatttctgtacttttagtagagatgggctttcaccatattggccaggctggtctcgaactcttgacctcaggtgatccacccaccttggcctcccaaagtgctgggattacaggcatgagccactgcgcctggccttacatttttttatattgtactggttaccataaaacactaaattatgtagaatttgttttgaaaaaaatatgtaatagaatccaaaacaattaggtagctcagaatgttttcttaggttatactctgtgcctgggtcaagaggtaacagacaaataggatccaaattttacagctagatgacttggacacacagagagtaggtgacttgctgatgattaaacagggaatctgatggatctccaggccctaagctctgaccttggactcttgcactttttgcagtctaatgtttagaaacatatgggtgaacctgaattaaagagaaatacatgtaagtccatttactttaatttcattttcattattgtacttaagagtgtgaggatgcagtcgtctttgaatgaaggcagcattcagtattagtgggattgtttagcttcacccaccctaccacaaagagatgaggaaacgctggacgttgttttagtctggtcagcaaatccaaatctatgagcattgtggagaaagggtctatgttcacatatatttttagtagttcttagaagaaagaaaaatgctgcttttttttttttttttttttcttccagatgaagtcttgctttgttgtccaggctgctagagtgcagtggcatgttcatggctcactgcagcctcaaacttctgggctcaagccatcttctgacctcagcctccagagtagctggggctacaggtgtgcaccaccacatctggctatttttttttttttccaagatggagtcttgctctgccacccaggctggagt

SEQ ID NO: 123078 - DNA, 1042 bp, Homo sapiens
atgaagttaggaaagttggtcaaggccacatggtcagttgtaatggtggggcttgagcagcctaattcttgggctgtgcgtgagccccagcggtgcattgccagctttcccaagcagcctcgactctgcgtctcacattcttcctgacatccacattcctccatagctttggtcccagctcacccttgcaccatgtccagcaccatttctatgagctttgacctatgcattctgcccacccttggaggcctaagcaacatccatttgcttgtctgcctttcttagccactttatttgtaagtaatatatttattgggaactctccagcacatattgtctgtatcagcatttcttaatctttggggatcgtggaccctttacataggcattattctccctaacaaaaaaagtgtatatagtgtatgcatgtaaatttgcatgcaatttcatggagttacaaatactctgaaaaccagtttctctttacatgcctagcatcttctagtaaccaacagagtagatgggcaagacagtggggttgaatgaaatgttcctgtcgtgtaaatgtctttcctgtgtttaagatttcttcctaatcccctaaaagggagggatggtctcaatctttgaatatatttgtatattatgatataactggcacagttatttgtcttataaattatggagctttgtttgtagtggcagttgaaggaggccgctctgctttgttttttgccaaattattttcattacaagtaactgcagttcgtagttagtagtcattgatcaggaattttctttatgggaagttaactggacaaagtagaaataaaattttcagtatggataacaagttttatcaaacttaataggctcaagaaaggatttttgtgctacagatcctactgtattataatgatgcctattttatagagaaagcaggaattattgagttcacattgagttgaaactcattttaaaattttcaactccattttttatctgtttcaactgacttggacatagagaacttgaaaatgac

SEQ ID NO: 123079 - DNA, 1044 bp, Homo sapiens
ttcaaaggtggttttgaaaaaaataatcaacgtatgtagtttacaaggcttcacagtgtgattttttttttttggtgggagtgggcggggagacaaggtcttactctgtcgctcaggctggagctgcagcatggcttaccgcagcctctaactcccaagctcaagcgatcctcccacctcagcctcccaagtagcttagactgcaggcatgtgccaccatgccagggtaatttaaaaagattttttgtagagacagggtctcactgtgttgcccaggcagttctcaaacttctggcctcaagcccagccagttagtgtaaatcttttaatcaaaactttggtttgtctactttgggggaagtaattgtgtactactaaaaaaatctgaaaaatatgtaatgtgttatttctgtagactatacaactttatgaagcctggttttgtagaaatcaatttctacttactatgtgtttgcttattaaggtttgaagcttcacatatggttagaaagaaatccacttaccacaaatgccttctgtaacaattgccacaacaactaaatctgtgcattaaattcaggcatttgcttctctttaagaaatactgatgtaaggccgggcgtggtggctcacgcctgtaatcgcaacactttgggaggccaaggtgggtggatcacctgaggtcaggagttcaagaccagcctggccaacatggtgaaaccccatctctattaaaaatacaaaaattaactgggtgtggtggtgcactcctgtaatcccagctacatgggaggctgaggcaggagaattgcttgaacttgggaggcggagggtgcagtgagccgagatcgcgacactgcactccagcctgggcaacaagagcgagactccgtctcaaaaaaaaaagaaagaaagaaagaaagaaatactgatgtaaaattattgggcaacaaataaatttggtgctttcaggacataataggatatgaccgtcattgaaataattagtagtgaagattccttgcttcctcatttacagctcag

SEQ ID NO: 123080 - DNA, 1030 bp, Homo sapiens
ttataccaaattctcaagtttttagataatgtgttttatctttaagatattttcagggaatatctataattgctcccaggagtagatagagaaaagaagtaatttgacagtgcttccagatggctcttaaaaaaataatacattccttcaagttcttgattcctaatactatggattttgttgtatctccaaacaaatcaagtaattctgatgtaagtatgaagctgctgtaacccagatttacctttattaaaacagatggtacaaaaaaagaagaaaagtattttaccatcccctttgggcacaaagctcaaacttatttatccccatccaaaggcagtttctctctggtttggcctgacttctgggagcccagaactcttaaaagatgttttcttgaaaatagtgagctcttttcttgtctgtcctagtattcttggccgagtttcctgtattctggctgctcctactcattaatatgcagcttgatccatagtggctgggaagacagcagagggttggaagttagtgcaatgaaagctcctatgcgggctttctgaggaaagatgcaaatgtacccaggaatagtgtacccaagtttcattttctcaggtcagttgaataatcgaagctttcaacagatttaaatagaaagtttctttttttctttttcttttgatgtagattcaattaggacttaactttcctacctccttgacagtaagtatacttttcttgttgacaataaaatgattaattaagtattgcaggtatctttttaatttttaatttttgtgggtgcatagtaagtgtatatgtttatgaggtacatgagatgttttgatacaggcatgctatgcataataatcacatcatagaaaatgagctatccatccattcctcaagcatttattctttgtgttacaaacaatccaattatactcttttagtttaaaatgtacaattattgactatagtcactctgttgtgctgtcaaatactatgtcttattctttctatttttttatac

SEQ ID NO: 123081 - DNA, 1214 bp, Homo sapiens
gtgcgatcttggcatctcagctcactgcaatctccgcctcctgggttcaagtgattctcctgcctcagcctcccgcatatctgggattacaggcacatgccactacgcctggctagtttttgtatttttagtagagacggggtttcaccttgttggccaggatggtcttgatcccttgacctcgtgatccaccctcctcggcctcccaaagtgctgagattacaggcttgagccaccgtgcctggccaagactaaggctttttaagaggaacttaaatgcttagaaatacatgtcacctagttagacctggaaatataataggtgtggaaagtcaaattgtcttgagtgcagaatgaagaaatgaagttttacaccctactaaatttaatttcactgagcaatttaatttttccttgctccagtgcagttactgaacttgactctgtggtagctgtttagctctgcaggcaagagaatgcagaggaaatccttgaatttcaacagcctctccctgtgagtgggcacaagtgcaactgattatccaaaagtagttgcttaaactaatttagactatttagctaacctcaatcccagtgccgatcttatgttgcttagaaaattacctgttggtgattataataaatggaggtaattaaaattttaaaaagtgatggaacattctgcatgtgggtgtatttaattatctggcaggtgttcatatttctacagtgtgaaacttgtgcataaacaatagcctttctgttagaaattctgttcacacttttgtgtttctccccttttagaggtaggtattttcaattgcttggagaataacagtgatgatctaactaatttgttttgcagtgtgtgtttcctaagtggttatatatttttttgcttgttttacttcaactgattctaacttttcttacttgaattactcttattcagtaattgcatcttcataaaaaatgatatgaatggaaacatgattttctagattttaaagtaattttagaaaaattgggcttttaaagttctgtgatatagccataccttaattttttttttttttttttgagatagagtttcactcttgttgcccaggctggagtgtaatggcgcgatctcagctcaccgcaacctctgcctccgggttcaagtgattctcctgcttcaacctcccgagtagctgggattacaggcatgagcc

SEQ ID NO: 123082 - DNA, 1097 bp, Homo sapiens
atgatgtgtctacttgctaggctatagcgcccagatgtttggtcaaacatcagattagatgttgctgtgaagcaagttttttttcatttgaataaagctgggtgggcctcatccaatcagttgaatgtcttaagataaaaagctaagtttccccacaccctgaccccagggagaaattctgtctccagactgccttctgacttgagctgcaacatcaactctttgctggggctccagcctgctggcctgctttgcagatttcagattagccagctccgacaattgcatgagccaattttaaaaataaatctttctttttctaggctgatcagtagataaagatagagctacagattggtctgtatgtttgcctatatctttctgttgatttgtgtcatattcgttctgtttctccggaagaccttgactaatacagattttcacatagctagagtcaacattgtgttttctatttattgagcttgttctttagcatttagctccatccttgattccttgagtcctttgacagacaattcctctctttccaggcagttatctgattttccttttgcccagtagtgctctgtgtgtacctctcttaggccattatgttattgtaattcttggcatatgtgttttttccctaaaactaatctgtgaacttcttgcacactagaagctcctactagcttgtgtggcttgggtacccagcctacttggcgcgtaagaatttgtcactgtgtgtttgttgagtgaaagattagctctgatctaactcttaagtatgacactaggaaagaaatgaaaaggagaaacattaaaatgtaaagtaaatgtgaccaaaaagccaggagaggttggcaagcacatggtgaatatcttctggatcttcccctggaacgcaggtgtgaaatttattgtggtgatctctggaacaccacagtgaccattatctaatccgcatttgtttgtttttcaaattgtcaatctttatccagacttgactttgcccagtgatggctagataaagccagactttaaaatatttcagagacatttcaggaaaacacagaagtatcaagaaggacaaataa

SEQ ID NO: 123083 - DNA, 1021 bp, Homo sapiens
cttttcttttttttgagatggagtttcgctcttgttggccaggttggagtgcaatggcaccatctcggctcactgcaacctccgcctcccaggttcaagcgattcttctgcctcatcctccctagtagttgcgactacaggcatgagccaccatgcttggctaattttatatttttagtagagacggggtattttgtatttttagtagagactaacccctgacctcaggtgatccatccacctcggcctcccaaactgctgggattgcaggcgtgagctactgtgcccagccacaatttcttttctaacaaggtctctcactctgtctgataagtcaccaggtccccatgttcctggaggggctgcccatgctggtttaacctgtggtgtgtgtccactaaaatgaattctttctgagtggtcctaagtgtaccacacagtcaaaaacaaagatgttagaatatttttttgatttcaaaggaagttaaatattaactattaaaattatagaactgtataaaattacagagctatgaagaaagtagtgaacttttttcgtagtcctaaccctcagatataatcaccgttagcagttggtacataacagaagcatttgaaaatcaagaatattttctaattatcagcacttcacttgatattctcctgtctacattaatgttagtgagaaaatagaaaggacatgaaagaagagaagataatgaacaaaatatacattccctgagcaggcaattaaagagtctgaaattctttttgttagctgttttgcattttgatttacttggaatttggtgagtgaatgaaattctagaagagaactgaaaacattgtggttgaacaaacattgacattttgtcctccttttcttttcctctttagaataatgtctcaagtatatgcatttccagtcagtcttttctagagaaattatgtaatgctgagtgatggttatgcgatcctccttaattttttatatacagcttaacagcagtttcattgacat

SEQ ID NO: 123084 - DNA, 1021 bp, Homo sapiens
taaagattgtggtgtgtatgtgtgttttaacaaacagcatgctgaccattaaaagcccttcccacttgcactatgcagtctttgtaaaaggatctgaatgtttatagaaccctgcaagcttttggtaaagtacatgtttttaaatcatgttaatcgtgtaaagaaaagacagacttgagcttgttaaaaattactcctgtcaagtgccatgtagcttcacatgtcaaacatgacttgaaaatgttttccccaagtggccatgtcttaacaatttatgttccagaaggagtttcttggaaggaattaagtaatgagaggtcacatttttctttcaagttcgatttccaaagtgaaaattaacttctgttttttaacttaaacttgaaaaaaattcagtgagagcctttagacttgtgcaatgattgtgttatatggaattgggcctccctatctctgttgccagaaatgaaacttgactgtgtgttttttgtttttttttttgtagctgtaaaaatgaagaaatagaagaagtaaaaaatgctgagtctgggaaactgttctagtcacttaaatcttagctacataaatgtgtgtttatattaatggggcaggacaaaataagaagagtcttttttttttttttctggttaaatactgccccctcacccccgcccaccaagtattgctttgcaaattcctcagactttctcattgaaaatatatgaatagctaaaagtgagtatttagcatgattagaaaatatcatacagtttttacagtgaaattccaatcaagttactggattccaagttacaggaattccagttggttattcattttttcttgatatttgagctaatggagaagagagataatagaaataatctagaaacattatctatctatctatctatctatctatctatctacctatctatctagctatctatgagacagtcttgctctcccagattggagtgcagtggtgcgatctcggctcactgcaacctctgcctccctg

SEQ ID NO: 123085 - DNA, 1328 bp, Homo sapiens
cttaatttttttattgcttgatttttaggaatagtttatgagcttcccaagagatgattaagcctttcctatattaagaaaggtaaagggggctgggcacggtggctcatgcctgccatcccaacactttgggaggctgaggcaggcagatcactgtgactcaagagttcaagaccagcctgggcaacatggtgaaagcccgtctctacattaaatacaaaaattaaccaggcgtggtggctcgcgcctgtggtcccagctgattgggaggctgaggctggagggtcgcttgaacctgggaagcagaggttgcagtgagctaagatcacaccactgcactccagcctgggtgacagagtgagaacctgctttaaaaaaaataaaataaaagaggaaaagggaggagaggcttctgttaaatgtctgcaacaacatagttgggtttatttaaaagtaggcattttctgccttttaatctagatatccacatgctaaatgtgaattgctttctgacttaggagtatgtttgtatctagaactgtgtttgaattttagtgtggaatgttttactctgagatggtgacttcatttgctaagtaaatgcaattggtcatgagtcctgtttggtgtatttgatttcactgggttggttttaacaacctgactgcggtgtactaggtggtgctgcgacagtgcagagtgacactgacagacatttgaatagagcagccgtggtcagtggagttatttttctctagtggttagccagtttaagaccaaagatttgtgctgaattactacagaaatgactaaaaagagcattattcataagtatagactcagacacataatcattgaattacgtaacccactatgtaagttttgtgtaaataaaaatacatcaacaagttttcagtcttacaaagtatgccgtaaaatgtttctgatgataaaattgaggtatattcatcctaaattccaaacttgtaaagtgcagaaaatataatgaagaaaaaaatcataacctagagagtattgcttcattttctctctttttttggccaatatatttatatgtttggatctatctatatttaattatagtaatcaatagcattttaaactgaagtgggtgcatctttctctgttcatgagaacagagaaatttgtgtcctgaattttgaaagtgtagcttatatcatgagctattcccccatgttgtagatatctagaggctgttttaaaaacgagaggcattggggtgcatctctctgacaatctgttttggatcccaagtaaagcccttttgatgtcctcaggggtctgcg

SEQ ID NO: 123086 - DNA, 1088 bp, Homo sapiens
aacttgacgggctcagcctgcacctcggctttcctcgggcatcttggaacgtgcagcagctgttcatctccgggttacccacactttctgaatcatcggagtcactgggagcttggtgaaaaacacccccaggtggccccgcccctggagattctgagtcagcgcagccgggtgaggccaggaacagacctccctagcaaggacccccaggtgattccaatgaggcgaatttgggaaacacccatctaggccgtgtgtgaggcatcttgtttattcagggcggcaggacattcatccattcatccattcctgaactgtattttgagttattctgttagtgctaagtggtgaggattacacagggtccttccttgaagtacttgacagtttcatgtggatggttagatatataactaaataataaggaatagaatgaccatttataacattgtttctggaagaaaatctgttctgaattccaaatcgccaatttaaattgcattttgagactacatcaaacttagaaaagctgaatgtaagtttctgggatgatggcactcctacacatataaaataatgatttcaaatgtttacagcatattttatctaaaaattaaactctgagaaacaaatataaacccttctggaataattttatttttcctttgggatggtggaaattttcttctgttttattttcacttacccttttgattggtttcataagacatttccacccatgtagaaaagcagttaccagcctggccaacatggtgaaaccccatatctactaaaaatacaaaaattaactaggcttggtagcaggtgcctgtaatctcgggaggttgaggcaggagtattgcttgaacctgggaggtggaggttgcagtgagccaagatcacgccactgcactctagcctgggcgacaagatcaaaactccgtctcagaaaaaaaaaaaaagaaaagcggtatcttactttggaaggatagacaatggttttagattattcctgtagggaaatcctttgttatactttacttcccctgcactccctgttatgattaaaaattgttaaaggtgttatc

SEQ ID NO: 123087 - DNA, 1026 bp, Homo sapiens
ttcatagcttcctcctcagctttaaaaagtgcaatgtcattatggaaagagaattatgtttaaatgcatttgccaaatattcagatttctaggagagttattttttgaattatgagagtatatcctttaaatcaaaacatcagtctcctcattgactcttgggtattgggaaaatgataacctgcttaaaaagctacctacatttaggttgaaattatttatctagccgtaatctagttttctgctatattaaagaaaaccctaatattaacattttagctgtatatattttaaaatcgagaatagcaaatgaaaaaatttaacaaaagagaaacatttgagtttcttaatattttggggagaaaattcagaaacaaaactaatgcaatatttgcctctggcagtcattttattatgtttaaaaaaccaagtttttccagcagtgaaggtgtaaaaagaaaaaaaaaatcgttataagtataaaataaaatgacttgcacctaactaggcccctagtaacttacttaattctgtttctcctcaaattggtttctatcctggaatgaatgacttctgcaggaactgaagttcagatgcagcaggagggtactgaccgccatcttgttccacatgccggtttcatttgtggtctgcacttgtcacagtgtgcacttcagctgcactttgggcaaaggtagaagagctggagcttctgtgtttgactgaggaactctctgagaaaaggagcttacaggccccccatgtttgtttgtttgtttgtttgtttttctgagacggagtctcactctgttgcccaggctagaatgcagtggcgcgatcttggctcactgcaacctctgcctcccgggttcaagtgattcttctgcctcagccttctgagtagctgggattacaggcgcacgccaccacgcccagctaattttgtatttttagtagagatggggttttgccatgttggccaggctggtcttgaactcctgaccttgtgatccgcccgccttggcc

SEQ ID NO: 123088 - DNA, 1077 bp, Homo sapiens
ctcagcctctagagtacctgggattacaggcgcccgccaccacgcccggctaatttttgtatttttagtagagacagggtttcgccatgtttgtcaggctggtctttaactcccaacctcaggcgatccacctgcctcgacctcccaaagtgctgggattacaggtgtgagctaccacacgtggccccatttttttttttttaataatcatgcaagaaggctttttattgaatataattatgcctgagtataaatgtacatgtagagaagaaagctgactatcaagacattaatttttgtggtttctttcaccttcacacactttgcttttttatgtgcttaaaagcagtgaaatgcctatgcattaccatctgttaggattcttttaaaacaatgcctcaaaccttgtttctgtgtaaaaactacagtttgaagttgttctgccattttaggcaggtcttcagaatatcatactccattagtatggatggctagacttttagacttggaattgaccgtaaaggccatccatttcgtgaattcttacccagagaggaaatccagtccaacagcattgcagttaattcaccccaggttaggctgtgggtaatgacacatccgggcctgaagcccaaaccttctgattgtctcgcctgtcgtcccactgcctgtgttccttccctttagaagagtgtggagccaggcacagtggctcatgcctgtaatcccagcactttgggagaccaaggtgggcggatcatttgaggctaggagttcaagatcagcctggccaacatggcgaaaccccgtctctaccaaaaatacaaaaattagcgagactgtctcaaaaaaaaaaaaggtgtggaaatggggagcaaagtttagatatgttccttaaacagtcctaaggataactgtgaccgttaattccacccttcttgtcagataaaccatttaatgagtctccccaggagcaattaacagaatccagcagtttaccaaaagcctctagcagttggggacagcatatttcagtgaccaataatagctttctaccataagaaaggatgtgagaat

SEQ ID NO: 123089 - DNA, 1051 bp, Homo sapiens
ctagggccatcactcttactctttggtttgttttctttttttttattttaagagacaggtctcgctcagtggttcaggctggagtgcagtggcatgatcacggctcagtgcagctgcaacctcctaggctcaagtgatcctgtcacttcagcctcctgagtagctgggaccataggtgctgccaccatgcctggctaattttttaattctttatagagacagggtctcactatgttgcacaggctggtctcgaactcccggcctcaagcaatgctcctgctttggccttccaaagtgctggaattactgcgtccaggctataatgactctcttaatagctaaatctattagcagacggaaataattgatgctaccttattacataaaatagagcatttataggacggtgataaaattaaagcaagcatttcttagtgaaacaaaccattgttcctgattgttcatcaggtaatttatcataaaattatttttcctttatacacatgtggagttatagacatttatgttgaatgctttaaaattgtctttagttttctctcatattgccttagtttgtagtaatttagagtaattagagtaatatgagtaattagagtaatttctcatgttgtcttagtttgattacttataaattattcagtactttctttcattaaaacattattaataatatgatatttgaaaaggtaatattctttattgaagttaaattagtttatgttctcatagcacattttttgttgatctgaataagttatgttacttggctaacaatgcccagacaaccttactattaactctagcaatctaggatgtagaattgtgttgagataagtagaagtcaaaagaaataaaaggttggaatcagtgaagaaattaaacatcatttaaattatcaacatgtccacctgagactgtaattgagaaggaaaaaagaggatcagaattgagtttcaagaagcagcctcttaactttcctatctttaaaggatcaaacttgataaggagtctagagtgtttccttgacaat

SEQ ID NO: 123090 - DNA, 1030 bp, Homo sapiens
gtctcaaactcctgggctcaagcagtcctcctgcctcagcctcccaaagtgctgggattccaggcgtgagtcaccacgcccagcctgcgttgtatttctattgaacagtgttgctctaaactttaggtattgctacaaaattaatattcttgaaacatcactttcttcctgccatttctattttttaccattttttttaaaccatgtcaactattttaaaggttcttaataatttggtcacaacctgtatgcacatgctgttgtatttttcattctttttcattcccctcaggctggttttctggatgcccaagaaacacatcatgttcattctcatcataatgcgtttgttcaggttgtacctcctacctagagttactctcacctccttgttctccttatcacgttacattcaagctgaccacttccataaaggatttcatttgtaccttaacctagcattctgccttatattattatctgttgatttttacatgtgttaaatctcagccttccaattggacaagaatgtctttgatggcagtgcttatgtctgtacatttttgcaacctctgccatacatgtactgcaagcatttagttgccttcagtgtattcatatcattgaattgggtcttgaaaaataagtaacaggtggataaatacaggtcagtgagaaaaatgaaagacagtgattataataagggatgagtaattcatgcaagattcccgtcctatttccagtcttcttgaggaacaattaagagaattatagaaaagattttagagctgtaatgattttatttttggacttttaaacagaattgttttcccaaagatgataaagtggtgtcttctcaaaagatttttttaatctagtgtcttgtcatgtttgtctctaatcagctccttactatgaaaatgattattgacacattaaaaataactctgggccaggtgtggtggctcgcacctgtaatcccagcactttgggaggccgaggcaggaaggttgcttgaggccaggagttc

SEQ ID NO: 123091 - DNA, 1061 bp, Homo sapiens
gtaaaaataatagaatactatttctgaaacattgtccttttgaatgaatcttttgcccagaggagaaagagctgggacttcatcagtcctacagaggagactgtgtgaagttgtttgggcttatttactaatgtttgtttagaaaaactctaggtatggcatcatttgatgttaggtactttcactagaacttggtggtgaggttgcaggagagggtaaccttcggatgtcttagatacccagcaaaaatatctgagagtggtgcatgatcaaattggcatattttaggtggagtacttgcttcctgttctttcttacatgttttcctgccagtctcttttgatcagccattttttctctcctcctcacctgtcagctactcctgcatctgtgggtgcaaagcagattgttaacggactctccccatggagtcactggaaggagacaggcatcttcctggctctgttgaaagaggctgcaaagacagggcacagataaacaggcccttcagtcaatgttgaaaaatcagggggaagacattttatgatagtcattggctatgtttctttttactccaactttgcagctttcaagataagaaaataacagaccagacctcacatttataaccactttgtgcatcatgttctaggctcacgtatcataaaccaggcaattttagttgtgaccactggaggtcattagagatcttatggtatattttgaagcagcttaactcaggcctgactttttgtcactggaaattgcatcctttgtccggtaactgaattcttttttctgtgagacaagaatataaaactaacctgttcagtgaaagtactttttttttttgtttgtttgtttgtttttggatagcagcagcatttcttcagagagcagactgtatttcatagtttcatgaatgttagtataaatttcctttaaacattttttttttgagatggagtcttgctctgtcgcccaggctggagtgcagtggcgcgatctcagctcactgcaagctctgcccccggggttcatgccattctcctgcctcagcc

SEQ ID NO: 123092 - DNA, 1028 bp, Homo sapiens
aaaactgttgaaaacataatctttagcaattaagcaaagttgctgatctagaaaagtaagaagtacaaagaaaaacttttcttagtaacatatatatagtcaatatggttttatttggaaaaataaatcgtagctacaaagagatggcaaagaggctggcttagtttccattacagtagcattatctgagaggaaaaacaatcagagaaaatacacctgaaagcaaactttcatttagatactaaagctgcaaatttagattaaaatgtaacacgggctgaccaacaacagaaccaaattgctttgttacaccgacaccactcattttcctctttaaaacacccttgattcctatcaagtagggctgagagtgatgcagaaactatataaatcattgcttctctactcctaaatgccaagggccttttagaacttgggaaagctggcacaactgtgaaactggtaagggaaaatattctttgtagatataacaaaagtgctttgacctaacatagttttgaagcagaggtcacttgctaattttagttaatatagcagcgtcaccaaacggtagcacatttggctctgcggagagaggaactggcctagcagagcacagcagggtatgaacgctgttgctggtaatagggaacaggttttctttctttttttttttttgagacagagtctcacactgttgccaggctggagtgcagcggcacgttctcgatctaggctcactgcaacctccgcctcctgggttcaggcgattctcctgcctcagcctcctgagtagctgggactacaggcatgtgccaccacgcccgactaatttttgtatttttagtagagacggggtttcaccatgttggcctggatggtcttgatctcctgaccttgtgatccgcccgcctcagcctcccagtgttgggattacaggcgtgagccaccgcatctggccgggaacaggttttcttctttttctcctcctctgccttcctttcctcctgttcatcctccttttccct

SEQ ID NO: 123093 - DNA, 1610 bp, Homo sapiens
ttagtagtataataccatgaagatgaaaattttgttaatgcatgtttttctgaaccagggaagaccattgaaacaagtatatagaagctattttgaaaaattacttttttccttacttctgagaacagaaaatgggaagtaaggtacaaaatagaggtagttctggttaaaacacaatactgtcaatttgaaagagaaaaataggaaagtaagtaagttagaatatggtggctaactgaaaagactgcctaaaatcaacattgattaaaaattctgaatgcaaagttattctttgggaaactaaagctcaaaatgagatctaggagttgatatagccagatgtcatcactagggaaaagaagctacattaacaaattcatctaccagggggcgggtttattgcaaaattcaggtgttaatacccattgttgcaaacagtgacttttctaaaaactagacattctatttccctgatttgtgtaataagaaaatgtttgaaattactaggatcttattttaatattaaacatataaagagactacatttcagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccattgcagtccgcagtccggcctgggcgacagagcgagactccgtctcaaaaaaaagaaactacatttctaaagtgaagtatacttttaaaatatgaataagctctcccttagttgtcttgacaaatttaaattgttttcttgaagcagagctgttgttagatatttcttcatttttatatactttgaaacataacttggcctttgcatctttttcaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggagggtagattgtgtttgttggcacacccaccttttctgttccctagcatctgggatatgcaatgcttctatggctaataccacacaccaatttaatttatagaatgggctcctcatttacatctcagtcacagactcagaaataaattgtcagtttgtccttttatgtttaatattttacataaagcatctattctataaaaatctttagaaagagtttcccatttaattttgattttaaagaattatattggataaggtggttttcaccataagctaatttactctctgcagccgtctacattcttcacaaatcatgtggtacattgaagcc

SEQ ID NO: 123094 - DNA, 1030 bp, Homo sapiens
atgtttttggttttttaaagagttgcctagctttccattactttataatgttattttattcactaagatgaatgttagtatttttgagtaagaaatcctatggtgataatgcatagatatttctggagactgcctttgtttattgttgaacaggtatatattgattctgtatcatatttatgttaaaactgtgaatattacagtcttgcatcagtatgttgctctaaaaatacttatattgcaggtacattcatgattgtggtgtcaactagaaacatcttttctcactgtaatttaagttagctcttgccacaaatatatagatttaaagtaggacaagtaactttcaattttccaagagcaaatggcttaaagaaagcaaatggtgttgcaaagtgctaactatgaatgtcttcaaaaatgcttattattaatggaattcttgtcttaaagagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccaggtaatcaaagctattcctagacacatttaattactaggaagaaaaagcacgacaattaaaagtaatcaaactggcccaggcgtggtggctcacacctgtaatcccagcattttgggaggctgagctgggcagatcatttgtggtcaggagttagaccagcctgaccaacatggtgaaaccccatctctgctaaaaatacaaaaaaattagccgggtgtggtggtacacacctgtagtcccagctactcgggaagctgaggtaggagaattgcttgaacccaggaggcggaggttgcagtgagccgaggtggcaccactgcactccagcctgggcaacagagcaagacttcatctcacaaataataataataacaataatcagactgaagtaaattatggtcagactagttctttaattgagcagagcc

SEQ ID NO: 123095 - DNA, 1071 bp, Homo sapiens
ttgtttgctattatgggaataggcaggagtatgccaggagggcttcatgtaatagaggtaagaagcaaagtgagatctgatgaaaggctgtgagatttggtctttaggttacatacagaccatgtaacaagttagtacttgccttctaatacttaacaaacattcttagaaatctttatcatgtagtcacattcattcagcctatttcttctattaacaaagtgattatacagttactaaaaagaagaacttttgtattcatgcaggacaacaacaggctggagttgttgcccatcctcctgcagtgcctccaagaccacagccctcacaggtaattctccaaggtatttattactaaatgtcccatgatcactttgcctgctaggtatttaattctattctcaaattatttggaaggtcaggaatgatctgttggtaatctttaatgagcatttaattcagtgaggctgaatctcattttgaaagatgcacatttcaagaatgatctgagttattttttgaaagagccttaaaagtgaaacaaatgataatgtcttgacagagaagagtttagtggaaacaacaatggattgggagataggaaatatccattaatgtcctgggtctagcagtgactcacaaaatcacttcaccaggctgggtgcagtggttcacacctgtaattgcagcactttgggaggctaaggcagtaggatttctcaagcccaggagttccagaccagcctggacaacatagtgagacccccatctctaaaaacaaaacaaaaaaattagctgggtgtggtggtgtgcacctgtagtcccagctacttgggaggctgaggtgggaggatctcttgagcctgggagatcaaggctgcagtgagctgtaattgcaccactgcactccagcctggatgacagagtgagaccctgtctcaaaacaaaacaaaatacccctaaataacctcactgcatctctctggatgtgtttaccacatgagttaaggaagtataatgacctctgcatcccttccacatcaaaattagagtgctgtagtagacatttat

SEQ ID NO: 123096 - DNA, 1422 bp, Homo sapiens
ctaaatgtttcagggtttctcaaaggtagattttttttgtgtaagtcagcgttataaattaacttactttacagtttacatatgtagtgtttaagtgtgctgcaggaataaaattaagtgtgaacatgcaaataaactttttcattataaactatcttctattatggcagaaaataaaattataaataaacagttttacatttgtttttattaaaaatattattttgtcttacattttatggatttacctgccacttctttggatatttaaatgaagtcttacactctgagctttatgagtttatcagttcaaatacctatgtcttgtatttttacctattaattctctattagatcatacaaatcccactagcccattacttgtgaaaccatctgaccttttagaagaaaataagataaattcatcggtgaaattcgcttctggtaatactgtaggtaagtgaagtattacatcttccatttgaagtttactaagtctggatttagagtctgactatttcagatgtgtatgcatttaataccgtcttcactagataaagtagaggagagtgaaccctttcgaacactttgccctatcagtgaataaatggttgcccattgactcctgcttcaatgcaggcttcctgtttgccatccctctctgtgtagccaggtttgatcttatggctcttcctcagtggttccttccttttctatcacacaagaaattgtgtatactttcattcagccagtgttaattggatacagtatgccaggatctgttctaggcactggagattgaacagtaaaaaagtctttgctgctatagagtttacattctgtaagggagataaaagggagataaaaaataactcttatattagaaagtaactaatactgtgaataaaaataaagctgggaaagggtggagagagtgccattttaaataggatggtcaaggaaggccttaccaaaaaaatgtcatttgagtgaaaacttgaaggagatgaattcagctgtacaaatccagaaggaaaattaaggcacagcaaacagcaaatgtagagccctaaggcaggacctgcttttactagaatagcaggcaaatacctggaatagaattagttagcaaatttggcagggaaaggtagcagtggtaggatagtaacaggaggcagtgtcagactttctttgacttagatgaaaagccaatcgaaggtttgaatggaggagtgacatgatttgagcctgctttttaactggatcagtctggctctcctaatggtaataggccaaaagaaggcgagacaaaacaggacacaatttaggagatagcggtaatcaggcaagggaagatggtgacagcttggtgtctagggtgcaagcagtggaagtgatgagaagtggctggactctggctat

SEQ ID NO: 123097 - DNA, 1031 bp, Homo sapiens
ttaaatctgaactttgtttcccaaccagtattcttactttaaattttcggttagaagagtagcctgctttctcttagttgtgtcctacagtgtctaagtttcttaaccttcatttgatacttacctgaagtattacccatctacagacccactacagcctgtagccacaatcccacatgatcctttgcaaggctttatataaataaggattataagtaagtaaataaggcacattcagattacaagggaatcacctggggggaaaaactctactcttctattatgaatttaacatttcttacagtattggaaatatttaacagactattaaaaagaaactaaattgtaataattagccatttgctcagtaaaagtcagtgcaaagttccaaactggtctgtagcatttagagacaaccactacacagtgcagtgaccccatttgcaaaccagatggttagttattaagctttcatagttctgatgaaattgagattctgatggtcttgtttccagaaacttgatctcttttcttgaactgcttgtcagttagtagcctttggtagaatctgcttctgctaggatatacatgaatgaaaacacaggaaaattgtaggtggatgagaagtgtaatgcgttagtctttgctgtgattgattgcactgcaaatatatgaaaatgctagttaacattcccagctgttccaagctttataaatctgattttatatacacatacacatacgtcgaatatagattagatgaatgttatgaattaaagcatctaagaagtttttcttttttaaaatttctaatttgctttgtatttggaataagacttattttctcatgaactatcatttttttctcctttgatcttgccttataaaggtaaattctgattttcttaacagttatttctggtattaaatgtaaattaagaaaatagtagagttgctcctaaagccatgtttttataaccaacatataacttaatatcttaaaggtattcttataaatactttcctgagaa

SEQ ID NO: 123098 - DNA, 1272 bp, Homo sapiens
atgattttttttgtgtacctcttttagaagagtagtatttcatatcaaaatacatctgtatataactcatgctcagatgcttgatttgctctcattgtggccgcattctgatttttctagcatggggtagggagtggggaagcgggggtgtctgattggcagttctgtcttgtggtctggcatggccctgtttgtagtgctgattgcaggggttgacttgctacagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgttttattttaactctgtaaggctttaaatctcttccatagagattgcaataaatcattactatacttttgattgtgaactcctcaccttacattacaagtgacccagaataaatataaaatgttgacggaaaaatagaaattactgaattttgttaaacctatgaaacacaacttgcagtgcaacctctgaattactttgctaaatcttctccagtgatcttttactccatctttctcatcatgctgacttgtctctcctctgtctgttcagcagtgggagacatttagtgaacgctcttcaagctcacaaactctgacccaatttgattctaacattgcaccagctgatcctgtaagtcaatcacttagcttgcttgtttgagattaattttattaacccaaatttccattcattatcgtttttagctgatatgcatgattcagtggagtgcttagagggaagtggcggcaggctttttggtttttgtgtgcttaatggtgggaaagacattttttgccattccttttttctagttattttgttgagagaaaactacgtttttaaaatctggtacatgtgtctagagaagcattttttgtgacaatctattttgttaaccttatcatttgctaattaagtgtatattttatatacatactgtttatttcagtgtagtgactctttatgtattatctgtatgcttacacatcatgtaatatg

SEQ ID NO: 123099 - DNA, 1541 bp, Homo sapiens
acaatgatattgtaatgatatttttgatatgagttctaaaccgattaggtactccctgttgactggggttatattcaaagccagcttggaagaatcggaatgagagtttagtgacctttgaaatttccttctgtttttaaatataatttagagttattttaaattaagcttaactatgcttaaaagtagaatatgatacctcaaaatactttaaaaaccattttgaaatagtataatggatttgtaactatctcagttaagtctgtaagtgctagtgagcttaataataaaagttaagtttcagacagagcttattgactttgcttttttcccgtggctggggactctctccttctgctttgtgccttgcaagtatgttctgtttttttgttaacaagggagatttgtagaggatatatgagtgaattagtataaattggcagttcccaaagtatattccaagggaatactgaaggattttatttgatgaaaaggatgtgtgtctggaaaaaaaaaagtgatttaaacaaagcttattttaaactttgagacatcacaagtcttgatatacaaatgtgcatacggatgctccaacagagaattattgtttccccaaacttacttgagcagaaaacctaatttttcaaagccaccttactgatgagtattccatggaatagaatacactttgggaaactggtataaatctatttctgttatcagaaaattattttaaagcatgtgacctattgcaatattattatgtataaccttctttttattcctaactagattttattttcatgaaaagctgtggttttgagtagaccataagtagcaggaataagtaatgtctgttaaaatgcttactctgagaacatgaggaaaggagatttagattatatattactacttatgaaaatcatcggttggcttttttttaataagtaaatatgcctaaaataaactacaatgtagtctttatagagaatttctctatttttaaattgcagatgttggggatcagccaggtgaggtaggttattcaggctctcctgctgaagctcctccaagcaagtcaccatcgatgccatcactaaaccagacatggcctgagctgaatcagagcagtgaggttagcaaagctttccttttctttcattaaaagttaactcttttaaggtaagatgttccaaagagggcaatttcagtctgtctcttccagcatgcatgcataattgagagaacatatcagatatactatgataaatgtttgtaattatgtgactttttcgaggttttcaaagtatatattctgtcatttgatttccaccacttatccccattaaaaccttgtgagtttagagaggcagattcagaaagtttaaccatcaaaaggtaaatgacttggccaagatctcatatccagtgagggacgagagctaggatttgaacgtaagtcctttgatatctagtcaactgccacatccactgtgtcacactgccttctcagtcctgtaaacaaggtatgtaatagtaca

SEQ ID NO: 123100 - DNA, 1037 bp, Homo sapiens
gtgagatcagcatgcatatttatttatatttaatgcttatgtatgtgggggggggtaaggaatacaataactgtaagtgaagaatacaataactatattttgtcgccactgccttgattcagtgcaaatgtcaacatgggaaaagcattattacaagaatagttttcacctttcaggtctcttttaaaagagtcttggggactcttaggggtctgtggtccacagtttgaggtctacaactctaggaaaataactctattgaaatagcggtaaagtataattatttgggtgactagcatttcactttgcagcctcaagcagctagacccacttcagctttgtaccagtgaaccagaaatattcccagaatctgtcccaaatcataactgccctgaggtgggggtgtggtacagcttggccctaaatttgtcagtagaagaaatcatgagaactgtggtcttgaaaacccaaccaggacttgcagattgccctaagattgatgtttaaaaataaagtaatagagtcttgctttaaataaattctttcgaaaattagtcatcttgtagttaatactgttttaattctgtttattttcttcagtactcacctgctttggggaatcccttgaagatacttctttattattctcctggtagactttcactttcagtatattgtcaaatttatagctactgtttccctttccctttgttatcactggggataaagtttcataatttttttttcccaatgaaaactatccaatgaggaatttgctactattgtttatcctaaataattttttcataagttcttctctaagaactttgagttgaggtcttcatagaataatatgtgaagtcttcctacttctgtactacccagacacttctattgagaagatataggacttaagaaagaaataatttctgatcttagaaaacaaaaatcaatcagaatacaattctggactgcagattagaacttgcaatgtggtataattataaaggtataacgtctgggtaagtaaaaaggaa

SEQ ID NO: 123101 - DNA, 1074 bp, Homo sapiens
aaatacagtcttaaagactaacatttgtgggtgggcaggaagctctttgttggagtacttatttggagcaaagttgaaggaggtacagtttatttctagactgaatggttgtccatagactcttggtttctagaacataggaaagaagcaatgcgtaatttgctaatttatcccagaaacaatttttggattttctaggacagcaatttttcaaacttttaaatctttttttctttggttggtttttgttgttgttgtcgtcgtcgtttatttcaatgtggaacaaacttttaaatcttaagacccctttaggcattcttaaaatttgtggaccccaagagtctttgtttacatgggttaaatctatcaatacttacattattagaaattaaaactgattaatttttgtttttactttatgtaaaaaagcaataacaaatccattacctattggcataaatatttttaggaaaataaccatattctccaaaattaaagaaaaaattgtaaaaggggtggcattattttacatttttgcaaatttcttttacatctgtcttaatagaagacaacgaaattgtcatatttgcttccacattgtctgttggatatgttgttttgtttgaggtataccaggggtctaaaaactaagccctgtgagatagatccagcctactgctcatttttgactagcccacaagctgagaatattttttctttttaactgttgaaatgaaaagaataatattttattacacattaaaaattgtatgaaattcaaatttcagtgtccataaaaattgtattagaacacagcagtgctcatcacttatttatgaattgtctaggactgcctttgcaccataatggtggagctgaattgctgcaacagataccttatagccacaaaacctaaaatagttactatctggcctaatatagaaaaagtttccaaattaaatctagcctcacacaataaaaggaaggactatttcatggctttttcagataacgtaattattctttggtactacatcaaagcacaaatggtatttcttaaaggttacttgcagt

SEQ ID NO: 123102 - DNA, 1008 bp, Homo sapiens
cttgaacccaggaggtggaggttgcagtgggccgagatcgtgccactgcactccagcctgggtgacagagcgagattccatctcaaaaaaaataaaaacaaaaaataaagtacatacatggtgaattttgataacataaaaacagacttttgaaaaatttcactaacttattacgtatgccttctaaaaatgcatgtgaattataggtcattctttttggtgaccttaattattggggctgctttttagagaatttcaaacacacaggaaagcttaaagaagagtaccataagcattcatatactaccacctagattctggaggtaacattttgctacatttgctatattacacatctttctgtgtatgggatttttataattactgagttcttgcactttctcatggaaaatatttctcttgcttctttttgagaaataaaaggatccaaagcggaatgtgattatattcacaataaacttatcttctagggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcaggtaagattgggagctgaagagagctgtttgcatgccttgataaacataatgcttgattctgaaagaaaaatcaagatagaggttaaccttagcttaatagcttagatatttcatcaagtgtacatagatttgtcatcagaataggatgtatgggccaagcttgaatttgtcttattcagtctatttttaaaaataaagatgagtaatatataccactattttacctttgtatttgtgacttgccgagatttgaagagcatttcagtgtcttgttattttgccatcctttaattgtgatatatattgtctcgagtggatagagtaacccatcttcattataaacatttttctctttaatacat

SEQ ID NO: 123103 - DNA, 1069 bp, Homo sapiens
tgagtaggtggggattataggcttgtgccacagaacctggcttagagattttttgaaagtaacaattatttagggttgtaaattgaaggaaacttgataatattccttcaggagttgcctcccagatagtttttaattgtaagtttaagttaaatagaagcaaaaaccaactatggaaatttgtaagtggatacattgctttgaaaagtggtaattgcatttatgtgtatctgtgatgtttagacaagtttatggataccagattctctaaaggtaaaatgaataattatttcccagaatattatgtatatattacatacattttattgacaaggagagcacaaaataattgaagatatttaaatgaggtataatttctaatagaacagaaaagattccattttggaaattgttagatttcttcagagtaagagttggaaagaaaacttcctagtaacttttttcctcaaacatgagtcagcatgtttacccattctccttataggttcttctgctggtgatgcagtgtggtcagggcattccccacctccacctcaagaaaactgggtcagttttgcagatactccaccaaccagtactcttttaaccatgcatcctgcttctgtccaggtgtgacattttattggtattgcatttttatttgcttcattcagagtattgctccagtcgttgtttttatattttgctgttgcagattttataaatgcaaatccactcatttatttaaaagcaaaattctgctctgtgcatttcaaatctgttatcattggaatgtttcagctgattttatttctgtttctgattccctagtgaagttttgaaaggtttctgcatctggaaatatatttgcttggctttcttagcacattttcataactttctgttgcttacataattgctgtcattctactcgtttctataatcattgtgcaaaaacatatccaataatctgactgtaacagatgtgtggttttacattttaaatatacacaaaaagcaagttttactttcaaagataaataacctagcaatcttggtccatataatc

SEQ ID NO: 123104 - DNA, 1254 bp, Homo sapiens
tgtgggaattacaattcaagatgagatttgggtgggaacacagagtcaaaccatatcgaagtgttacatcagataatttgtttttcaagtatttagaggcttgttgatgtgaaagaagatagaaattctataaagaaaggcacttaaatgcagagggttctttcattttcatagagtaaaggggaaagagaaaaattaagattttaaaaataatctgtacagaaaaatttctgtaaaattctgtaaatatcagaatttgtagaaatagttttaagtaccagtttagtttattggtcggtagaggttttcattgtggacctctagtttgccacacatcattcttctagtgttgggagtttacattcttttcaggtaattttgaattcttttacatgtatattgaataagcttaatagtttccttccttcatgtggaggttctaaacagagacgaaagtaatcatgtaatggaggtaagtacgctttcctctgaaatgattttgtagctgtattttttctggtctaaaagtatcacttatttacctgcaaacagtttctcagtccttcatctttctcctctatttaaaattgaatgtagaatatctggctgtaggagaaacataagccagactacagtggatagatagaatactctaccatatttttggggggtgaacaataaggtatttttaagaatttctgccatgaaaatttctaaatctagtctcagacttagtgacatattctgtgttttacttagaggtctaaaatcttactttaaagacccggtgtgagtagaagcagcctaggctttggggtctgactgatctaggtttatatcttaactgtcagttactacaagcatgaccttggcatcatggagcctcagttttcttatctgtaaataggagctttgcaggggtactgtggttacgaggtgaaataaatattcagtggcaagtatagggccaaacatacgtagacatttgatgtagccattgttatcactcattagaaggacaatttggttttattacttctttctagataagagtctccctaaataatgtaagggagatggtggtccaaattttgtggtgatagacattttgtgcctcttgtttctgtatccatttttacaaaaattctaatatctaattcatgtcttattttagttttcaatatatatgtccttttttattttgaagtaatgattattttgtggttaacagtaaaggaccttcctctgccaaga

SEQ ID NO: 123105 - DNA, 1041 bp, Homo sapiens
tttttgagtctaatatttacttgtgctagcaagtctagaaatacttgttgaaagactggaatgattaatgtagatccttgaacactttcatgctctaaaaaagacaaattttgtttgttttaaagaagagtagtgtagccatattaaacacatttggaaaataagagggaaaacccgactcaatctcatctgaaaaaattgtgatagacttttaaaaaatagtttccaaatttgtatttatgtggttaaaattaggtatcttgcctttcttccccacttgataaatccttagtatttttccatgttgttatatcatttaaagaccgtcactttaaatggctgcataatagtctcttagtcacatggtcctattgtatgtgcagtgcttatgaataagagtgggtggtacgttgtttctttaaaaatgtgactcataacaaaaatttattctaagaaaattgctaatcatatggattttgataaataggagaatgatgaccttattgcaaagcagtgactttttgtttgtaaacatatgaacctgaaacttgaggaagttggttgtcagttgtgagtattataccatctattagatagatattttgagacgttacaaacaagttgggtagctgcttatttttgaagggagatttttgttgtgaatcttaatgttaacattatgttattttatagatcatggagctttgtggtgcaacaagacttggttattttggaagaagtcagttctacattgctttgaaacttgtagctgttgcccagtctggtttccctttaagagtggaaagtataaatacaggtaaatatagagtacactagtaaccgaaagaaaataggcttctattacaaatgaagtcaagtcaatagaactcttgtgtctttctgatcttatagtggcatttgtgaccttgagtgaagtgtcgtgactttattcccactaccttgcatttctcacttgaaaatactagaaaaatatgtctgacctgtattacggcatagtatatgtacttcatctgtatttga

SEQ ID NO: 123106 - DNA, 1032 bp, Homo sapiens
ctgcattccctcctccccatcaattctacacacacttacagctacactctggtctttccttcctgaggatgctcagtaaatagtcattgaataaatgaattaattccatgacagtttgcaggtcaatatgtataatataataaaaccttttttttttttatgagatggagtttcagtctgtcacccagtctggagggcagtggcatgatctcggctcactgcaacctccatctcccgagttcaaatgatcctctcacctcagccccccgagtacttagaattaccagtgcgcaccaccacacctggctaacttttgtatttttagtagacatgggtttcaccgtgttggccagactggtcttgaactcttgatcccaagtaatctgccctccttggcctcccaaagtgctgtgattacaggcatgagccactacccctggccacaataaaacttcttaaaatgagtaaagaagattaacagtccatttaaagttgccagagaacaagttgggcaagtcaggaaaagaaatgcaaatggctaacaaatataaaacttttaataaataccaattaaaacagcattgagattctgtttcccttcttgaacactacctcctcatttctaaccatttccctggtgtcttcccaaaatgtcaacaaaccatactgtgatctccttttaggtcttccctctgtctagcatatacctggcatatgttagttgcattgttatataaacaaaagtatttaagatatgtaatgaacctctaagaggcgtcaagtgggcagaagagtagaggattggggctgcatgaccttgcctttttaaactccccttttcctcatagttcccttgatggtgttaacctgcctgtttattctctttgcccttttacatttcttcagaaggacatgctccttagtggcaggaacaggaacttcttccagtgctggtcagccagcaaaaatgactcttttttgtgtatgtaaataaatggctgttattgttgtgatacaattgcttaatcatta

SEQ ID NO: 123107 - DNA, 2192 bp, Homo sapiens
aacttaacaactcgtgttttatgatgtaacatactaaaactgttataatgcagcttattagatgaatgtactactgggcaaatatgatcccttataaaataatgaagtgacaaagagcatgggtttcaatctaagttctgtcacttgctgtgtgtccttgagcaagtatggtcagttctctcagctataaaacagtacctacctcatagggttgttaggatgattaggttagttaacacgttacgagtttgggacagtacctgacacattgtgtgtgcacagttaatgcttgtcattattataataatcatctttttgtcattctcaccctgtgataacccatagcacgggtgtagtacattatcctaacagtggaatgggtttctctttatcatattataagtaaagaaatttccctgtcccatttgctcctgcttgaccagtggtaacaaatatataccagaaattatatcatgcttaactctatttaaccacggttctactcacttgagatacttgagagctccactgtattctgtgcacttaggaataattgtgggctcctgcttctcccactagaggagcaatagtggcaacatagtacagttggtaagaacacactctggaatcttcaacttcatcacttactgtgaccagggcgaattactgagcctctctgtacttcagttttctcatctgtaaaataggatagaaatctctgtccttctgggctaagatgattaaatgagctataaagtgcttaaaatgatgcctggcccactgtgtttaaatgttttattgtaaacttttattattttttaaaatttctgattaggagtcattgtggttctggaataatcaagtttcaatgtaagaaaagagaggtttgattattagtaactggttcttgaaaaatactactccttaatcaaaacattaatattttatgtggcatgttgtaaggcaacaggttgcaggtgttgtctttccatgtcaccttacacactttattggttgaatgggattatttatcttcaatgagttttacaagcaattatgtctgggtttgcttaagacagtcctggtttatgcctcttgtttaggcataattataaacagtgcctctttcactctacacatgtctcagtttggatgtaaattttatgatcaccctaagtatacgatagtgatcaaattaattttattggactatctccataccctatcgtattttctaaaggcaactagtactatttcaagcttcagttttaggtggttgtagtatttttcaaactacttttgcgtatttgtggtttttctcctttcttacctttaatcttatttgttttttttttaaagcctttttgtcgttgttgttgttgtcattgttaatgtagataatacaaataattattttaattgggaatttgagacctgaatcaaactatcaaactttaaaagtagtcatactatttttcacattggagttcttatgtttgaggctatcagaagtgttttatttgtttagataacaatgacagtgagactgattatgagcagtaaaatatttattggcctgtatgtactacttttatcagagtagactgacagtgggagtttatatttcctaaagcaagaatttatagctaaagaaccaggaatcacatattgctaaggagaatctctttaaccacatatactatgcagaaattgaagtcaagaactataaacttcttaagctgcttcagtccccttacattggttgtttgactgaacccattctttatgattcccttctatagcagatagagtgaattctaccctccaaatattaagaagcttctaggtcatatagcagtaatctatattgtgatggtgagttctcttgatgaatgtctatgaaaatattagtagaggaagaagaatatgtatatatatttgaactttctgtgctgaaaagttacagaagacatttctagggtttttttttgtattgagaaatatactgtttttatatttatatactaatacttgtatagaaaggaaattcttatctcgtacttatgtaatttttcttgtctatttttaaaatttttccttaactgacaaaaattgtatatattatacaacatattttgaaatatgtatacattgtggaatggctaaattgagttaattaacatacttatttt

SEQ ID NO: 123108 - DNA, 1042 bp, Homo sapiens
aaccattttgatgcttaaaattacagccttgctgggtacggtggctcatggctgtaatcccagcactttgggaggccgaggcagatggatcacttgagcccaggagtttgagaccagccttggcaacatagtgagaccccatctctaccaaaaaaaaaaaaaaaaattggccagctgcagtggtgtgtgcctgttagctgctcaggaggctaaggcagaaggggtttgaactaaggaggttgaggatgcagtgagccgagattgcaccactgcactccagcctggaagacagacctgggagacagagcgagagctatctcaaaaaaaaaaaaaaaaaaaaaaaaaaaattacagctttgtatcatagattgtgtgttgtttgcaactagggcagaaagtttttaagaaaaagggttctgtgttaaaattttgttttcctcccagggccaagtgtatattttcaacattgtatgtaagtacttaaaagaagattttgatgagatgtttctataatgctactaggtataataaccagtctgcaattcagtgttagcacattctatacaatattgagaatacatgaaagactgcagatacgggtgtgtacttgaatcaaggagaggcagtagagcagccttatgttttgttccccaaagagtgagatgtgtacccaattcttgcacatagtgaagaagctgttctcttttttgttgtttgtcacatctgattattcatggagaaagttgcagcttggggctagtaaaatttttttttaacaccgttctcatattatttgctctcttcttttaataaaggacagataggccttgatgtggctgtaagcacatttagcagacagtggtgtttggctgaaattacagttttgttttcattgaatatatattttttatctctatttcaagtgaagtagaattttccatttatacatgatacaaagtttcttttaaaataagtttaactttaaaaaagtgtctcatttaaagaaaaaatactaagtacataatagtgcaagtggtccatg

SEQ ID NO: 123109 - DNA, 1001 bp, Homo sapiens
taacaaatgacctgatttcttctctactgcctgtaccctggcctgttcttaagcactagtaatctaacttttatttttatttgctgatttatcttctgagacagggtcttgctctgtcacccaagctggagtgcaatggcacgatcttggttcactgcacctctgttacctgagcttaagcgatcctcccacctcagcctcccgagtagctgggactacaggtgtgcaccaccatgcccggcctttttttgggtatttttattagagatagggtttcgccatgttggccaggctggtctcggactcctcagcttaaaagcaatctgcctgccttggcctcccaaagtgctgggattttaggtgtgagccactgtgcttggtgtaatttaacttttatattccccctccttttttttttttttaagatattcttaaagttcattgttatcctgatcaccaaatccagtgacctttcacttcccttgcaactggcagtgaatcacttcttggtggatattgtctcttcttgttcatcgtggagctgaaatactctgtctttaacgtcctgattgtcttcctactgtcttctttggagtcagctttgactcctcttttccatctatccaacttacaaagtccttcagattctctttgaaaggacttagccaatcgttcttttctgttcttagtgttactctaatccaagctctgaacacctcattgatgaactactatagtggcctcctaaatcttaagcttttctgtgattgctgaagaatagattagtgaattataaattatatgctactcttcagaaatgttcagtgaaaattagtgtggcatttagagccttcatcatctagcttcagtgtaccacctagccaccactacagtccttgcattgacctactggcaccccgaataggattgcctctcttgttttgactgaccaaaaaactgcccattctttaaggtctagagatgaggtacttactaaaaaa

SEQ ID NO: 123110 - DNA, 1991 bp, Homo sapiens
ccaactctattctgtatgtttgcacttgtatacaatttgtactttaggttattcttcctgtgtatctgtttcccttgataggtggcaaaaaatttgagggtaagttttagccttgtttgtttcctttattatcactttgttcctgttaggcactcactcaaaacctattagactgcttagttggtgctttagaacttcattcctcatcagtacattgatgggtgctagcctagcctcttcattttatcataccacttaaaaaattccaaattataattaatgagtttttttcagcagtatggaactctgagaccagactgcatagtgctttcaattagcctgtgaatattctcgttaatacttttaaagttggtcaggtgatgctagtcaaacactgagcatgcttgctaataactttaagcaatcgttacttcaaggctgttctcttaaatttttttttttttttttttagtggtattgtgggtcactttagtagtaaactcacatgtatttctctgccctgcagaggcataattttcaattgttgaacttgacagtgagtaagcagtggtagacaagcatgtagtctaaataagaaaacaggtcagtggagtttctcatttaatttagttaactcttttggagggaaggtatagcattcccataaaatgaatggtgataacagagagcatttcaaatctgattagtcatgcgtaatcagccttaaaagcttctaccaactcactgctacatctcacaggcttgtttctgattattctcctaatagggactgtgtgttccttcccagcagatctgtttttctgtttctcacacagcttttacttgttctttatctattcttttttatcatgtaacttccctcagctacaggactctctcctcactttcgtgcttattccgccccccttttcaaaacatggcttaattgacttttgtaggttttggaaattaatttgaacaacttcactctcactgagaccagtttccctcctgcctatccttttgtatatgttttgtactgtattgatttttgttcatttatgctgttgcttggtgtgtatatgccattgcttggctgcttctccagtatctctatatcccagcaatattgtgagcaagttgtgaataaaactcagatttcttttctttcttgatgtgcagaacagcaaaaacacataatagatgtttagaaaacatcggcagctttttagggcaagccatttgcttagccctgcttggctgtgcattcatagacgtgattgggatgatgacttaaagcaattctgggctcctcacccagggaagtgaaaagtgggggtggtgaagcttcaagccttggatgttccactgcctagcactatgggtactctctccccaccccaatcaacattctgggcatgagaagagaaggaggcagtaagaacagaacaatagcacagaattctctgagctctgacttcgctgctttgctgacaagacattgctgctttcccctccctccctttcaggatctttttcccttacctacccccacttttttttatctatagcagagtaattgtaagacattttttaaaaactgataatttattggcaactaaagaaataaattatggtagaatctggacaccttggcactatagcgtatacttttttttttcataaaatataatgaggcaaaacttctacagagttccagtgtgcctggctgcaagtggaggcccacaagtcaatttagagatgagggtgctgggttgagtcatggtacactcacaggatttcacacattccctagcacagtccactgagacatgtgccacgtcagaattacagattgtactacttgtcattatctcataggaatagtagaaactgcagatcttaaaactttgaaagctaatgacccactgtattctgtgccttcattcagaacactaaagaattaatggctggtggaagggagcttatgg

SEQ ID NO: 123111 - DNA, 1364 bp, Homo sapiens
ctattctgcaataaaaaagaaacaaattagtgatatatgttataacaaacatgaatgtcaaaaacatgtctctgggcaatatagcaagaccctgtcccaaaaaattaataaataatattagctaaatgtgatggcacccgcatatcattgaagctattcttggaaggctgaggaaagaggatagcttaagcccaggtgtttgaggctgcagtgagctgtgttcacgccagtacactccagcctgggtgacagagcaagacctcatctgtaataacaacatgctaactgtcaaaccaaatacaaaagagtacatattgtgtggttacatttatatggactgtctacaaaaagcaaatctatagagatatagcagattagtggttgcatcaggccagagcaagagaaatggtatggaggaaaatacttgggtgatagaaaaattctaaaattagattgtagtgatagtgctctatacactgtataattttcttaaaactcaatgaattgtacacatatgatggttgaattttatggtgtataaattatacctcaaagctatgaattaaaaattacaaaatagtcatcttggggaatgtaaaggttgaatgtggtggagaatgaaggactgtgtactgcttacatagtttaattacaaaacttcagcataatgtaatctggcattttgataaaggatttaaattttgaaagatgatgtactgatagatttttatgtgtagaggagattgccatatctcatcttccaagattcattagaactgagtatatttacattacattacattagcatcaagctaacatttattcactgttctgtgtgacagggaccgctctgcgtgctttatatgtgttattttacaagtacattatttattgaccttagaaggggctaaaaataatatgatttagaatgaagaccagtttccatctattgacctttggtggtatgatgaatttttgtacacttaactcagatatcttaatattatgggaaattatagaaatataatacctcaaagaataatgcaagtttgaagtagtcatgactgacaagtaataattttaatgaaatagtagtttcagtctacaggactattttgggttgctttgtccactggaataatcaccgtcactatcatgaatctttttgtgggccattctaatgttacttaaagggactgatttggtgtctttgtattttgaaatagctgtattcaatctgagtttgcataaggagctagatcttggtcccaatcctcacaattataatagcatgttcctgtggagaaaaaaaaattgcatgaagtgattattgcttctttttgtccatgggttatgcaaaatgt

SEQ ID NO: 123112 - DNA, 1922 bp, Homo sapiens
gtgacagagcaagtctccgttcccccccccccccgccccacccacaaaaaaaaaaggaaaaaagaactgtgtacaataatagagaatcattgggtggtagaatcagaggaggtagtggggacctacttaggtgtaagggaaggccccttagaggatgcctggatggggggtcaggggagggagaataaggtgtttcatatagagagaactgggaagggcctgaggctgtgaagagcacagtgtgtttaaggaactgaaactgtggacaagaggggagaatggcagggactgcataaggcaggcccttgtactcagtgataaggaatttggattttagtggaaatatactaaaagtttttattcgggggtgtagcatcatctgaattatattttaaaagatcatgctgactgctgtatgagcaaaaagaatactgggggcaagtggaagcagatacgctagtggatatgcaacagtccaggcagcagacagcaatggcttagattagcgaggtggcagtaggatagagagcagtggacatctgtgagaattttttaggtggtagaaatacgaaggcataaatagggttggatatggaacataagggaggggaaagaactcaaggatgttgctggaagttgccactattggatggttggaagaggagtggattttgggggggattgtttcgtgggagaggtaagggtgaattcagcagttccccttttgtctatcttagttctcagaagcctgtaagattgtcaagtaggcctgttagagagatctatacatcttgaggaattcagagatacttggcttagagatgtcagtttgaagattgtcactatgttagtgatacttaaggtaatgaaataattgaagaaaagattataaagaagagagaaagattgactagaactggaatcctgaggaatgctgaacatttctaagttgggtaaactggaaggcttcttggaaggacgctaggaagcacacaatcagagtggtacaaattgggaatgtgtaatatatagtattatcatgtcgtggatgccaaataatgcaagtatttcaagggggtgggtagtcagctgtattgaatttcactgagaggctgagaacatgtgggcaggaatgtggccattggatttggcaacctggaagttattagtaacttcagtgagccagtttcatggactagtgtagatggatgccagatttgagtgatttgagggataaatgatggctgaggaactagagacagggtgtatagatagcttttaaagaagtttacctatgaaagggaatagatacagggtagaagctagagatgtatgaggatataaaggaaatctttttgtttgtttctttttgagtgtgagaaattctgcagaatgattttagttgttaggattgctaagataagggagatgagaagtccttgagaaagcaggagtggtcaggatcctgactgcacagagtcctttgataggaaggggatacttcttcagttttttttttttgtttttttttttttttttgtgatggattctcgctctgtcgcccaggctggagtgcaatggcctggtcttggctcactgcaacctccgcctcccgggttgaagcgattctcctgcctcagccatcagagttgctgggattacaggtgcctaccaccacgcctggctgatttttgtcttcttagtagagacagggtttcaccatgttggccaggctggtctcgaactgctgatctcgtgatctgcctgccttggcctcccaaagtgctgggattacaggcatgagccaccgtgcccggccacttcctcagttttaacagtggggaagaaagaacaacatggttacagacgcaagtaggaatatagatttagtgggtggaatatagatttagtgggaggatgtt

SEQ ID NO: 123113 - DNA, 1275 bp, Homo sapiens
atctcttctcctactgcgacattgagagcaccaagaaggtggtggtcaacgggcgggtgctggagctgttccgggccgcgcagctgccgaacgacgtggtcctacaggtaacgtcgcgtcccggggccggcgggcggcttaggcctgcagtcactggcctccaggagtgggagtgggcgccgattccttggggcccggcggggggctggttcctcggggggtccccgcagcgggcaggggccgcaggtgcccgggaggcctggactcgcgccgcggccaagggggagggggttgcccttagaggacggaactcctgtggtgggggtctgaagagcctcagccggtatcccccacgaccctgagaatctgtgctctgtactgcaagagctatctcacttgaaggatcttaggttgttaatgtgtgtgaatcctagaacctggcatatagagagcttttcggatcctgcagagtagtaaagttatcagtatgggcaaaatggtttttttaattcttggattaaccgagaagacgtgataaagtgagttctatagatttaggaatcgaagaagcagtttttttaaaggaagcaaaattcttagggaaattttttaaaatgtgaactacttagtagttttacaagtaggcatacaagaagttgtaattatctgtagaacgtgtgtatgtgatgagactgaacaatgtttttcaacaggcattcgaaagcatttgtggaacttgtggatttgggttgggagatgagtattgaacagctggtaggcagaagtgcgttatttgccctaatctgaagccctggaggagcaaaccctgtaggtttaaagcctttttttatcatatctgcttttgaaacagaggacttcctagaagttcttatctaatgtatgtggtgagcattaatgctactctgtttaatgattcatagctgctagtaggagtctgtctaaacagtatgttaggaacaggttttaagctttcatcttttatattgatccaagctagttatccacatctccaaaatttaaagccacatgtataggtgtatgtagtggactgcaaagcattggaccagggttttgaaggctgggtccttgaccctactctgctgttaaccagcagtgtgactttgggtcaggcactttccattttcaagcataagtatgttcatccacagaatgaaggcaagtttcttccaacaaaaattctgtgaagaataaaaatgtccacacacaggtctctgttttagaagttaagtctgc

SEQ ID NO: 123114 - DNA, 1019 bp, Homo sapiens
ggtctggacccggttaccttcttcagtgcactggggagggtgaggccaaggaaggaagtggctgaggcaaagagaaagacggctgtggaggaggaggagcagggtagggggaaaagtaagtgtttctgcgctcaagaaaggggccgcccacactcccagggacaagcctatgaggaggaaactcaggggaggagacgtccaagaaaggggctgactgcagacaggtgaagcgccctgggctcctaggaaaacgggcccagagcctggattacctcacttttccaccgtgctactcagagccaaggatcccaggatctgcatctgatcctgggcgtcgatttcctgatggatttctctcccaacgtaagaaacaaagcgccctcaaattgctgaaggctgctagaaagaacgtggcattcatgggttccggatgccgggggcctccagaaaactacgactcatgacttaaaaatggcttaattcgcaaaacaaaatgcaatcttgaaagccaatttgtcagactgcaaagaaattttacttggacatagatagttgttgaccctgggtcagtatcggtttcttcccttgttcattcattatttcatacatttaacttcataattcaatttattcatgctccctttgttttagtcactgttattttaatatatgcgtgtgtgagagagagatgcttaccgtacccagagagtccttttggaaaggaaacagttacccaaactatttctagagcaggggttgcacaaataactacaaaaaacgttccttaccccctccccacccccagcccagctaatttaaattaagagtgatcgcgtgacccaagagcgcacaatccgtgatgtagtcatcatcctgtgaggtgacctggagcaaacagttctcatcaaacacggactctgatagttagtaagccaatcagacactcccttggaaatggaaagtggagaatgcagagacggagctgtctgatgtaagagaaaggttggagctaagagagg

SEQ ID NO: 123115 - DNA, 1040 bp, Homo sapiens
gtattgatctgcctcccccactagactacaggctcctgaagggcagggagtgtttgtcagttcattctggggtgcccagcccccagcttaggcctgcctcaagtgtgccgtgtgttttctcctttgttgccttgctttgtgtatgcacttcctcctgtgtagagtgccctaccccaccagtctggctggaccagtcctccccagtgacctccaggaagcctcctgctgcttcctcctttgtgcttccatatgccttggacccaccactcaaagagtattcgtctcattgctcttcattgcaggccctcatctgcctttagaatgtgagatccccgagggcagatcctgtgctacacaccttttgtatttttggtgcctggcaggataccatgaagaggacctacgcatagtgaatcgtgggtgcaaggagaatggctgtagtgaatcgtgggtgcaaggagaatggctgtattctcccccacagacgtggagaataggagtgcagggagctgagggggcggttacaaaggtagagggaaaatggggacacttcagtgccacatgcatcacacaaatatttttaggaaaaggaacatggtaaattaatagtgacagacgcgacctgaacaagacaaagggctcttggatttggatgtgcttaatggaatgtaatggtgataatttagacttcctttttttctctcccaggcagcaatgaatgtggatcacgaggttaacctcttagtggaggaaattcatcgtttgggttcaaaaagtaagtatctgacagagatagagtatttctcctggctttaccttggaacaggtgagactggcatgctggagaagcctatgaaggggtcacccagggcttcaggacacaggtctgggagctctgcccacagccccaggttataactgcccttagccaggaattgacatctggagacacggggcttttggggtattgtgattctgatgcagggaatagttgagatatttcattatttttcgatagaaagcaaattaccaagcttctt

SEQ ID NO: 123116 - DNA, 1101 bp, Homo sapiens
catgttggccaggctggtctcgaactcctggcctcatgtgatccacccgcctcagccttccaaagtgctgggattgtagacatgagctgctgggcccagccgtgcattactattgtttggatagttataggtgttacaggcatatttccaaagatttgtaggattttcttttctttatccatatcagcctagtgtttattggtcatattcaattagtttttaaattctaacctttacattactagaagagtgtcattattctggtaaggcaaactgaaattccacttcaaaattagcagctttcacattagaagacttaagataattatcgtaacttctataagcatggaaatacttttaattttgcagcttcatcaggataccttgactttctcattcctggcaaaagatgacttattgagtttgaaagcatatatagatatgtgttatctttgaacgtgttatggttaattatttaagttgtatctggagtgattttgctttagtctacatatgatgtatgagctgaggatgaaaactgatgaatttagttttatcttttcattgaaagtcaaattccttaaagtctcatttttcatatagcgaaaaaagattaaatggggagagtgcacttggaaatttaaattctttcattcaacaaattttttttagtgtcccctttgtgctcaagtgctggagatgtaaaaatgaacaaaattccatctccatctttgaggtcctctttaggtagctgaaagacagacaaactggaagtacctagagggaagtgattaacatgggctgtaaagtcggactctctggaaatgaatcccagctcctctacatacttgctgtgtgaccttggctactttactaaacttttctgtgccttgttttccttatttgtaaaacaataatactctatttcaaggacacatttcttcacattaaaaaatctctaaaataggccaggtgtggtggctcatgcctataatcccagcactttgggaggccaaggcaggcagattgcctgaggtcaggagttcgagaccagcttggccaacatggtgaaaccctgtctctactaaaaatacaaaaatt

SEQ ID NO: 123117 - DNA, 1088 bp, Homo sapiens
tactgggaattcagattcagtggtcctgatgaatggctgatgattatacatttttaaggagccccccactcccaccctggggattccgagtgttcagaacacacttagagaaacactgctcttgatcctggttttctctttcatttgtagtgtttattgattcaaaaactcacgtaacaattaacaaataaaaatagagggagagaaattcatctgcagtattagcactgtagcacattcaacttttgtaaatgttggttctcagtctttgtctggataatcctaaggccaagaggcatatagcatgtatttattccattactttttggatcagggaagagaatatgttgaatttatgactgttaagtgttaaattgcaaccttggatagcccatagttataaatttattaaagattttgtaagtcttccatacttgagggtatgaaacagactttgcatttgctaacaatgtattttctcaaactagatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaatttgccttattttgtcatt

SEQ ID NO: 123118 - DNA, 1076 bp, Homo sapiens
tcacacctgtaattccagcactttgggaggctgaggcgggcagatcacctgaggttgggggttcgagacagcctggccaacatggtgaaaccccatctctactaaaaatacaaaaattagctgggcgtgatggcacacatctgtaatacccactactctggaggctgaggcacaaggatcacctgaacccaggaggtggaggttgcagtgagctgaggtcgccccacggcactccagcctgggcgacagagcgagacttgatctcacaaaaaaaaaaaaaaaaaaaaaagaggaatggttagtgttatggttagaccctatacaaaatatttattttgaggctgattgtgtgcttattgctgagtttggggacatgccaaaaaatctaacctaaaaacttcacattctagttgggttacacccatctgaaacaatatgggataatctctgattgcatgttacagaatttaacatgacttggaatgccaaggagaataaaagcagtgaaagccacaatggccaggggagatatcctggagggggcagaacttgcatggaggaatgattgcagctgattatctcgagggaaaaaaagatgggatgatgagggtgatgactgaaggaaaggcagaaggatacaaattggcaaggcatgatctcgtgaaaggcaggatatgaggccgaccagaatgctggggagagaggtcgttcattggacaatgaaagtgggacctgggaaatcaggaagaggaatatgaacagaaactggagccaggacattccatgatgacagtgatgtttagtgcagatggccctcacactagtgattcaggtggattgtagagagtgaagaagtggtcagacaagccagctgaaatgttgctcaggaatctcatgggggtgaccataacgcaaaggcgggggaagaatgaactccaagcatgtttttaaaatcaaagccctctcatctgtactctttctgctgtgacaggaccccaattcaaagatcaaacattagaattcactggcacttgacggttattgctaacatttattgagcatttacaatgccaatt

SEQ ID NO: 123119 - DNA, 1044 bp, Homo sapiens
taccaggctcagtagacacctggtctcttcctgggtgtctgttgttcactctaattgtcagctctcatgctcctactgtcttcctgaatcttggatctgtgctcacatcatgcttagaagagccatttctgccacccctgtggtttttggtggagaggattaagttccttaggaatagatggctcttttctctatagttgcttcctggatcccctttgaaaagatctcttccacagcttcagggtaagggacaaaaagatctgcatttaatatgcaggctttgcaaccaggcttgcaactgcttttcctgcagaaaacccttatagtatctaaaaattattttactatttcatgttctgcccccttgcatataggttacacatttttatcgccatgttataaattatgtaatgtagtttttaatatagttaatataagtacaatatactaaaagagctgatgctgctattttaagcatcgaagttaagctataaaatacagacttgaactctggtgctgatagtaaataccatttttctgttattttgtcgtgatatagttacgagtgctctgataaataacatatgcttattactcatgccatttcctccaaaatgaactctttaaaaatttaaacacaagtctagtacaataacatttcacaacatggctaaaaataaaaggaatcacatttgatgagcatttactatatgccatgctctgagctaagcactttgcagacattatctcacgtagttcctcaacaacaagaggctggtcctataacaataattgtcagtgagacagctgaagctcagaggagttaaataactttcaagtctcagaatgaggccacaatggagcttaactccaaagtccaaaccttaactatcaagtgatattggcctcccaaaactagataaagataaaaggtgtgtttgtgcatctgtgtgtgtgtgtgttaaagagagagagtgagagaatcagatactcagagcataacaaactgcagggtctcaccaaatagtttactgggaagaaatc

SEQ ID NO: 123120 - DNA, 1043 bp, Homo sapiens
gtctgaagcgattctcctgcctcagcctcccgagtagctgggattacaggcgcccgccaccacgcccggctaatttttgttatttttagtagagacagggtttcaccatattggtcaggctggtctcgaactcctgacctcgtgatccgcccgtctcggcctcccaaagtgctgagattacaggcgtgagtcaccacgcccagccagatcaggcactttttaaacagggcacctgctcttacaagcagcgtacagtgctctgaacataggcggctgaatgtcgcctgttagaactgtaggccccgttggctgtgtctctgcaatattgaaataggaagatttatttatttattttcagaaacaaacttaccccgtttgtgaatgtttcagaatactagttttgggtagcctgtgttcttcatgttcttttgtttttctcctggctttaaccttcattttggtattgatgtggcagagagaaaggtgctcagactctgggtaggacagactcctagctcagccatttagagcttcatcatcttggaaaggtcagtcttccagagcctcaatttcctcatgtgtaaacttgaaaaaaaattaccctggctccctcctagtgttattgagaggctcagagtgccccttccctattatgctcccagttcttgttattttaaaggttacatatataatgagcttaaagtttctcacaaagagtgcatgaacaatgatgacagctttcgtttattcatttaaaaaagattacctgcagtgttgcaagtaccgtgttcaatactaagggatccagcggtaatcaagacgagacatcccggtcctcagggagcttgcattcctgttctggtggtggttttggtttgctctgcccacccccctaccagctcctttttttttttttttttggcctatgtggaagcttcaagttcacagtttccttttttttcttgctccaaaagattagtccaatttaaggtggcatgaggaaatttttttcttaggctacttgtacctcctagtttgtacat

SEQ ID NO: 123121 - DNA, 2394 bp, Homo sapiens
caaaatcaactaaggaccaatatttggatttttaatgttaaagttattatcggtagtagttttaagtgtatttcaattttttacttaactgtgacattagattttgtaattacagaaattacaaatcaagtaattattacaagaaaggaggtacttgatattctttgaaacttgtaaatagtttttcactgttcaagtcagctatctacatctgcaaacatgcaaacttaatgacttcgcttaaaattaatagtgtttatttgtagttgtttggagtttatagaatggttttgtgtcttgtagctcttgggcagtgcggccaccagagcagggcaatattagcttttagttgttcagtttgtcaagtgggcataaataaatacttattctgtaaaggaagattactagttacggagagcttggggaagccgcggtatagttgtggttggagaagatgaactggctgcagttgtgcatcttgagtaagtttaatattaattcttaggatatcataccgctaataagacatttattagatactaattttaagatactagtttatgaggcttatttttcagggattggtgtaaaagaccaccccatctttttcctacatagtaatctgtctgcacataccatttgcattttcattgcaggtatacaagattaccaatggttatatttagaatctagttatcaaaaggtagatacgtagtttcattctggttccattaggcctctacatttttatatcaggcctaaaaatatttgaaaccttgatcatagtatatctagttttcattgggcctggatcttaagtacttttataaattcctgttattggatgaccatggttcatcactccactcattccttactgcctctagaacccgtgggcagcagagtctgccttaattcatggaactgtttctagcagatggagttcgtttgcatagagattggctttccatttggtggacctagattcaaatcctggcttctcaaattacttgtcaaatgaccttgggcaagtcatttaacttctctgagccttggtttctgctttgtaaaatggattgtagtacctacccatacagatgtagtaaaatatctgtatctatctattaaatatatttaaaataaatagattacatacattagatagattagaacagtgtctgacttacagtaccagcttacgaagtattagctgtttgtcttagatcctggaaatagcctgagcagagatacacgtgctggaggttactggagagtgctcttggcatcattcctagtggaggagggaaggaagcaggattgggcagaagcaggagttgaactgtgatgcatctgtaacagagaccccagttgatcctctcttgggggagctctggaggtgggatggcctttctgagttatctcaccttaaataataggggcagggccttctacacactcccccaactcccagttgactggtcatttggacttgggctccccccaggaagagagcatgaccttgagggtggcatctctttacctggaaaccctttatggagagggactctgctgagaagcttcagctctgagtgaaaggagagccattcttattcccctagcattatggatgtcttcatttagaccaccagtaccattcacataaaacacaggtgtgggataaatatttctcactaacaactaaataggctttgtggaggagactgggaattaaccaccattataacagtgtttccatgggaaaacgcattctgaattccatatatctgttgacaagtagattttttttggagtaccacctgttccctatgcacaggatttgtattttgctgcatatttaggccactaaagacactttttataaccgaggtttgtagtatattttaaatagtttctttttagatgtttactttaattcctactacatttaaattacctatatccatcagtaggaaaatgaaaaatgtttgcttgctgtttattttcaaatcaaggaatatctgttgaggatctaaggtatataggttaccattataatcttagaaaacattttcttgccttatctagaagtcagttttttgggtctcaagaactatttgcctttggatgttgtcttttgaaatccacctttttagtggagattggcagaaaatattgcctcatgcatcaaagattcttcctgtacacttcgtgtattaaagtgaagagctcttctgtgcgccgttcatggtgctctatgcgcagtctcgtctttctctcattctttacttgttagaggatctgtgatctgtccttaagttctagaaactaaaccttcaatgtcaattttcctgtaagtccaagaatatatttcattccatggagaattgaaaacgg

SEQ ID NO: 123122 - DNA, 1051 bp, Homo sapiens
agtcctagcagtaggatcactggtttgatacatattgccaaactgctcctacagacgaggtttgccagtttacaccatcagtggtggtgcagttccttcgcactctgtaatgtaaatttcgattaccattttcatctttgccaatcagatagatgaaaaatcacatctcattgtcataatatttgcattttttggatcatcagtgaatatctttttatatttatattgatcatttgtatttttttcttgtttgtgatttttgtccattttactaatagggtatttgtgttcttactgattttcacaaagtgtttgcgtattcagggtactttttgacatacgctttccctaatttattgtttgcctttcagccttatttatggttgtctttgctggttagaaattttacagttttgtatgattacattaacatccacatagaaataaaggtaaaggtaagggagtgtgaggaaagttgtgaaattacttgtaggcaaagcagtttgggcatggcataaagttagcaactttgagttcatttgtataccagtgcacagtaatgctattacatttatgaggttgtgtttactttttaatttggaaggctctgtttctcagaattggttgcaacccgccaggtgtggtggcttacgcctgtaatctcagcactttgggaggctgaggcaggcagatcacttgaggtcaagagtttgagaccaacttggccaacatggtgaaaccccatgtcactactaaaaatgctaacattagctgggcatggtggcgcatgcctcttatcccagctactcgtgaggctgaggcaggagaatcgcttcaacctgggaggcagaggttgcagtgagctgagatcatgcctctaaactccagcctgggcattagagggagactctgtctccaaaaaaaaaaaattggttgcaactcctgctgccctcccttacctcctctccgagtctctggccactcactgctgtcgagtcaatagctgagctccagtgctcaatacccgtctcttcttgcacatttctaaaat

SEQ ID NO: 123123 - DNA, 1031 bp, Homo sapiens
tggaaaacaaaagagtgtaaagatttcatttattttagggtatggatagggtaaagaagtgaatttagctacatcgtgctgagattttattgatttaaatacagtagtcttaaaatcatcttgggagttggtgtgttaactcaatccgtttaactaaacagaatgcaggcaaggcaggctgaacttctgtttcttccggccgtgctttttctgctacttaatttgatattctccatactgagagaatggtgtttctttacattctttcaaaggaaaatcctcctcttttgagtttagcaattctattaactagagcagattgactttcttgtcattatttttaaggagtgcaaagattggggtcaggaaacctttatactgtaattgagtttaagtacttttttaacgtggtcacttaggttggtgcaaaagtaatttgcgatttttgccattactttcttacctactttttaagtactctaaggattaatatgaggattgaacattttgaataagacactattctcaattgtagaactacatactacaatctggttacgcaaagctgtggggtcacagcctctccatataagctggctctgtgctctcaattgtcctgtgtgcagtatgggtggaaatacaagagagaaggccacttactagctgaatggccttgggcacatcaccaaaggagccttcctgtgctcagaaagagtatgtggaatctggactaaagtgattgtcctatttctattctgtgaaactttgatacttttaagaaacatttaggataaactatgacactattatcttcatcctgatgttcagcctaaaccaggcatattctgggtccgtattcttttgggtcttgacgtgtcttctattagacaaggaaaatatgaatcttctactttatagtcattattgatgtgatttcttactgagatcagagcgtcagagccagaatggaaataacaggtaaaatagaaacctagagttttttatttagtttgaatttgaggctgggtaga

SEQ ID NO: 123124 - DNA, 1014 bp, Homo sapiens
ctgttttttttccatgaatattttccattgacaattggtcaaatccatggatgtggaacccacagatatagaggacagactgcatatgaatggggtggagagggagtcttagctacctggagaatgtgtgctgcaccaaaacagcattctgattcacattccaaaaaaaaactctggactggtttactaagacacaatgcaggccaaactgccccattggaactctgatctaggggatatatagacatcatatcacctattatcagttgagcttttagaatattttgaacagcagggagttgtgagttgtattttctaaccggtaactggtctacggatgacccgtgttgccagttaatcatgcagtcttatgctttacctgttgggcagacaagggaaggggtaaagtcattagtcttttcagcagaggtcattgggatttcagaggtaaggggaaggggccaaatcggccatggcctttggcctccaaataccattttggggctcatcaagagagaagaagcaggtccagcatttacactgcgttgtaatttacatggtaaatgaaaatcacatagataaactatgagtaaagaggtttgagtattgccacattttgaatatttgtgctgacaaaggaggacattaatatggataatcaaaatcaagcttattttcctaagcaaggataatattggaatacagtactaaagactgacatgaagtctttaaaaataggattgtttaacaactggttggacagtttctccgcagttgtatatatacagtcatgcattgcttaatgacagggatacattctaagaagtgtgtcatttggcgatttcatcatcaggcgtacatcatagagtgtacttatacaaagtatagcctactacatacgtaggccagatggtataccctgttgcttctgtgctacaaacctgtacagcaggttcgttgaatactgtaggcaattggaacacaatggcatttatgcatctaaacatacagaaa

SEQ ID NO: 123125 - DNA, 1052 bp, Homo sapiens
ctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaaggtataggtgttaattcaccttgcctgctttctgtttgttaaaaaccaaacaacaaacaagacagattgctctattttggtgtagttttcaccagtgttgtttttttgttctagtcaggtgctaggtaacatttgaatatttcagcttcgcccagtgacgcggtgattttttactctgatgtcacagtaccaagtacagttgtcctagcggataattttgtgtgttctgtaatttgaagaaaggattgccg

SEQ ID NO: 123126 - DNA, 1083 bp, Homo sapiens
cagtgaggaaaagcagtggtcagaaaagggccaaggtatttttagattagttgaattaattttgaagtttatgaaagatgagagtgtgttgatagcagcaaaaggtaaacaggattattgaaagctcagacattagcccggtggtggtggtggaaggaggggcgatggggaagcttattattcctgtggatggcatataaggatttggtacatttcagccataaattgaatgacacgaggttggttagtataagaaatctgtcagttcatgtacaactactgaacttccataaagatgagacacatcacatataacatgtttacactttaaatgtgtgctaaaaagcttgttgtgaaaatgatatatccccacctgtctccttcccaccaaccctgctgtgtcagtacccagacaaacattttcaaatcttagctgatgcttcaagtttttgacatcgtgattgtaaatactgctgtcttcattctccagctttacatattatctgtttattgactggctttgaaggtggatgactgtgcatccccctcctccttcctctcaggataagataccacaattattagttaaatccttaatgtttactaatgtgaatatatatatttaatattgagccaagaagtatagggttttatcttattatatagtaccatatagtctaggactccttttgtttttattagggttaattgattattttgatttgcatagtttttttttttttttttaactttggctagttctcactctccagcagctttacaaaccatctttcaaagacatttccacatacctgtcagattttttttggaaaaaaaatttttgcccctgaaaatgcccctcgtggagactcttaccctcctgcttctacctgtcctggtgcactcaggacctggtgtaccacatagctgtccttctaggaatgccttcatttctgtcctatttttaaaaatcttgtttcctagatctcaatattttatttttttctcggtttattctctcagcttttaggaaacatcccccaggagctttttgagaaagggagcatgggaatagatgatttg

SEQ ID NO: 123127 - DNA, 1992 bp, Homo sapiens
cagtttctgagcttaaccatttactatccctcagtctactttctgacttcatatagtttaattcagggttgaaataacctcattgtttcatggaagatggagtttgtgtttttgtttttttatcctgtttgggggtaattttagagggaagtggatggaaacacctttatttctccattgtaaaacttgaaacattttttatgaagatgaatatgggtacagcagatatgagaatagtagtgttctttttctatccatgatggacagattattgtcatgtaatccattcatcagttcatcaaacttacggatatcacacatgctgggtactatcagttcttgcttgtcatcaatttataatcttaggataagatgcttttataaaatgtaactaacttaccaggcttaaagttctagtatcatacctggatatgatgtacattaagtatcctataatttccagaggaagggaccactttggcttggttcgtaaaaagaggcagcatgaatgctgatgtcaaaaggtggactggatcttggtaagcagagggtctacccaggtcaggtgtttgttgatgaggagggagtgcctgcaagcaaaggaagggtggttaaaaagaagaagggcaggttgcgatgaggagctagggagagaactgtttggttggagccaagggtgttctagagtgggaaaggagtaggatagggagagaagggagagaacagattgcagaagtactttcaagccataataaagaactttgctatatattctttatgaatgtgaatggaaagattttcagtgtttttttaaagcaggcagtcacatggaggaaaggtgcgggaaaggggtttgaaaggggtgggatctagagacagagttgaggctttgtagtctagatgtaaggagataaaaggtgtggacagaatggaagggaggggatattgtcaagaggttattttaaagaaaaattacagcttgtgaatttagaaacaaaattcactttgtttctagaccagataaatggtgcaagagtagagaaaggagatgggtagataaaggtggggaaagggcctggttttgcgggcagaagatgaggtttctgtgtgttgggtttgaagggatgttgggacttttgtgtggagatgtctagcaaacatggttaaaaataagcatttgggttgaacactgggagtttataacagtggtggttaaaatcctaagggtggaagagctcttggataggaagaaaagagaaaaaaaaggaaggaggatatgataaacccacaaccaaatcttgagagtacctttcagggagcagatgaagaaagaggtgaaaattaggcctgagtacttgtgtgtgcgtatatatacacatcaaaacatagacatacataaatagataatgcgcacattagatgtgcccacaaagatactgagaagttgaacgtttgatgtaaaacctgaagatcagggtgtttaattattaccagagaagttatcattgccacaagtgaggccttgaccacatatcagcatttttattgccacatctttgagaaatccatgccgtcttatttgtagtaagaaaatgtaaatcatgtcttcaatcaccaattactgaccacacattcttctatttttcttttcttttttctttctttttttttgagtatctcagtctgtcaccctggctggctggaaagcagcggagtgatcatagctactgcagccttggactgctgagctcaagcagtcctcctgccccagcttctccagtagctaggactgtaggctcaagccaccacactcggcttatttaatttgtttaaacttgttgttgttgttgtttgttgttgtgttttttttttttgtgacggggtttcacttttgttgcccaggctggagtgcaatggtgctatctcggctcactgcagcctttgcttctgggttcaagcgattctcctgcctcagcctcatgagtagctggg

SEQ ID NO: 123128 - DNA, 1819 bp, Homo sapiens
tctattctgtaatgctgctgttagggttaaatgaaatgattcacacggagctggtagcatagtgccataccctcggttaactcttagtaaaagttactctgtcttcatcattatggtcatcgttagcaacacctgacttctgtgtctaaggctgcccttacccttctcagctgtggcctctgtacctgggaatgtttgggaattgcattgagtatgcaggacagagagtgcaaatgaaattttttccagtggctcctggatccttgaacggacttcctaacatgccccgaggccagagtagatgtggcatgtgagacccttttattttcaatgccgtagagcagaggtggggagtatttcaagaagttcttgtcatccttcccccttttggcataaaggcccccaaggttatctgtctttggctgttaacatgccccatccatttacccaacatacacttataaagtgctttccacatcccagacactgtgctagtcactgagtctacaaggatgactaagacatggttcttgccctcaaggaggaagggggtcatgcaagtaaatgcaaacgaagggctccccctaagtactgtagatggaacatacatacctttccatcgggtaaggagcaggttgatccttactactgagtgctgaagacccatagtctgactgatggcagtgagcagcacattctgaatatgaggccacttaggattatgtgttctcctgatggtagtttttaacatggggaagcaccctgggttccacacagagcagaaatgttgctgttatacgttgcctgggcagattctgggcattctgactctttcctaattatttaaactgtgatgcttccatatacactaggatgacatctttcctttattaacattaagatgttatcaaataatggagggggatcatgttgtaacttttaagagctcggtgaataataagacattgaacttcttttaaaaaattacgagtaagatataattctggttcctaaattagatgtggtgatggctgagcattttgaggacaaggatagttaacagtaattttggttgtggtgtaattctgggctatcagtccccaagacagacttttgatttttatgatgggacttgtcacaagagagcttgtgacaagatcagtggtgttggttaagtctctatatgctaaacataaacttttgagcaggaagtcctgcgtgaatacagtacaggctggttttgagtgtatgtggctttgttacttgaatttggatggacccattatgtaagcccagcagccctttttggaaaagtgaattgaagccaagtttttaatatgcttgaacttaaaatacatgctttattgacaacagctagtaattcatcattatcctgaaaggacagcttgtgtactaaatattgatttttctttttatatttatccaaatgataaaatctttgcttataattggtagatgaaacatttttatctccttggagatgaaatgtgatttccatgatggccactcagagccttgtgtcttctgtgcacagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggtaggtactgaacacactgagggagcagtgggtgatattaggcttctgtccccaagtgaatgtagggaagatgcgtctggcaataaagaagaaattcagtccagcaatg

SEQ ID NO: 123129 - DNA, 1609 bp, Homo sapiens
cctggattgctaattttacttgagtatcttgggaaattttatttttacatcaaagaaaacgcaacttttctatagagtagaatgaaaaatgaaatttcaaagaagtttcgtggaggtttgggtgagggaagtcagcttcagccgctgtcttaaaatccagggggaggggtttcttattgttagggaacttcagtggagagcatttaggcagtagtagtttagaattttcttctcataagtaggtgaaacagctagcagtgctgcatatcaggagagaagttgggagtctttcaggtataccccgtttccatgtttttggtagtaaaagggatgctttgcaaagcccttgatcagtttcccagcattttggtttggatgactttgacaagtgttgggaagtggaggggtgttgtggctgatggtgtctgtttcccccaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggat

SEQ ID NO: 123130 - DNA, 1066 bp, Homo sapiens
catatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaacattgtactctgtctttagtttgtcactttatttttcattgagatttttgagcagtgggattgtctggtcagaaaagatgaagagaaagctttctgaggttttgatcactattcaggtaaccatttcaaagtcactcctgcagctaataaaaaaaactgccaacttttttgctgcttgcgtcatgtatcacatgtaaactcactttgcaataaaagctttcagtatgacaaagttgattctatacgaatagtccaaaattatcgttccggttttagggaattctattatttgatagatagtatagtgttaaagattagatagacccccaaggtcaaccacccatagccacatagccaaaacttaagtcgtcctgatttccctgaaatgctagttctaatcaaaacaaaatgcaaggccttgtcggcatgatttggtgaaatcaaacttactagccatacagtaatcccccctta

SEQ ID NO: 123131 - DNA, 1051 bp, Homo sapiens
tggtggcaggcgcctgtaatcccagctactcaggaggctgaggcaggagaatcgcttgaactcgggaggcagagtttgcagtgagccgagatcacgccattgcactccagcctgggcaaaagagtgaaaaacaaacaacaacaaaaaagaagaaaacaaagaagtttacaaactactaactaatttaaaatatgatcaaaattaaaaacctagcttgtctgtagagccaggggctgacagtcttgggcccagcctctggcctccgtgggtacccagcttcaggcagcttggcaccaagcagcgagtgcccagctatgtttcatccaggaaaactgcacctgagtacatgcctcgttctccacttcatctaagcaaagaagagatcctacaaacaagaatgtgagtagcctcaggttcgaaaaacacaggctgcattttattcacttcttacttcctcgtacccagcccagggcctggtgaccaccagacattctatatgcttcattaaatgaaataaaagaatggcagccccactgttctgttaattcacctaaatattactctacctctccgaacttcggtttccccatttataaaatgggggtgaaaatagaaccttccttgtgggactgtttcaaggatgaaacaaataatgcatgtaatcacattttgtgaactctacctcactctataaatgtaaagacccagaaaatacagagactgcttttgtgcagcaacttctcagatgtgcccagatattatcaacattttaatggctaaaaaggccatgccagctttcccactgtgatagtcttctattcaatacagtaaatatcctaaattacaggcttgttcatggaactccataaagatattcttcttttaaatgaaagaaaaagcagtgacaaaaccatgtgcccctaagtcatttcccatttcctgaattggctcaggtgcaaataagtttgcttgccactgccctagacggctcagaaataaattatgactctgctacaatcttcattcttgacattgaacatttgtttgcttc

SEQ ID NO: 123132 - DNA, 1078 bp, Homo sapiens
attttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacg

SEQ ID NO: 123133 - DNA, 1042 bp, Homo sapiens
aagttaagaaataacttgttttctagaagtcatttgggggtggttgttccctttggtggcttttttccccccgtctttgagttgaacactattgatgagagtaagcattccaaaggataaattacaggacactaaaacaggtcatgatgagcttaagcggagagcaggatttaacataattggcataatgcttcattgttatcattgtaacatgcctcttggtgtgctttaatcaaaagctgcaaagttgtcactgcttttttttttttcttaattgccatcatatcaagtgtactccagagttagaaaggtttgcaatactcaacattatctttttcaatgggcaggaggcaaaaaaaatcaagtgtttctgtttatacctgattcaactacttaaatagaggtagattggaataatacactgattgattgatgggtggcattaaatataaatctacctttatctccagtgatgagagttttatttctcagcaaaagtgccaaggataggtacatattttctagcgtaatctctgaaacagtgtctgactggtttatagttctgagaaagatgaggcagaattccactttgaggcttttgtcctataatatttaaaatgtactcaggttgactcaaaggtcaaattacagtctttacaagatgttccctcttaagcatgccctgttttcctgaattctgagttttcctgttgcatgcatgggatgcaaatcacctgaaaattatactttaattttacctggatagatgtcttatcaagaagaccatagctacaactaagtgggtatcaagttttgccttatataatcaagcaaaggaaaaagtaatattgtgaaaatctcaaattatcccaggtggaaggagaaggaattttgtttttcatgttttcatggcttatcttatgtttataagagcaacacacctaccttcaagaaaaaatacagacttttgtacgcaacttactaggggaagtaaaaaatgtaggttgaggaaaatcttataaataatgctttaaaagaacat

SEQ ID NO: 123134 - DNA, 1787 bp, Homo sapiens
atcttgggggtggtggttcgcagccgacgtgcgcccgggaatcctggggggcagaggcgagcaaaagtggggtgcgctgtggtgggcgacacgtgtggcgcgggtctcattatctgcccttttcacttccaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttat

SEQ ID NO: 123135 - DNA, 1038 bp, Homo sapiens
tttctcttttcacattggctccaggagaattagaaattaggaagaaaacagagagcaagttttggtcattggttggctggtggctggttttcttttcttttgttttcaaacttccaaagaggatcttgaagcattcatcagaaataattggaggtggccgggcgtggtggctcacgcctgtaatcccagcactgtgggaggctgaggtgggtggatcacttgaggccaggagttcaagaccagcctggccaacaaggcaaaaccccgtttccactaaaaatacaaaaattagctggcgtagtagtgagctcgtgtagtcccatctacaaggaggctgaggcaggagaatcacttgaacccgggaggcagaggttgcagtaagctgaggtcccaccactgcactccagcctgggtgacagagccagattttgtctcaaaaaaaaggaaaaaagaaaaaaacaaaggaaaaaaaaaaagaaataataattggaggtgtaggggagcaatgtcttaattgacaggctgtggagcagctattattgctagaagcaaaaacaatgagggaatggaaccaatgcctaagaccacctactggccaccaggtgagcaccacagccctgctggggatttgcactggctcttctcttcagagctgagaagagttgcccaatgggagctccttgactattgcttgttggtcatcttaaaatattgatggctgcttgtgtcccgagatatcctcagccctgtttgtatatttccctttccaatgcgtacactagaacacttaccacttcccctgggttctgaagtgggttccaaggtgagccaagatgagcacttgtccttcaagagattggaaagcagtgacgtctcagctgttttacacagttagacactggggatccattcagtgctttttggaaaggaaacacaaacatggcaagacttcatacttaggtagcaaattacaatttccaaagtctttttataccttcaatattaaattcagtgttctaattatggtaaatgttctaa

SEQ ID NO: 123136 - DNA, 1636 bp, Homo sapiens
tccttttagagagtgaaacataaggggatgattctaaattgatacggaacagcaaccaaaccctcctaaagaagaaagacctggggatggaggggtgggatttaccttactagttatcaacaattattataaagctgtatttaataacacaatagggtattgatatcgatagaaaaattgagtgaagggaaagacctacctgcacattgacacttgatttataacagagtttcactcaagagcaattgaaaagaatagactttcaagaaattctgtcatacattggttatctatatgaagaaaataaaaaatgtgtctcctgatgcatagtagatacatgtttatggtgaattgtctaggaatggagaatatggcagatgttcacaaagaaggagatacagttctttgacctacactcccaagaaattgagtagtgcctaagtatgaatatttgaaaatatttgtttggaaattagagaaagaacaagcttcatgatgttagggtaaaatcacctatttaagagccttataaacattttatactattttaatttttttgaagttaagtgttagtgctttactttggtaccctctatgagtttgctaatatcttggacaaaagaaaaaagtagcctttctattttttagagatgaacttcattgtaattgttatgtactattttaggtactgaaaagactgaaagtgacaaagaatagatatctacagtttttgtctgtttctttgttttttgtttttgagatcggttctcactctgtcactcaggcaggagtgcagtggtgtgatcacagctccctcaacctccagggctcaagtgattctcccacttcagcctctttagtagctggaactacagatgtgcatcaccacacctgcgaattttttgtacttttttttttgtagggacagggtttcaccatgttgcctaggttggtctcaaattcctgggtaatctgcctaccttggcctctcaaagtgctgggattacaggcgtgagccacagcacccagcatgatagctccagtttttattgagcttattcaaaaacgtaatcataataactacaggtaaaattcaaatacaatttagttttgatatctagatggcattcttttgtgaatatctgtaaaaacatgtttgtgtctgtatgtgcatttattttcggagtcttaaaagcatctatgcgtcaatgtgatagcacaaaaaaactgccaaatattcactgataacactgcattaattgagcactagtccggcttgtgtaaaacggctggtggtattctgtaatcaccagtacagtcttccctctagaaagtcaaattcaatgacattctgtacatactgcagttttaaaagtatcattccactcttaagacattaaaaactgcattataaacattcatagttgtgatgtgacttcagtctggaaggacaaatgtacaaatgtattcttagatttactcaaatgtttacgtatcattttataatgactagaatggactatagtaggtcccttgactctgtggctgccttaaatggacaatttctaaattattttaacattccaaaggattctttggcttttgaactatccatctaatttacttctaaaatgag

SEQ ID NO: 123137 - DNA, 1049 bp, Homo sapiens
aaaaaaacacttagatatacttttgcctcagcaagaacaatgagatacaaacagggatatgaagggtaatttattgaaaagtaatatatagaaggaaaacatttatattaagaatgaagactccaaaaactgtaattctcttttaaaatacagattcactttcttaaaacatttcctttaataaaaaataaataaaattttaaaaataaaaaacacagtcaagaatccaatgtaagaaaaaggtacagtcagtaatgtaccatatttccagataaatatttcatatttaagtaataaaaatactctaaatgttttttttttcatatttcttatttgtgcttaatcagtggaatggcagttctacactgaggagagccaaatttccaaaaatctgttataggttttcaagactcatttattttagttgttattacacttccaagctgccagctcattcctcaaacaaggagactcaatagatatcagtgttgaggagatttaaaattcattccaaaatttatgattctcacttcaaggaagaaagatgatccttaaagccaaaatgacaggaaaaaaaatcttgtttctgaaagaataaaaatctgattaaaagaaagtttagattcttcataacactgacccctacagaataaatatatttatgtataactaggagtattataatttccattaattgttctatttgcacagtaagtacaattttattggttcttattgttcatgtatttttatactatcgtttattaagtgtaataaatatgattgttggctttttaaagtcagtttccatcatattgtaactaaaatgttcaactgtgttaattttatctaaaaatagaaagtaaattgtcaccttacatactgttttaaaatacttttatgagtcacttaaagagcataatgattagggaacataatcaagatcatttaatctcaagacaattgcaatattggagttagaatgactgctgtggtttgaggaagtcaatgtcgatattatccatagcataactaacagcccccttctt

SEQ ID NO: 123138 - DNA, 1052 bp, Homo sapiens
attattgtacacacaaataaatggaagccagtcctattatttatgttattgggattggaatggaaacaatttaagacatgagtttaaggtgctacaagtttttaataatagtttttatctataaaataaacataggatttcttaacattttcagtgaggtggcagatttctaataatattaatcatgatcatactagcaggagttaataattggtaaaaagcaattatgctaatgacaatgataataattatggcttatttgtttaacagtgaataacatttacagtaataataagctgaaagatgatttataccaataaatcagttggcaaaaatttataacaaattttaacggaaacatgaataggtaagaaataaaaagaatgtgcctaaataatacctggctaaaaattgcttatcagttgtcaaatgatacaaaaagatctttacaaaaaggaagactctgctgggaagaattccctgaatttggtagacagaacagttgggaatcaaatgatatcacagatatgatataagggatttctcttgattgtcaagatgtcagtactcaaaagcatcaatacccttgtagggtttcaatactgctattagtggatgtatggtcctagtaatttatccttgagttcttcctaaaagtctctgaaaatagagctccttgagggcctctatttgtgtccaaacaagatgttaataactctacataccctcttagagccaaacattctatatactgcatcctacagtaactgtaggctgaagaggtatttttgtgtcgatgtgggtatatgtgtttgggtatctttttgggagactaagagggtgaagagaagaaggggtattgttttagtccattgtcatgctgctgataaagacatacccaagactgggcaatttacaaaagaaagaggtttaattggacttacagtaccaaatggctggggaagcctcacaatcatggtggaagacaagcaggagtaagtcacatcttatggggatggcggcaggtaaaaaaagagagcttgtgcagggaa

SEQ ID NO: 123139 - DNA, 1048 bp, Homo sapiens
gagaaggtatatttattcaaagagagagtatatgtaaaattactatagcaattctttctataaacctcagttcaagtctcatttcccactatcccagcccattttgaatattttgtcagtatcacttatttggcacttggcaggtgctcttgtacatatggttgtttgctgtgtgctctgtcttaccaattaaattataggtgcctttgacagcttaggacatacctagtcctctttttttttttttttaacataataccaaaagagaaggccttatttgataaaaaaatttatcatgaatgtcttgcattctttggataatatttttgtgctttttaggtttataacttccatagtaaatcagttttatttctaaatttacttgaatttttaattatttattagcaattatattttaaacactcataaacatggatgtttaaaaatgaaattgttcaaattatcttacttttctttctaggtcgtttatacgcaatgcagactggaatgaagatcgatagtaaaactcctgaatgtcgcaaatttttatcaaagttaatggatcagttagaagctgtaagttaaccactgatcatttattttctggttatggttaaaataccattttattcatttgcgtgtctgtgttgtcattttagttctttcccttggcaacaatcaaacaaagccattatacctgaggaaaaactagtaataatttattttcatttatttgctgtatacttccagagaggttatgagtgttaattaaagtatgttcaagtatctttgcatatgccatcatatcttgttccacattattatagatggcctttggctcctccttttataggtgaaaaacccctcctttttttttttttaagttgagacagggtctcactctgtcacccaggctggagtgcattgcagtggcgtgatctctcggcttgctgcaacccccacctcccaggttcaagcaattctcttacatcagcctcccacgtagctaggactacaggcacacgctaaacgcgcccggctagttttt

SEQ ID NO: 123140 - DNA, 1050 bp, Homo sapiens
ttcgttttactgcagaagttgaatgttgaactattttattgataggtttggtttatcttagtatgggttgacagttctaaacctgcttattctatattctaagagtgaccaaatgattaaatatattgagggagacagttttctcacttttggggaatttagttacaatgtggaatgagagaagactagattgtgttgtgctgttaggttggaattgttgtaatcttaattcatgcttttaaatatattacactagatgaatagatctatttatataggtataatatgtatactatagtttgtgtatctgtatactctgctaggagcaatgatgcagcagtagcagtgagcacacagtgagcatccctagtgcctgattttctgttctaattttattctgcataaggaaccaggactttcgtaaaaagtgcttaatctagggctaagtccaggaaggctacagataaggccagaccttcttgtgacagaaaggaggaaagtgttatcataatcataggacccagaagccgacttgaaagggttcccattgtccaagccagggacagtttgagcataaaaataagaatgatagtaatggatgataactcattgaataaattaagaatctgtataggtccagactgatacatatgaagaaataaataaatgaataaataatagaagagcagagaaggctctttgtcatagtattctaactataaatatacaaatagtgataaaattaaattattagtgggctttaaaagtagtaggtggaaagtttgataaaaagaagtatatttacatgtctctgaatatcttaccaaattgcttattgatatcagaggaaaatagtaattcaataatgagaaaacttgtaacacacctctttaggccaagtcattaaacctaacaccactaatattgggacagctcacgtcatgtgcatcctaataagatgatctgaaaaagacaaacatcgcttcagtgataatgcttccaaaaacgtataacccgaacgtaatcatgaggagacatcagacaaatcaa

SEQ ID NO: 123141 - DNA, 1092 bp, Homo sapiens
acttgtttgctgaaattatagttgctttgaaaaatataaaaggattaaaatgttgaatgaatatcaggaaatacatgtaatctgtgactataaatatttcagtgtctgagtaattttgataataaatttgtttaatatgtttttcaagcatttctcattataccacatctcagtgttctgggagttatgtggaagtcttgtttatataataacttgggaggttgagggactaagagtataaatgtatttgtgatgttgccacaaagttagagattattaatcccatttttatcactgtctactttgaaaatcttatgaaagctgtggattctcatgctaatgtgtattgcatttttgcatgtaatttggagggtgttccaggaagaggcaagagagagtgctacatttttgagactacagtacaagctacctattcttgttcaagaaataacaaggagaacaatgtggcagaatccagaatgagaaggagtgataggataggagatgagaatgagggtggtggggggaggattcaaacagagaatttataaaatttgacttgtatttttaaagtattgttcccttctgtaatggacaagagtggaaaaggcaaactcattagtatgttattaaataatcaaggtaaaagataatgcttgctaggaccagagtttgccaaagaggacatgttgagtagtggttggattctggatatattttgaatgtagagctgacaaaattttaacagtttcattggcagagtgtaaaagatacagagaactcaaaaatgactccaagggttggacctgacaactataagatttttaaccattgtggccatttatagagttggtgggggaaaatcaggagttggttttgaacttggaggagcttatcaaacatacaggacaaatatggaattggatgtatacttatacaagatcctaaggttcagagaagtctgaacagaagatataaatttggaagttggcagcaaatacacctcatggtatttaagggtggtacatttaaagccattagactgcgtgagatcatcaagtgtagaaagaagagacaaggaatccaagagct

SEQ ID NO: 123142 - DNA, 1055 bp, Homo sapiens
gacagctggtgtaaaactttgtctttcaaggtgactttttggtatgctaatggagaataatttatatcaaatttttcatagctctagccaggaatttattattacactcttgtgagtcttacaggtcctaagtttgaaaatccctcctcccgcctatggttgctgttgtctaaccagtcatgcttcagtgtagcaagtgatttaaaaattaaatgaaaattcatgctaattcttaagtggccaaaatttgcagttgtcagtgattctcatcaatctaataacaaaacaggaacttagaggccaaggacaaaagtaaaagttctttttgcagttcctgtctcttagaaaggatgtttaatcagccaaaaggagttaatgaatttcaaaaatacatcttgaaaatttccttttaaaatattgtttagtatccagcatcctttacatcctttattttaaagaaaacaacattgaaaagtgaattagtggaattacaactgccggaaatttctgctaaatagtatatgcagcagtttgtaggaatagggatgttttggaaacaggatgaaataaaaattaaatacgttgctttactaaactgagcccttttcaacttagtttcttaaatttcacatactaatgcagaaactcaaattggtttaaacttctctacactgctcatgcttagatattaggactgaaagaaccttctaaagtcattacaacttttctactaagtctttagacaggattaaattatttcagatagaagaaaatttagcctaattttaaagaccctcaaagaaggcagtttaaactttccttagcaatttcttcatttacttgtaaaatagttttcttcgtaactaccaaaaggtacattctgcattgataaacattaagtagctgatctttaaggcttattttctgttatttcatctattttaatctgagttgcaaattgcagcgtggtaattgtagtttaccaagatagacctgaatgagtggctaactttactactaaaacagtatgaccttcagtaaattactttactttt

SEQ ID NO: 123143 - DNA, 1050 bp, Homo sapiens
ttctccagggccccctagagtcttacctgagtgtgcataattcaggggcttgtaggtatttagttggggttcatacaaacatttcatggctcacttcttggcaactttcttttatgtagactattgactgccctcagatgaacagccacataaaatcaaatgttacctggtaagatttcctcttacccttactctcatttctaccagcttttggtcatgctctagtgcctttatgttgtggagcttttttctttcccagaatgtataaatgttagagttctccagtattggggaaagtcatgttaatgtatgtaaagtataaatacatccacaaggttgcttgataaaatgcttatctcagattaggtaaatttaactttttttcttgtttgaaattagctacattgaataacctgtttataatcagacaaaaaagttatttaaaaatgtggtaggaagcagtaagatctattctctttgatgagtctgtagctctagcttgcttttattttaagttactatgactcccagtagcggctgatggtcattttatactcaaaattcagtttttcaaagtagttttcaaattcggctcacgatacagtatattttaaaagtttgcatttcagaacttttcaaaatgaaatatctcatttctttctgcatagctaaatgcaaaatttcattcctctgtttttattagctaaatgcattgaacaactcacagataatcatttagtagctagtacgcggtaaatcttaagtaaaagtccgctgtcagaaaatggagttcttattggatagcataaatgtggcatgttttgccagaaatgtccttgagtcttcataagtttaaagaaagtttattttaaagaaaaacatattctgggtgtggtggctcacgcctgtaattccagcactttgggaggccgaggcaggcagatcacgaggtccggagattgagaccatcctggctaacacggtgaaaccccgtctctactaaaaatacaaaaaaaaaaaaaccaaaaaaaaaacaaactagccgggagt

SEQ ID NO: 123144 - DNA, 1088 bp, Homo sapiens
taaaaatttacttttatcccaggtgacttatggtactaaactatacaaacactttaaaataattaatggaatgatagtcatccttcatgccctgatttctactgttcctattatgtaacacactactactttacttttatttgtcagccttattttacccaaattttttttattttacccaaattttgcatgaattacattatatgcaagttttctattttgaccattgtaacatcaagtatgattagtgtctttcctcctattttaaaacttacaagtttatattatctgcaaaaatattgctaacgttttctttaagattattgatgaaatgataattttagcactgatctttttttgtgtcttcagtcagcatatttgaccttgacttttcaatattttatggcctatgtgatgatattaatagacaaacctatttgcatttgttttggaagtaaaatttcttggaacacttttaagtattttattatgtttagaaatattcattatttccagtgtggaataatgtaagtgaaaccagctacttagatctgtttgccttagatgaatactgttcagattatacttgaaggttgaaatcctgatcaagagtcccagacacaagcattctcatagaggagccaaggggaaataaaatgcatttaggaggcaaatcatattggttatttgtttctaccccatgctaaagcataaactcagctgatatttaacttctcgtgaccttaatttttcctcttcctaatatgaaattaatcatacttacttctcatggttattttaattattaaaagggaaaaactgtaaaaatggactagtagtaggcctatcacaaaatcagtgttcagcagattagcctcctttccctctttttttcctcttccttcctatttctgtgccaaggaaagtcaaggtatttaatggcaagttaatgaacacttaaaattattatgcgaatcaagagaagtatcacaactgggggtaggatattaaccttatagaaagactgtccaaggagttttgttttagacagtatatctcaaggcagagttgtggtataggcacatcag

SEQ ID NO: 123145 - DNA, 1037 bp, Homo sapiens
taatagcaaatgtttcccctcttactcacgttaagaatgatttattttctctcatataaaggtccaggatgcacttttatcaaagggaaatccttaagataactgaaaagaatagtatgtactaatttgcagtttttagttcttccacaaaaaagcaaaggaggtgcaatgaggacagggatagtgattgtttaaacaggcgaagtgtttgcttcttgtgctttcaacactgcacagatatcacatgtagttgatacagtgtgtttttttctttctcaagaaacataagctttttatagttcatattacaggagaagattttagtaataaagctagattaaataatataattattttatgattaaagctagcctttcattgtaaaatgcagctcacttcatagatcaaaatgtaggctgtgtacttgtgtcagaagtaccatgtttgcattcttctgtaagctttgataacctgttgttgatactctggcctacgcatttctctcaaccctgtttctcatgattacactaaggtttcactcattctttccttatactgttactcatagacaatataggtaacattcctttcttcctttttctgtgtctctccaaatgctgtgttctttcaggagtctgtttaatcacactttctggatagtcttctctataaatagagatttgtttggaggattttaatttaggcagaaatgcaaattacttagcaatgaatgacattgatctatagattggaccattagagtatagtagatttaccttgttttttaagatgtatatgaatgatatatgtaatctacataagcctaggtacacctgtttcaaagcactagacatgactagtgtgaagatccatctcagattttacattctagcatttttaaaataatatatatttatgtgcctttcagtgtttggcaagttttgtggagaaaattgtcagatgtttataatttaaatatatttggtgagtacttatcaaaatcaagcaaaaaatagtcattgaataggtcagcctaa

SEQ ID NO: 123146 - DNA, 1047 bp, Homo sapiens
gccaggcgcggtggcacacgcctgtaatcccagcactttgggaggccgagatgggtggatcacgaggtcaggagattgagaccatcttggctaacacggtgaaaccccgtctctactaaaaaattacaaaaaagttagccaggcctggtggtgggcgcctgtagtcccagctacttgggaggctgaggcaggagaatggcatgaacccgggaggtgaagcttgcagtgagccgagatcatgccactgcactccagcctgggcgacagagtgagactccatctcaaaaaaaaaaaagttttttgagcattaagtgatataatatctgaatagtatttagcacagcacttgacataatgaaattctgcctgtattcataactactattgttggaattgttaagtgacatgtctcagcaatgcctgtatgtatgaaggttcagtctgtgtcctgtgtgttccatccaagtcaaaggataatagagtataccagaatgagattatccaaggcctttgacataagaatttctagaactatctagttaaattggaaagagctgctaaagactcattttggaaatatttacaaataagtgttctatcctctcttatgacattagatatatcaaccttggaaatggatgcttatgtcaactgagcacgcagtgatttttctttataccaagtgatgttatctttgatccagtgctgacccaggctctctttgccactgtagtagaggatttaactgatagttctagctctcttctgcctgatcttgtcctgacctctgaagaggagatgaagccctcttatatatagatggtcttgtctgcagctcgtctgtaacttataagctaagatttcagaagagagatatattagacaacccctctaatctttgaagcatctttaaggtccacttgcaccctctcttgttctgattatggcctctagtaaattttaatgatagaaaaaaaaaacagcttttattttggtgcattaagcttatattgacctttttgagtataaagtcagataaactgaaat

SEQ ID NO: 123147 - DNA, 1052 bp, Homo sapiens
attctgatccaaattattattttctaaaattttcaaaaagagtactgaaacaattgatgctactgtttccagcacagtgccaggcacctgcaggtgctcagtaacttcactgcatgaatatgaaaaagctgtattttaaattatttcccacattttaaaactaagttcatatagaattaaacattaattaaattgcagattttaaaatacacatatacttactagtgtagggtgctagagtaagtcttcaaatatttgttgaactagtagtatttaagattacataaaatttggccttcactgttgtgaatcagggattaccgatcccaattttaacagaagttactgacttggcatttgttgcccattaaacctaaacatcaactatcctgaagttctgttgacaatttagtcaggtatgctccagttcatatttctgatcttgaaaaatacctaccagattctttaatggtttttcaaaatatatttacactacatacgctgtctaggtgaggaaacatctttgaaaattgagtttaccttaacgctactttttgtgctttaagtctctcctatctcagggcactcttttaaatatacaaggcatccatccagaatttactggacatgctgaaagaaggctgtaatggtcagattaatctttatttttacaccattagctttagcactgtttggctgacatatcacttattaataaggtaaaacgtgtataatggcaagaactctgttactatttttgttttataaacttatctaccaaggattaaattattttaaaacacaaatactgtatttttttgtgaaataatttcaatatttaaaaaatgtgaatgaaattaacagaaaaatataactagatataaaatacataaagcttacagacatgcataaccaattatgtaactcatatataaaatacaagaactaagtaacaaccaatgtacagatttagatccaaaatgtaacttataaacatatagagatatttattttcaacaatgaaaaattaagctaaaaaatcatgttacatg

SEQ ID NO: 123148 - DNA, 1530 bp, Homo sapiens
gaaataatatgtaatggttgtttacatgtttaattgtatatttcagtgatataaaatttaagaaaccttaagaaatttttacatggatggcacaaacatgtaaaatactctcatgcttaaaacaagctaagcaacctggttttctttacataaagtttgttattcactttttttttattgaaggtgatacttacattccagctcaaatgagggttgaattggtttagtctgtgtgtattgttccatgaagagagaggctaagtgattttagcatagacaccaaagctgctatccttgtttgtccttattgcttcttgaaggaaaatcttaattcatctaagttattatgtattgccgtgtctgtggtttatattagtaataaaaagacaattgaaaagaatgaagaaaatgtatcaaagttcatgtgagattgactaaaactactgtttttacatagccttaaatatgttttttaatcttaagcataagcatttgcccaaccttacagaacactttttatattcttataaatatcccaattgttctttttcttctaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgat

SEQ ID NO: 123149 - DNA, 1028 bp, Homo sapiens
tgtagttttgttttccccatatttaaaggagagcttttcatattttaaaagtaagactacagtgttactttttaagactctatgccttagaagcattagtagtactttacacatggtacctaaaaagtattttaatttttagtaatcttagaaataaaagcagaaaatatattgtgggctatttcaggctaaaaataaagtattatttgagataaaaatgtgcctttgagaaaatacattaaaaacttaaatctatgttggatttgatttaaacttgaacagcacacaccaagcattaaagcacttttggatgcaactaaactaataatgggagtgaaaataattgcttttgatatcaatagcactgctaacttgactctgagtaacttagtagcatgaattaaaatgctgactctgaaatgaaattttgcaacaatgttcctttacagtcagagataccttttccatatgtactgaggctttgttccttgtgagctgtagtaggaagatacagttagtacacatagtgaaaactgcgtgcctgaacttttagcttgtgtttctattaatagcaaaatcaggcagaggatggttagcagacgttaaattggatggttgatttccatttttctggtttcatagcccagatataacttgatcaaaaattagcttcggtacttgtatattcattgcataagtgtggtacagctttatttgaaatacaccattaagttgaaaaaggatcctgtgaattaatttcttatgttgtagtcatccctttctgtaaatatatattagagcaataagacattttcaaaggctgataaattctatatctatcatactttttaaaccctttgaccagtaggtgcatatgtgtaacaacacatatagattctcatcacaaaaatagttataataattaaatattaaagacaaatatccaccaagaaagaatttgataattatggaatatttacattatgaaaggtatacataaccataacttaatttttgaaatgtttagt

SEQ ID NO: 123150 - DNA, 1049 bp, Homo sapiens
ggatgaacatttaaaggcttctgatttctaggatttaagggagggaaatttctaagatcaggcaatatcatttttataattatctgattaaatgatgttttttcttaagaaatctgatatcaggtgatacaataatatggacttcttcctccaaaaatttttcataaaatagctggcttccttaaaactgtaaggaaaaagcttctgcttctattctatttgaggtaataattggtaggtaagagtttatggaaaggatttgcagaagagatacacagacacagcttttaacatttctaatatactgatattcagtatgagtctacagttgtggccatcaagttgttttgtgataaagtagatgactacagggatatttgaaaaatctcctcagatgttgggaatattaggaaataaactgagtctactgccacttcaaatacagagtacttccaaatactgaggctacaacataggatgagaggaatgggacataaggagaattaggattccaaccagcccaataaaggtcagaattgtgggtcattcaataattggactgtaaaatattgttgcctgtgaaagtcaaaagagatgtgaggaacatttattttgtattttcaagttttacatgactaaaacattttctacagagtggtaaaagagtaaagaaatatgtgctacagattcactgatgaattaataacgtttttcgatacaaacatgtaattgtctctaatctttctttagttttcaattaggaaatagcctaggggaaaagtataagtaacttgaaaacatatcgtaatatctttggcagtcatagtcaaggctgttctgcttatacttgttggctgatcactataaacattgtctacatgatgaaaatactaacccaaagtttgtaaatataaaattaaacactatattaaacctcttagtttttttgtttagaagttcttttcacatcatgatcaactgtgtttgaattcaaaatagtctttctggtttacatgtcagtgaaatacatgaatttttagtgggtgttt

SEQ ID NO: 123151 - DNA, 1033 bp, Homo sapiens
ctttatggttctataacccccgccaccccagttcagttaccctctagagtagagattcttaacctgggtcagtgaacctttgtgaaattcgctgttgcctcctgaggcctcattgtactccttgaaattgtgtgtaacgtgtgtggcccctgctcattttactggagagagtttgtataacagattctcagactgtataacctcccaaatttaagaatcattgcattaaaattttttgtttctcttttactttttgttgctctattgataattctttttctcctcaagagggtttcattttccatttattttttatgattgtatgttggtatttttaaatatttactgcttgattgtcgccagtgtgtggtattctcggtttattgcatgcatctgaacccagcccttctctctgtctctcttttgtctggccagcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagaggtatgtaaaccaaaggcaacgccaaccttctgcttttatttaacatgttctgcagtaaacacaaggaccagaagacagagttatgctcttttatgtgaatgtgaatgattaggattgggatataagggcaagaatctgttaatattctctgagcattcttgttagcaaaatataattaccagatccaaaatgtggttacagtagagttgaattcttttatattgtttatatgtggaacatttaaaggctgctt

SEQ ID NO: 123152 - DNA, 1099 bp, Homo sapiens
aaagcgatggagggcttgatgttttgcatcacattagtctgtgttctgaagttaacaggtttatctttcttgttatgttttgtcctagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggtgagtttgtagcgtattcctttttttttttttttttagcattattctatgaatatgattgtcaacaaagaattatacatacacacaaatgtacctgtatgtatattcacacatatagacatatatatatatgttgtcattaaaaagctcttttaatttttaaaatgtcgtctgctcagctcttatagcacacatttgattataagccatgcatgctccatcaagacatttggttttaccattcttaagttttccctatgtcataaaatatcacagagtttatcacgaatataacaatagttataattgtggaatctcaaatacaaatgttaacactaggcttgaaacaaaagaaattaataagtaagttattggtatttttttttt

SEQ ID NO: 123153 - DNA, 1062 bp, Homo sapiens
attttcagcagatttttaaaaacatggttaaacctgtcaatacttttaaaaacgaaatgtttatttagcagtaaatctgcttcattttatagcatcttcatttttctcataacaattttattaaatacattcagttttatgaccctcatggatagataaatttttagtggactctttaattataggtgcaagtatttatttgcctgtgtaatgattcaagtttagatactggctgatgtccgtcaattttcacaaagaacagacagtgccttctctactagttttatttattttactgattactactctttcctgagggagtggtacagtataacgcaatgaatagtctaagttcaaacaaattacatttattttaacaagcatttattaggcacttccattggttagctactgtggttgtagagataagacacacttcataaatactttattgttattcttttctgaaatttctggatttgtatttttgtttccctctctaggattttttacagagtttgctaaggtttcatcaactcttggatttttaccgtttcataatcattacagttctgttcttcatagctataaaacttcaattcattattggctcctcccttgcacttctaacaaatgattgaatgtaatatttttagattactaaatcatttttaaataataaaattaagataaatcattttatctttgcaaaggactttatactctgaggatgcccaaactctttatgaacatagatgactaaatttcactttaaatatatttatttatgaaaagttgaaaaattcatcttagtagcaactgcaaagaaaaaaatgaaaggaattactgtttttatttttctgttattgcaacttattgtgaggatttgctcttcagttatttggagtatcattaagtaggtatgagaggagcagtgggctacacatcagtcttttttaccacaacttgtgtaaatattaacatatagtgactcctttcagtagcataatttggaaagtacaacagatagagaaggattaacagctttagagcttttcctca

SEQ ID NO: 123154 - DNA, 1159 bp, Homo sapiens
ttaatattaagtaaacacctgaaaacacctttctggtagcctcgaaaatcagtgaacacatacacatcatattctaaaaccaatttgttgatgataaaacatatcattatccaggagagtggattgtttgttctttcttaacaacctcctgatgtgtaaatccatcagccaaagaaaactgattgtgatattgactttttatgcagatatgctgaaaatggaactgggtagaaataaagtttgtatatacttttgatagttcatgtatttgtttattttggtgtgtttgtaatgcaagttttcatttatcaattaaatttccttttaattaaattagtcacttgtatttataccatttttacttaaaaatattccagtgtgatttttattgttatattggatcatattaaaatagtgtttattgagtgtttaaagcaatgtcaatttgctaaactagaagttccccagaaggaacagctaactaaaatactgagaagtaattgttgcagtttcccataaaagaatgctacatattgaaatttatacttgttactgtgcaatgaaactgatgaaatgttcaagaaaattgttaaatatcttgctctaaatcatagctcttctgattttcttttcttatttttacctctaagctctttaacatactgggaatgtagtttgcctaaaaactgctttcccacaacactgagcccttatctccctttgtcttccagagatattgtatcagtgccagaagtggcctaagaagcccttgactgccaacattgtgtgtaatatgagaaccacaggaactccctccagggtctcctctattgcatgctacagaggctgagatttcattagtctctgaactttaaaggctttttagtttgcggaagtcccttacaaaatataagtacctacaaaagggaggtcctacaaaaaatgggcatacagtaaatgtgatgcaagggaataatgggcaaaaagcattcaagacaaaattccacctcagtcctgccttaacttctgcctcttcaaatgttcttttttcattgtgcatttgcttaagttttcaatctttaaaactcccccttcctctctctgcttcctttcacagccaagcttcctcttcttgcattcactcgtcagaccttggcag

SEQ ID NO: 123155 - DNA, 1004 bp, Homo sapiens
cacttttatcgcattatttcctttgattcttgataagccgtaaggtagggaggatgctttttcatgttggaaaagagaggctaaaataaatgaaaaacagtatttgttcaggatgatttaattgttaattttctttaaagcagatatttctcttgaggatttatccatccctgtgattccatattttaacagatatcactgtggattggggtaattttatgggtgttcatgttaagatcagaaaatctaaacacaattttattttgtttgtattttgccatgcagcaaaacatgtatgtttaagaatctaaaatatcatattacttaatagtggcattttttgtcgttactttagagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccaggtaatgagccagtggtttctttcattttaattaattagttagacatataaaaacttgctgatcacttagcagttgctgcttccaagaggtcttggtccatgaagtggcaaggtctgaatgttggctaagtttaactagagcagtagccataaagtattgtgggagctcagagtgggtatgctttcataatctgggtgacaggggtggtcagcttaccttctacaagaggggttactggagctaagcatgagtaggggccaccatacttggggtgagcatcagttcagttagaggaaagagctttaagggccccaaggtgaaaagaagcatggtgcattctctttgccagtggttctcaaactgaacattagaatcttctggaggaggctgggcgcggtctctcaagcctgtaatcccagcactttgggaggccgaggtgggtggatcacttgaggtcaggagtttgagaccaggctg

SEQ ID NO: 123156 - DNA, 1026 bp, Homo sapiens
catgttgtaagtctggtattaaataaatagataacagtaacaaaatttactcttcagagatgatttatatgaagccagagtttgcctgcccacgacttcatatggccagttccttcatatattgtctaaattttattatgagtttgtaattacgcattattttttctgctgctatctgattgaatggttaattatatatatatatatgtgaagataagcatcattcatgttctctttccattttctaccttgtctgtttttgtaatattaaaaattgctggtagaaaatcttttcagaacatatcctttttggtgatgttctcttatcttttcagtttttccagaccaccaagactttgttaagagtttttcttgacttagaaactctttattcacttgtataagatattcccagagtctgcattgtcccatgacacattcaccagttcaccatatgagatgctaaaacaatgcacctcatacctataattatatcttctggtctacaaatatttcaagaatttaatgtcttctgctacatttctttgtactaaaactggctttcatgaagattagtacattttcatattggctatatcataaaagttttcatattttcattctctaaaagaacaaaacaacatgaaattgtgtataaatctgtaaacaaatctgtaagcagccttatttaatttctatttgaaattctggatttaattgtgatttgcaagtcataggtttttcaagaatttgtgacacatcacttggcaatctctcaaaaccatgattcatctctctgggctgatgaatcattggttgagttagcctatctgtgaatcaagtggcaccaactcaaaccccatcccatgtaccctgggtgccccgtgttctcccagtgttttaagggattcctgggataagaagatagggggagccccctcagactctgagcctctgcttctgctgaattccatcacttcgtgcatggcttgatgttgcagagatactgtacctgttctttactgc

SEQ ID NO: 123157 - DNA, 1031 bp, Homo sapiens
taatgccatctcacatccctgaagttatctatatctgcaagtcttccctttaattgtatttctggatatttattatccgagggaagaaaaagtcaacttagaatatttatccagtttattgatgataattctgctgaaagtgtcagtggcctttagttgttgaagaactctaagagatgaggacccaaggttgtctgtttccccccactctacctagatgcttcaaagggactttttagagcaccaagtaaatgacaatatgcattgcctcgaattttactgtatagtagtatccaaggaaactctttctagaaattctttaacttttgataaccagaaagatatgagaacatccctttggctactgattttacatttgcccccagaaagccatggatcatagcctgaaacaagcaaaaggaatgagttctatgtgggagccaaatttctagcctaaatatctaagtgtatctttttcccccgaatagttaaatagctctaacaagaccaaggttaaacacaaccccatatagtctacagtaaatataatgccaatacttagaaataggtgtattattatttttcaaacatgctacttgattgtgttctctggtagatgaaaggattagatatcaaaagttaaattcactacttgagatttttcagaatgtttctcactccaagttttgaaaaccttcttggctgcttattcaccatcttccttcactatatttgctgagccagccttggcccgtaggagtctttctctaggagtattagacaagttggcatttgataaattttctgtcctaacaacccccgtaggcccactttcagcacttgtgtgttacttgcaacaccctttctccattacaattaaaatgttatttattttaaatgaggaaattgcaaattttactgagaattaaaacattttcaattcacaattacagttttttttttttaaagctaagcatatatctctgattagtgaaagatggaagtgaaatgaaggcaggactaaggatggg

SEQ ID NO: 123158 - DNA, 1032 bp, Homo sapiens
tacacccctacccatttttcccttcctatattatttgaaaacatatcttagatataatttcttccacaaatatttcagcacattctaattccttataattttgtacatctttcaagccatagtgcatgtttttttgaagtggttttccaattattttttcattggctctgctacattcaagaatatttcgtatggtaagccacagtacaaattactagaagggaagttgacactcagtgactatcaggagtatacttagaagaagaaaaacatggaagtttagtgttgcctattacctaatataagaaagaatcggagctttattttcttttgttcttctttaatgtgcaaaacggagtatacaatatggtggcctgtaggcatgccaccagctcatcttgaacctaatttcttgtatcatttcttgcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaa

SEQ ID NO: 123159 - DNA, 1071 bp, Homo sapiens
actatagtaactgaaaaataataacctgcctatgggttttcattattgatgtatatttggctgtatacatagcagtgacagatcttataaacagtgtatatatccatcaatagaaagattataaagtgaaataattatattaaatattataaagtcataattttattaacaaaaataaacactttttttacagtgttcagttgatcttgaatgatgcaatgaattttgtctgagcctcagaataagtggtagcatttaactttcagacacaatttcagaattgtggacttcaagtagggccaagtattttgtctgtttcactttgaatcatttttattgctgtgtcttcaagttcactaatcttttcttcaataatgtattatctgccttaatgtctaatctgccatccactgtattatatatatcaaattttgaacttttcctctctaggggtttaattttggtctttttaatcttttccatattgtttccacttaacacagccattctttagtttctggaacatatggaatgcagtttttaaaaaactgtcttattgtccttttctactaattctatcatctgggtcggttctgatcagttaatttttctcctctttataggtcacacttttccactttctacttcataatttcggattagatgccagaattttaccttattggctactagaaacttctgaattcctaaaaattttacggaggtttgttatggggcatggtataggatacttagaaacagtatgatctttttatgtcttgctttttaaaaagctttgttaggtaggaccagggcagcatttagtctagagtggatttttctccactatcaaggcaagacctttcttagtactctaaccaatgccccataaattatgggattttcccctccggctgttgggaacagagctggcggccctttgtgaatactaggcactgttccctctaatactttcaggtggtttttccctggctgcaggtagtttcctcacgtgctgatcaatcagtactcaactgaatattcacagctctttggatttcgctcggtgta

SEQ ID NO: 123160 - DNA, 1668 bp, Homo sapiens
ctcttaaaaattgtgctgtcattcattatttacatctcagagtgtgaactttgaggatcttgtacttattagtaatgttatatttatctccatgcaagttgtgtccagcatagtacataagacacatgggcatttcctgcttattaaattagtaataatagtccaatgcttatttgaaatgaaataacttagatttggcattgtgattgtcacttcatggtgtatatgtgactgctggtcgtctccaaatgagatcaaatgatcagcatacagccaaagtgaaatttagtgagagaacagagcctagaactgaaagtgtgttttttctagcattggctacaaccatagagtattctaagctggagccacagtattttagccagagctttcagtcaggttaattaccaagtaattttttaagaaggtactattacatttctaaaatatatagacctaatctctgagactcagagaagaaaatttgggccctccaaccttagtttgtattttagtctttagaatccaggatcaaaggatagcttgaagaacatacctatctgccttattttgtattgtttcttaagtcctctcatgcccttgctaatacagttcaagtcgagttgaacaaaagtgtgtcctgtcctcaaggagctgtcattcttcaacacccactcctccccactttgagagagagagatagcgtgtttgtgtgtatatgtatatgtacacacacacacacacacacacacaccctctggtgctattacaaacatttttatagggaacttaaataaaaattcatatagaaccagaatctatcttagtatttgaacaactcattggcagtaaactcagttccttctgtacaggattaatggtttccaagctgtaaattatgatttagagccttgtgcattaagattgactttgagccaggggaggcttggaagaggacaatgtatagtttgctttaggaggtcttggagcacatttgtgtggggaaaacagcagtgagttagagtgaagaacgagaaatgccagacgcaggggatggtatctggtagtctatgtgtcctgttgtgcagagtgctaggaaatccaaagcgacttcagaagtagaactgtggattcttagcggtgctaatagtgtgagttgagtgatgaggaggtggtcgtagttgaaataggataggataacagagctcgtgaccatgagaagtagacaaagagatgaattaaggaaatataaggaaggaaaaaatatattctggaaatgggctgaactgggggcaaagaacagtagggttgaagattttgctaaataaatcattggctgtgaactcttggctctcgtgagatgcatgaccattcccttgctcaggcatttccacctcctggaaagccttgtctttgcctgtcagaatattcaagccctaatttaacttctaccagctgcataaatatttgtttcatgacattagctcatagcaatctcttttttactgcactcatgtactactattataaatgtagtagcacttaattgatgtttagagctataatttaaattttcacctgcatgctttgtgtctccaataaggttccaaatttgtatagaattgggtagtgtaaaaaaaaatcctctctattgtccaatacaaagttatg

SEQ ID NO: 123161 - DNA, 1097 bp, Homo sapiens
ccaaggaggtcatggcagccaaaagactcaaaaggtctgatgtagacgaaatcctgtgttttactgcagattaaggctttagagtgtgagagttacttaaggtcatatggtggagccggaattaaaagtagcgtctttcctgcactgtgtggcctcctggcacctcaaccctggtcttagtgccaagggaatgagtgcctttggcttctttgatgagtactttgattatgacgaagtccaagccagcttctgtctttgtttgcactttgctggtctgtggtggctttctccccacccctgctttccaggcctggaggtggtggtgaggtgtggtcatctccagccatgcctgcctctatgtcccatggcatcacaaggcatgctgtcctgtgacagctaggggatagtcaacagaaacaatagaatatttagccttgattgcttgacctagttttggtggtggtgtttcaagcaatgtgagtattatcaggggaaatctttcagccaacccagtgggctttgttaaattaatttaggaactcgtgtcacattatttcctcctcactattaggctaatagatacctgaaatatcaacagaaaaatatacagttaacagctagcatttagagttcacttcctcgtgccatttttaaatgctgtataattctgttaacaatattatttgtatccccattttctggatgaaaagactgaggcacggagaggttaggtaacttgcctgaatatttgtatgtctggcaagtggcagagatgggactgaaagcaagtattctggctccatggtccatgatctgggccactatgctacatgtccagttattactttaatgctttaagccatagttgtccaatctgtctttctttggttcggggttagactacgaatgagtgtatctgggatgaagagcctttggattttttttttttttaaatgtagtcctaggaggaactcttcccagtctgctggagctgtctctgaaaggtactatgtcatttggttcaaagtctgttcggctttaatcccttgcttgtatatattcaggcaatatggggaaggaaaaatatgttcataccc

SEQ ID NO: 123162 - DNA, 1031 bp, Homo sapiens
aaggatttttaagaatcttgaagtttgtcctgcatcttgaagggagtgccctacctctttcttggaaagtgactaacagaaagaaaagttatgctagcttctgcacgaaaccatcctgggaagtattgagaagtggtattatgaagctagctaccaaatattatttgagagaggctttgtaacttttgcataaaatgttaggaaaagtacagaaatattttcgccgctctagatattcaaatgcgaaaaatgtgtgtgttgaatcattttgcagttcattgttcaggtgattgtgtttgttgattcagtgtaattttaaataaccaaaccatttgacatttgtcttgtcatgtttatggcaagaaccctggaataaagattatttatctctgttaatgaagaagtcttttgagaccatgtccaaatgagtttcctaaataattgtttcttgaatagcagtaagactagaatctagacacaggttttcttgaaagtgaaaacatatttcccatgactacatggatttctagttagtatgtatagttactgctatttgtcttctctattgttagcaacatcttttgttttgttcttttctggagcaactaccttctaatactagtggataacatctgtttcaacctttattttttaatactgagattatcaattaattttgttaatgtggttagtgggtttgggggagtggcagtgcatggccaatttcaaattgcacaattaaaaaatcttgtgcttatggctttggaataagtttttgaactttcacttgaatatgattgtgtttgatgttcagagactttttgaaatattagtatgtttgaacatactaagtctaccttgggaagacctaatttgggagtagctagaaactgtccaattttctatttcactcttctgctcaaccctctagcattcattttaggctctctctctagttaagttaatgcttgctttctctcaaactttctcttagagctgagatagtaatttaatgtttgaaattcaggaaa

SEQ ID NO: 123163 - DNA, 1030 bp, Homo sapiens
tgcttatcttcagaacagcttggttcttttaatagcaaatggctgagtggaggggaaccatttgcagtgggtcaatttaagtatggtgtgtcctcccatttcagaccgaagtcatgctaactgctcagggattggtgcaactgtgtgtttcttttgatgttggtcagatcccagaaaactcagtattttagaaggatgttgctcattccttagataatttgaaaaattattggtcaacttaaaaaaattcaggagctagggaacacctcatctattctttttatgaatatgttaatttattattctgttggaggctgttcttaaaattcccatgggccaggataggaagaggtaatggggagaaggcttgttttttcatgcaatatatgaacctagcgctatatgatcatgccagattcagtatacgcaaatggtgcatttctctcaatccagagtggctggaaaatgtgtgctcaaaattgagaataatcatatattccattcatggattaattgttttcaaataatgtagtcaattatacttacaatgattttttaagttttaataacataaaagacacttcgtatatgtaagcctgtggtaaatcatggtgtacctcatttactagtcaatagtattggtgttcaaaataatggtggtgattggattaattctcagtccatcccagaatttgctgttttgaatatacagcttgtttttaaggtatccacttcttttgggaaagtagagataagaaaaaagtctgcttctttaaatgtcttgtttggattgggggcacacagccattttttttctagtgagtagatataaaggatttcccaaaaggtggctgtggcttcgcacaggagagctggagagctcttggtacatatactgctgagtgttgaaggcaggtgagtctgttctatgtttctgtgcagtgggctcttgctggggtcaaagctgtgtggtgtctgtaaaaaagggttgctgtgtaatgctttagaattggaattgcagattcttctt

SEQ ID NO: 123164 - DNA, 1033 bp, Homo sapiens
aagaggagtagtgagggggtaggtggacgccaagaaaagcaccattataggagagatgaattatagagtttccaaattatcaatttcattcactgaaattggtgttcaattgagggtattctatatgccaggttctatgctagtccctgtagatacaatatgaacaagacatagtcttggtcctcaaagaattcattggaagtcagagatcatggcccatgtggcactattgagtgacttttgctgggattgcagtttaaaccagggaaacagaacgcagcctgtgggtgagccatgtttggagacgggcatgggagggtcagaaggaggctggaaggctgcctggagaagagactgtggaagcctggggagggtgttaatgaagtatctgactgtgtgatctgcagctgctcagacagctgaagtcagatggcctgggatggttgagaatcagggacccaaagtcaacatgagagcaaagagccactccagcagctgtgaagaagtgaaaaccaaggagagaagggggtcttgcattagcaagtggggatctgagtttgagatagaggagaaggagcaggtcaagaggataatggggttgaatttgcagtgctagtggagggctcaagaggttggaggatggagtttattataacgggagctcagagaataatcatctctaatttattattgacgctgtgctcaacattcaacatccatgttcttcctcaaaagctccctgctggatagtgtaagtgccactaccatagaaagattctacttcatcatgcctggtctactacagcctcttagctggtgctcctgactcaaattactctgtttgtggtcagttccttattccactacaaggctcatcttcttaaaacatcacgtttaataggttactgtgaagatctaaaagcttcactgagtacccattgcctacagtataaaggatgtgcccctccataaagtgagaaatcgccatttttgccggctttcgtaatttaccaatgactcttacacacataat

SEQ ID NO: 123165 - DNA, 1061 bp, Homo sapiens
ggatttctgaagagccatggctcagaaatgaacccttagaataatatattttaaataggtttacagagaactttatcattctctgtagaattacctataaaccaataatggatggataacatgctgcagagattaggcttccctccccccgaaaaatgcaggtgaaacaggttaagaggttacacactgactttagggcagagttaacaagttgtagaatagaactggatagaatagagggttgttcccactgctcttcatgccatttctctggctatttcttgattgagagaaaggagtatgggctttgaagtcagacctaaattaaagtcgctgtcctgtcacttgctagttgtaatttgggcaagatactaaacctttgtaaatttcagttccctcatctgcaaaggggagtcagatcacttgcctggcaaaattgtgatcaccagagatagtatctgtacagtacctgcttgataattagctgttacgtgatttttcttatgattatagattatcaaatttttcaagggaaattgaattgcacacttgccgcattaggaatactaatgcaactgataagagcaattgttttactgtggggtttcttcgtgctaggcaccattccaaatatattacacatatgatgacctcatttactctctaaacaacctgatcatgtagatactactgttattcccactgaggctcagggagtgtatccaccttgcccaacgtcacccagcaagtttgtggtggaaaaggtttacaaacctgggtgtttgtgactccaggtcccactttccagttcctgcctggccaatatagggatgtgggatagagaatgaaaggactaattgtttcatgagaatgatttattgagtgggatatttgctttcggaatcttcacctttcccatagacattattggaaggggcttgcacccatccgtcatgtaacttttgctctatgttacgaagcctcgccgagctccactttcctttttggtacgatggaatgattatacttctgagagttgtagcgagcatttaagtgggatg

SEQ ID NO: 123166 - DNA, 1712 bp, Homo sapiens
agagagtgaagtttatgtttttataaaactagcacatacacactgctaaatgaaaaaggcttcaatggaagaaccacttacaggaatcagcagactgaaaatcttatgatttatcccagtatgtagagaattcaccttggcaacttgctgaaaaaatgtagatttggagccccagccctggagataatgatgtggattgcccatagactcaactttgaggaacctactcttaagcatctagttttggaagattgctatacataccatcctacatcatttgaccaggaaggaaaaaaagatgagaaaataagatgaaggcaagaaaagagacaaaaatttaagtcctgaaaaaaacatttctaccagatttttattgtttaaaaaaaaccaaaatttcagtggatgctagatagaatcacaactgtaagacaaaacagaaaacaatgtgaagtgtacaagactgcacagaaaacatatcaagatactgttcaagaagaggtaactggctataaatttaaagttcaagtgttaaagttaaaatgtagctctaagttttattttcccaacaacttttaaaattgtaatgtgatggatgtgctacttgtgatatttttggtcatggagcaggactgttataaacaattaaattggtttacttaatttttctcctgaataccaattcgtgccagtgaattatcaaggcgactttcaatttccaagatgattttctactggtcccagcgttgttgtgaagatgaattaaggtctgaggacagtgtctggcatattatcagtggggacagtgtagtggagtggttctgaacacatgctgtggatgccggagaccctgcgttcaaatgactgctctaccactaactagctctatgcccttgtccaagttaacttgatttagtttcctcatctgtaaaataaaaaaaaattagtgcctacccatagaattgttttccaggaataaagtagtaaatgtaaagcacttggagcactgcaagacacgctggacactcaataaatgtgatcttgaaacataacttctgttgtcaagttcactgttaaaagtaccttaaagtttttaaaaattattatgtaaaatagggacatataattttataaagttacagttgtcttgagctttattcagtttaatttatggatcatctacttttaagtgccataaggtactccaggctataaaatgatgagtaagatatggcccctgtgctcttgaacagtcaaactttgggaagttaacctgttgacatggttttcttgagtaggtattatgctatgttaggaaataatgttgaaattaattaaaactatattttacaacacaagtaaaagatagtacctgaaagacagaaggagaggctaataatatatcgtcccttgatatattatagattgtagcagatcacactagaaagatgctgatatttttcctgagctggacttaatacaatggatggaacacagatatgacatcataaaacccagctattaaaatggcaactctactatttattgattatataactataagcaatagacttaacttgtgcctcagtttcagcatctgagaaacaggcacatagctaccttgctcagttgttaggatgattaagtgagcgaatgtttgtgaagatgctttatgaactataagcttttacgcatttgtgtggctttatcatgat

SEQ ID NO: 123167 - DNA, 1081 bp, Homo sapiens
attttatttgatttccaaacaatagggtagtagctaagttttgaaacaagatctgagaggaacttgcagaagcatatctatgtttgcaaaagcgttctagatatgattttgattcttgaaacctatttgaaaaatagtaatcagaatataaataatctttaggtttatcatatcagagaaaatacttactggttatgcgacgttttatgtgtttcacagcatatttattagctatgaattgatttgtactttgcatttctcataaactcccctagatgtgataaggtcacaaattttctctgttaaaaagggcaggagtggggaaaactcacacatcatgtatgcactcaagttttgacatattgatttacaaagaaaagaatcagtttgctagcagcttctatgaggtaattttataaggagtaaaaaaatataaatagagttcacgcagaatacgaagatgagcaacggaaaatctgaaataaaagtggagttaatattatgcagtgattcttacctctgctgttagaagtataaaagcactgtgatccttccatctaaactacagaggtttcagctccatggcaacacgaagaacctattctgtcagagggtgtgtatacacaactgcattcaaagcacggggctgggagtgagtttggggggaaaaacctcaaccctccaagacttgcccacgcatttttatgtgtgtattataataaggtctttgtgcaaggaggcctgatagaagttcacatcagctgcactctggtcttttacatgatccagccgccatcacccacctcccttctctctccagaaaggaagccagaagaggcaattaaagaatgagactgcaagaaaaatgctcttctccctctctcttcttggaatgtcaacatagttattgcttttctgtgtgtctcaggggggcacttggctgcttctttccacagtcttattccagggagagctgtttaattgcagccttcatgtagagtaggcgctggcaagagccgtagtcagctttcttctctgtgcaaggagtactttcggtaggtcatctgatgtcctgccttgt

SEQ ID NO: 123168 - DNA, 1030 bp, Homo sapiens
agagtgtggggctaactctggagaaaccctaacttttacaggcctgattcaagggagtgatgccaccaagattaagaaaggctggctagaggtccataataaaagagagtccagtgtcatagcatctatgtgaggagaggtgcaatagagattttgccagggctgctgtgataaagtcccacatgctgggtggctgaaaacaaaagacatctattgtctcacagttctggaggctgcaagtgtgaagccaaggtgtcagcagggttagctcttctgagggctgtgaggggaaatctgttctgtgcctctctcccagcctctggccatggtttgcaatcctagttgttcctgggctcctcattactgtagtctctgcctcagtcttcatgtagtgttcgccatttctgtcatgttggataaggggcccaccctactacagtgtgatgtcatcctaactaattacatctgcaaggaccttatttccaaacaaggctgcattctgaggtatggaagttagaacttcaatgtttctttttggggggccacaattccacacataacaagaggattcaagcagatttccctcttgcgtaaggctctccaggggaagcagtgacaatcatgacccagttcccattcttacacaatattttaatattattgtgtccagtgaggttcaaattaagtgtttaatggtagctgaggtaaatgtaaggagtaggaatagaaagaagattaaatgggggagaaatagtggggaaaaacagttcttagaggagatgaaatttgaattgggccttaaaagaaggggctcaggatttaaatttgtggaaagttgaggtagaaagggcattaccggagaagaaaacctgcatgaagtcttcatctggaaaaatattcaaagccttcaaaaagtaggaatctgctctttgtcacttagcataaaagaaccatgttcttgctggtttccctttgtatggaaagaatattagatatttatgtttgatgaagagacttttggcatgagtaa

SEQ ID NO: 123169 - DNA, 1897 bp, Homo sapiens
atttttattttcaaagcaaaccaggtatacggagaagtcttatatgaacagctcaatgagtttttaggaaacacatctgtgtaaccaccacccacatcaacatatcaaacatcaccaataccccagaagctactctatcccttccgtgtcattagccccttaaaggtaaccaccattctgacctctgtcactgtagattatagctgctcattcttcaattctacagatttccatagaaattcctatggtattctgtaggaatcatgcagcttacgttgctgtttttttttcccctagattcttttcttcagtgtgcgtctgtgaggttcattcttgtggttgtgtgttctttttcattactatacaggactgcatttgttctttttcattactatacaagattccattttgtatgttttaaaatttatactccattctattgctgatgcatttctgtgttgtttccaactttcagctatcaagaataatgcttctatgaacgtgcttatacatgtaacattggtacacagggatatgcatttctggcgaggaagagacttactgggttatagagtccacatatgttcagcttcgtggagactgccagttttccaaagtggttttaacaatttacattccctgcagcagtgtttaaaagttccagttatcctgtgtcctcaccaatgctttgtagtgtcaacgtttttttctgatttattattttttttaattttagctattctattggctatgcagtaatcttttgttgtgattttaatttggatttctctgatcactagtattgttaatcatttttatttccttacctgccatttgaaattggtctttttaatgacgtgtgtgttaaagtcctttgccgtttaaaaatactgggtagtctttcttttactctggcttgtagaaggcaagttttaaaaaaaatttgttcattttcagttatatacatgacaaatatattttctttctttatggcttatcttccctctttatgacatcttttgatcaactgaagttcttactttcaatgaagtttaacttattaatccattctattattgcattgttgttttttgtccttttcagaaatatttacccaatccaaggtcatgaagatattctcctctgctatcttctagaagctctgtcattttgcctttcgcatttctggtctgtctgggagtaatttttttgtataatgtgaggtaggaggcaaggatcattttttctcacatgggtatccattctttttcccagtggcagctttgccctatagcagttgaccgtttatgtgtgggtctgtgtctggactctgtgctgccccactggtctatttacctatccttgcactgataccataccattccgatgactataactgtaaattaaatcttgatatctggtaatataagttctccaactttgttcttcaatataattttttttattcttgagcttttgcatttccatgtaattttagaatcagcttgccaaatttcacacacaaagatttagattattaattgggataataatgaatcaatttaagtagaattgacatttttcaatattgtaccttccaggaacctagtagatgcctccatttcttaagtcttctttcaccttgtcagtaaagttttgggttttctttgtggaggactgcacatcgttcactggctttattcctagttatgtgtcctcttttcagtagagagctgcttccagtttgtataaaagcaaaatcttcctttacggtcacacccttaaacaaaacattatagaggaactattttgaagctgaagagaggaagtgcccttgaaccttgaggaggaggtgcggagttttttttggttgttggtttgaggtaggtgagatgca

SEQ ID NO: 123170 - DNA, 1951 bp, Homo sapiens
gctatgatctgctatttagaccttccatagaatttgcctaaaaagccatgaaatcttggaaggttataatgggagattaaaattagagaatactgtaatatttactgaatataaatagaaacttcttcccatggaatggagtcattattcaaacgatgtagtagatgaatccacagattattaaggttggtgtgtcagtggtgttaaataatataattagccaattctgggatgaatttaatttctgtgccattagaaggcttgtcctcagagcccaaggatggattcccatctacacagccaccaccagccctccgctccacctgcgcctcacatcgtctggattttgtttgaagtaactattgcagctggacagtttccctcagatgggcagcaaggctgtgactttctttcagagatctgctgcaggcatttggaagtgtcttttgcaatggaattgtttgcctcgtagggttcttcccaagttagggtgttcgcctgtggctttgaggccttttccttcttctcagtctaattctttctggtgctttagccatgatgttgccctcactagtttcaaatccagtgctttggatggtttccacatcattttacaacatttgaggatatattttctgcagtgaaattttgtttcatcttccctttcagtttttggaattgagcactactttgttattaactaagaagcatgcattttggttacagcagtttttagaatatgtcccagggtgttcctggtgaaaagggcagcccatcacaagaaattataggggaaggaagagctggaaatcatgagtcttgagtacaaaataacagtttcccttctgcccccaattttggtatatttgaagaaaagtggtgtgtctaacaaacaaacatcactgtactgaagggttttgatcaattctttcttaagccaattcatcaaaagtggcacatctcagagaattggatttttttttagttcaattagagccacactcttgaaggattaacatggcacctctggtctatttccaaacatatcagctgggtcttgtcagttcaatttagccatccacggggcctggcatggttactatggccttctccaactttttccttttcttgaatgtgaaaagcatgtcgtaactccatggctttgcaatctcctgccccaaatgcccttctcagtctttcctgacaaattcctgctagcttagttcctatcttctttaagaagccattcctaactccccaagcaaagttagctattccgttacttgtgcttgcacagcactttcatatctctattatgcatgtctgtatccccacaaaaatgttaagctcctagtgcaaaacagcctttgaattccaagcacttcgcccagttgtctggcatacagtaggatcaatacatatttattaaattgatgaatgaattcgctatagccaatttccataattctttgccagttacatagctactattattttttttgtgccaggcactctacagtgattgtatcattaaattttcacagtggcgctacaaataaggaatgatcgcaattacaaatgaagaaactgaatctcagaaaccttatataatttgcccaaatgacgtagctcaggatggtagaagtgggatttgaacccaggcctatctggcctcaaatgtgtggccacattttatctgaacaagcaaaacattaattgattcttgataaaaacagttacattgtatagcttttataacagtaagttaacaaaatgtaagaggaacatcttcagggtattttgaagcttagtttcaaactgtttagcgtatttcagctgtctaagataaaccagtcaataattaggtacgtatttttaagaaaaagacattatgaaattcctgatctccaagagctgagttgtaaatggagataggctttgtaaatcatca

SEQ ID NO: 123171 - DNA, 2047 bp, Homo sapiens
gcagcattcaactgcccagcacaaaattagtgagaaaacaggcataagaaagcttacaggatctgaaatccacagggctttcgtttttgatttacactaaagttttagaagttagacatgattatcatgaaaggagaatgtcatatcccttcctttctattgtctactttttttttctcagcaaccaatcctagaatttatttgaagaggagaagaaatgagtaaatcgatgaattagaaaagtaacgcaatctttttgtataaatactaagttatctccaggatctatgaaaatatcaaaagagagaattattgttttaatttattgtaattaaaaatataagcatatacaatatagcacatttaaatggagctggctcaatatctaaaatcaaaaatcgttctctccttatagcctatttaactttatattctcagcaacttgcagcacatgacaaacattaggcattcaataaatgttggtgattgaaagaatgtttatgcatgtgcttttgaaacttggaagaatgtcacatttacatttctatccttccaccgtctttctgtcctcagtccactgatgatcagatgaaagaaaagcacaggtggtgttagcaaatgaatcagaatttccaaactgtaatgcaggtggccatggacagttgtaggagagagttctccatggcctgcaacatgtggacctggactttgatataattcaatctaacaaacatgtattgtaaatctatgatctgcaaatcaccctgatagatattgtgaggctgcaggatgagaaaaacacaaaacagatgcagttttaaaggttggaaatggcatatttgagatagaagaaggcaagtaggaaaacagctccgcaagccaacagcatagtccccaaagggccattttcagtttgacaaggagaagcactgtcgttattctggcctgtttcctcattgcaaaaatagaaccatgaacctttctcttctgctgataataattttaaagcattgtcagtgaagtaaatatatactgaaagcaataaataaataaatatttaaactccagaaagattgctgagcttcagtgatgctataacaggaaataacaacaatcagatagtgcctcggcttactgaagaactaattcatgtttataaagtgctttcagaatgcaaagcactgaagaaggttaggatattattattattaccaaagatctttaagcagacaagatcttggtattcttataatcacagcaggagttgttcatttcccatgtaatttatgaggagaaaaaaataataaaccccacccctcttcacacttgatttgtcagttgttcttgttatatgaaactgatcctcaagggaaccttaatttaggcaacgatttattctcttcaatattattttgacatttggtaattactacagattttgtgcatctgtctttcccagaagagaaggcattaaatgccacttggatgatcattggttttgcaggaactcagatttgatgttattcttttggtagatagcatgacttatggtaagtttccagctctgggatacacagattgtgcctttcattactcatggagtctgtgccacactgatattagatatttcataaaaataagctattggttgaaagaagaatatcttaaatatttcatatgaaaaaaaactggccttttccaattttccacacgtattctaaagtaactaagatatctggaaattttcaaaaatgaaagtaagaaactggaacagagatcagaaattccttaggaacctctctctaggactctcaaatggacctcccaaagaaaacaaataagacccccaaaaaccaggaacaaggagagttacatcaacaatgagtcagatgctttcagaactgcttcatgctattcctgtacataagcttttttcttatcaaattttatggatgatgatagcttcttccattgtaaattttcatctgtgatcattagttctaacaagtccagtcctcccatgttagattttgcagatttaaatttt

SEQ ID NO: 123172 - DNA, 1397 bp, Homo sapiens
acactttctggaaaggaaatacaattattttctctaagtgaacctaagccggtacctatgatcatttaattttctacatccttcagtgagccattctagtctttcagtgattcatcatagaaccttatagaacccttgtcaagctgattgatttataattttcaggatccatattcttctttcaaacaaacagcacagctatatctgatggcctccaagtgcccagcctaataacttgcccaagcgctcacagcccatgagagccaggctgggagtggaccattcaggggctgccctatctgtacctgtgtgccgtggtacctgccctctctgtacctgtctccatggagccttgtaaacatctagttagagatgctgctaaatttaaattgtcattatatttcaccaaacatatttcattaagtcactgataaacattcctggcatttttgattattttccttttcattcaagcaaggatgtttttctcctattgtttttaccatctctatatctgtatccaggaactgagcttacagctaatgatctaattcagatatgtgtaaacctgggtataataattagcccagattggtggaaacgtttcccctttacgcaacccatttcatccttatcaagtacattaattcattggctctggtaatatagctaattaccctgtatattcaggtgctgctgctgatattgctgctatctccatgtgctgggataaacagactgttgttagtaaacattccttctgatacctaccttccgccatcactacgcacgtactaatatgtcttttttgctctgttctttttcccacaacagtttaacctaaaaagggccacttcatttccttaggctgcacttctaatgaatgcagacatttgaaagggtcctgaaccggataacctttcgagttttctccagttttattattctgtgaagacagtttggtgtaaatgatttaagaggttagtcagaatggagttctctgttcaaatgatcttcttaaatttctgtactgagctctactcataggaaacgtggagcttgttgtgggattcacaaggttgcccttgcaagtacagaataccgtgcctgccacacagtaggtccaataaataaaacaaaattaaacaaagttaatttaaacaaaattaaagcctccctagagctaatgattttaacttattaccatataataactagcaagttagtgtcaatctcaatctaaattttcaaggaaaactgccccggtagaaatattgtatttttattagcactgaatttgtactcctaacaaaaaattaatgaaattccttaaaagctgatataaaatgtaaattacttatccttggacaaagaattcagatcttccttatttattg

SEQ ID NO: 123173 - DNA, 1070 bp, Homo sapiens
gttgctatacagttttccattttactgagcgatgtatttatgttgctgcataatgtcgcctgattgcacttctcatgctggtgaagttggctgacatttcaggctctggataacatgaagctgtgctttaaccttatttggaagtcagggttagagtggcactggaaggtctccttcagcttcccttcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttcttaaaagctcaagccttccagactcatcattttgtagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccag

SEQ ID NO: 123174 - DNA, 1206 bp, Homo sapiens
aaactatgaagcattttcttacaaaaaacttcattcagtgtcctggcacagatcctccagttgaacaggggccttctttccaaagccccaggtaaggactttctcaacctgtattctaacatgatgggatgttgtcttctttgctttcctatcttatcattgcaaactctcaaacattttctacattatcatcatttatatttatactagcacacatgtttgaaagcgatatgatccccattgaaaactcttttcctttaaaagtcaatcccatttctagaggtcttgacaatgctttcttctttccatgccattgaagttgcattaatgttggtcaaccctggatggctcgggtctcatactcagaggttctgatggattcagtctgggataagactgagacactatctatttttttttaatgctcccttacatagctcccttacacgtttgaagatctttgaatttgttggtctcacaagcatccctggggttcaaaaaatgtgggtattggaagaacacaaagtgagggaagctgtcctggtgatatctagatgtgagctgaatggagcttatggcaaagagacaaacctgagttaatctgcataatcacgcacacttaactctaatgggttagttatagggtggtatctctgcctcagtttctattgcaataaaatactggcatcatctcaagattctcagaaaatttaattaatattaatatttaatataagattaaaagcatactacaagtttcaattagcattaatcctttaaaatatggagttaaatgatctgtaactaattaaagactgcagttaacaggggacatgagttttttctgggttatatgaaacaaaatataaatcttttatataactcaatttcctacagaaaaaaaacttacttgtcagtgggattttaaagttttattttattttcttggatctcattacttttccatgaatcctataagcagaattacaatgaggtgagtcatagacttaacacttttttggagtttcttctgccaaagcagcttgaaatatagaggattttcaaaaactgtgtttggggaacatgggaaggtatgggaaagaaaggaagggtgggagtctaggaggaaaggaggaagaagggaaagaaagggaaagggagaggaaggaaggacacaaaacattttactttagattacatttaaaa

SEQ ID NO: 123175 - DNA, 1039 bp, Homo sapiens
aagaagttggtgttgtataccccaggactttcctatcaatgtcctgtgataatgttgctgttttggaagagtcctggagacttgaatggctacagcaatagtggatattttgaaaattatcagaccctgtgacctatgtgcaaagagagccaaaggaaaggaaattaatcttttctggatacttctgtgtaccaagtactatgttcagtcctctatttactctctataattgatcttctatgaacagctatcattccattttacagatttttaaggtgtcatatactttaaataacttcttcatagctaggaggtggcgagggaaaatgcaaacaaaagtttgcctagaaccaaacccagccagcctttctactttgctgttttccatggcgtatgctcagttaatgtctgctgatcaccatctccaggacagaatctgacagctagtaataattggaaacatatgcagacaacgtttgattatctgtggtgttgggaatagatgctctcattagttgttagaaaaattataaaactgacattgttgagttttacattctatcttaagatatcagaacagctgttttaacagataccaaaataacagtcgtttaaaatcgatggtctggaggttggcaggccagttcttcctcatgaggtcatctagggcctgaggctctttcatctggtggcttgtggatcttctgaggttgttcctcatctgcatagtggcagatggcctaccacaccacgtctgcatttaagccattaggaaagaggggatgagagggaagggcacatttctttccagttgagggcatgacccaaaaattgcacacatcacttttgctcccaaaagttgcagggttgcacggacatctaactgcaagtgagtctaagaaacgtcgtctgtaagtgccagtatgtctattcttgtggaaaaaggagaaaagagagattgtgggacaaatagcagcctttgccataccttctttcctgtcccaatctttgataaacctacaaataagaaagatccaaa

SEQ ID NO: 123176 - DNA, 1045 bp, Homo sapiens
catccatgtcttttacctcggggttgtttcctcattctgataattttgttgtcactgattttaccagacatgtcttccacagacttctgtctgaagacactgtctgcaagatttttggctgacttgttcaatgctctttgtgtaccaaacacatgtagcacaccaaactctggtgtagtccagggcagtggggcaggtaaattggcttccctggaaaatatgtccatctatgtgccttattcccagttcgtgcttttaagggatggagcacaccagccatgaactaaggctggagtagcaaaacatgaaatctgctttctacaaattatccagataatctcttccaatccccttctggaggaaaaacagagctgtatgagggtgacagtctggcaggtattcaaagctgcagtgaccatggcttggctcctgttgtatccacagagctgtttgattgggttaatttatacagtttttcctgtatgaatccttttgataagtatctttagaagcttctaattcattttaaaggaatgtttctctttggcttcatgtctcattcttttcacattatatattctggtgataaatgatggatccataaatacattacctttgctcagtcagtgttttctgttgttgatgtaaagtacacaaattggatttgtttcaggatagctgaatttggaatatgacattttgccaagtcagcatcacacttgcccatacaacacagatgtggattttgcagttgttttgtttttaaaattgtatatgtctgtggtgctattgattaatgtaatattgcattaatgtgctattacaacactctagggcattcatgaggtctttcagccagcagcaaagaattccccaaacaaaagcttttaataaaatacagattgcagggcaaagaaaagtatcaaccgtgagaatttatggatagcagaagtgcttgaggaatcaacttttgatggccttgccaatggaaataccgtgtaattgttatattatttcatttccctccaaatcattaaagatcatc

SEQ ID NO: 123177 - DNA, 1155 bp, Homo sapiens
aatagtatatcttatttaattcaacaaatactaaatgttaccatctaacagatagccagtattttaaaattataaagatattttacatgctttattttgtgctcaaataaatcttcaaaatctggcatttacacttacagcacatgtcagtttaggctaatcatatttcaagggcttaatagctacatgcatgttgtagctactgtgtttgatagcatacgtatagatgatggaggaaaagcccagaatactaaataaaccatgagttctttgatatgcctctggcacagattctaggtggagactggtggaagatgaaagggaaatgtagtcagatatcagagcatgaaggcctcagataccaagtcaggggatctctccatttaatcataaaggcattgtggagcctttgccacctttgaaagattttatatagatcagatttgaggttttgaaagattcctctggcaaatgtgtgaaggatcaattgtgggggccacagtgcaaagaaagttggaggtatttctcaatctgttctgtttctctgtgtttaatggaattttcatataaaccccagcaattagtagacaggcagcccttctgaattagcagtgtttcctgagtttttaattctactccagaacttcatgagaattaagggtatggtggaagcagagctaagaatatcaggtgttaagacagaaagtctggcatgtggacaccctgaggctcaggcggagcagcccatgaagtgcggttcttagtcaaatagactctgtcctccaccaaaccatggtgcacaggcagtacaccatcaccaaatgcatgtgtgcaggccagctgtccctgattgtaaggtatacatcaaagggaactatccaccatcccccaaacaccttctttgccaagatgcttcttacccctaaactctagataataatccttcctttgaggtaaaaattgatttttctagcccatcttttctaaagaggcaaatgtcttgagtaggttacatgtttttatcaccataacctgctaataactgagttatttgcttccctttccctttatggcagaatacaagcttcccaaattcatttttctccccaaaattgcctacttcacagggtcctttcttcttccttttattttgcc

SEQ ID NO: 123178 - DNA, 1041 bp, Homo sapiens
tctatccatcagcagagggtattagaaaagtggtctgaaaaaaaaaaatcaacaacaacaaataaaaccataaaacacagcctttacagttaatcctgtgctgggctcaaggtaaatgttagtcacttttaacaaaggctcaagacagccctggaagtccttgacaaggaaagaaacaagccctgggagtccttgagaaacgctgtttcagcgaacaactattccaaacccctatgtgaaaaccctgaccctggtgagcaagactgaaccattttagacttgcgtggagcccttttgccccttggcctgtatccctgactcaaaccagactttcctgacaacttttccctcaggtccaaactcagacttggctgtcatcatcttgccacttctgggatgaagcattaagagacagaaagaaagtagctagggaaagagttcatttccatgccgctctactgttaaacttcctatcaaaagcttcactttgtacttcattttatttaacaaatacttccactgtgctcactgtgtgtcaggcactgttctaaggaatttgcaaacatcaactcattataatactcaggaaaaccctgtgggtgggttctgtttttctccctattttataggtgagggaactgaagcacagagcatttaagcaatgcaagtcgagcatccctaatctgaaaacctaaaatctgaaatgctcgctcccaaacccaaaactttttgagaactgataagacaccccaagtggaaaacttcacatggagatacctaacacaaactttgttttatgcacaaaattgtttaaaatatcatgtaaagttaccttcaggctgtgtgtataaggcatatgtaaaaaataaatgaatttcatgtttagatttgggtcccatcgccaagatattaggtgtatgtaaatattccaaaattcaaactgcttatggtcccaagcattttggataagggatactcaacctgtgtatccctaagtcacacagctgtgttttgatctctgtcgacacgtctccccctcca

SEQ ID NO: 123179 - DNA, 1033 bp, Homo sapiens
gttggctgttcatttgccatcagtaaattttattttgtcaggtttagacatttttcttgcacagtgattttcaaatgtttctttagttattgaaccctaaatccaaacaaaatcttccatggacatcgagcagataaaaatggaaccgttacagctgaaatagggtgggaaaggatcttactgaaataaacatatactatcaatatggcatttgcctaatccagtgtatactttatatatatgattccccacttcattggcagtttgtagcaaattcttattttctttgtttggcactctctagattttgacacattagaagaaaaaataaagttatattattttaaaaacagtccaaattagctggaagatacttattttctctgactcttgtaaaaatgtcagtagggtaaaaatgtcaataggggatgcaaaaattaagacaacatacatgtccttttcttcattttatgacaatggtgaggaggaggctagaaatcttaaatgatataattggctttggaagcatttttaagctttagtctcatttgtccataaagcatgcagctagagtcacagaatctacacatttaagatatcttatggctttccagtgaatggctatttctgaaggaatcacgtcaaagctcccatgtcatttttgctgaagtcactgtgtcaattgcaaaggcagctggcgctcccactgcctccgtccatgcccgatggctttcatggagcactccaagatcctgtggtctcatccattcctggagtcaagaacacctgaatcactaaaataaaatgaggtttgaaatgtggtgtttactatttagagtgatcttaaatatttacaagtagcataactttgtaaaaaaaacaaaaacaaaacaaaaacaaaaaaaaattgttattcagggaccttctcgaacaaatgaggaaatctttaaaaatcaaattaaacttctgaaattagtacaaataaacgcttgtgaatctttaggattttcagtggaaatacacagtgaatttt

SEQ ID NO: 123180 - DNA, 1051 bp, Homo sapiens
ctagcaagggaagatcttaaaaagacttatgttatctagtagagtttcccaaagggccaatccagggatagaaaatcattagggggaccacagatgaatcatgcattttacacttttctgccaaaatggtggtcagtttttcaaaagttctcaaatgcgttgttattgcaatgctttctaattttctcccctttacattcctcctcaaataaatctgcatagccatcctgaaatattattcataaaattaacaccacagatgagcagattgacagaagagagccacaagtagtatttgttagggcactgatgtcccagaggactgacttgaaagcttgaaatgactcttttggtcatgattatgtataaggaagatccgattagtacatcacctttactccccccagttgtctttggcctttccccagtattgcttatggtgaccaagcatttttaaatggttccctagcaaagcaaaagtcatcactattcagcaataccacttttatttgatagcttcccctctttgttttctatatcctagtcctttatttgtttttttttttctttctttcttataacttacttaagcttctacttccttctcactctcttatttctgatgtcaggaacatgccgatttgccctttctcctgctcatctgctcagcttattataagccctgccctggttcttcatatttctgtgttttcttggaaacactttattcaaatattttcctgtacatacaccacattttctttaatgtatgctttaaaaaaattttatgaatgtaactttaataacaaggtaatacccacaaattaaagaacattctaaaaaatataaaaatgtagaaacaagaaagatcactcatggttcttcagacaaaggaatcggtgttaacattatgatgtgctccttttagatttttccatgtaatatttatgaaactaaatatgataatataaatatgttttgatgttctttgatgtctaaatgtgatgtataagtattttagatgtttttaatggttgtataatattccacc

SEQ ID NO: 123181 - DNA, 1035 bp, Homo sapiens
gcaggcatcttcaaggccccaaattctctttttgtcccccactgtgaaaaactgattggcatctggtgatgggcagggcacgggtgcctggcgcttgcaggaagccccacaggaggtgcacagagccatggtggatgaagtgtggccaagccagcacaaggtgggggaccagatgtcgcccgattatgttccattgaaatccaaacaaagccccagattcaggatcatttccttgagactccccagttggaaattggcactgagccagaatctcacaacagctggtctccccatgctaggatttatgtgccttaccaaaaactttacctgcgtgttattgattggtttctgtaaagcaatgaaacaatattttgaagacccaaagcatactgctctctgctgaaaataaaaagaccatatatcactgaacacaccagcaagtcttattataggcttgagaactctgagaaggatgcgttttcctttttatttatgccacccatgttaaccttgaggctgtgtactgacatttgcagcttcgcaatgacaacactccactcttgttaggagaccaagtccaccctttggaaataaattatattataaaataagctttcaagggataccagcagatgagaaatcatgcttatgtttctcatcatctagtttgtgttgagaaatcggagagtcttcccaaaatctcattacttgttatcatccaggtcatttgcatttatgtccttctcctttcctcctgcaaaggaagatgaactacaagcctggcagtttcattgttgtggataacgaggaggaaaaacctacaaacaaaagccactccattctgccccaccctcaaagatactgaagttggttgtgctgagccacaggggaagattgtaatttaaaaacaaaaactagcatttctttgttaaataatcgtcatgaaagcatttatattcatattatacttggctaaatatgtattcctgatgtgaatccaggaactctgttttatgcattgccttgatccctggc

SEQ ID NO: 123182 - DNA, 1432 bp, Homo sapiens
cagtagagacggggtttcgccaagttgaccaggctggtctcgaactcctgacctcaggtgatccgcccgcctcagcctcccaaagtgctgggattacaggcatgagccattgtgtccagcttcatgccagtatatctttagtgcccctctatacttactaatgtccttatttaacacagataggggaggcctcaaaataatctaataagattaattcatttttattgtattttgtttttgtgattatcttctatttatgacaaatgatattccatttatgagagtttacatacagttttcctttaagtacatttatttaagaaaaatgtgagtgaattgggtgagaactttaaaaaaaaaatcaagtagcatgaacggggccacagtatggcttttgtagattttaagcactttgtgttagtgagtcccttcttacattagtgtgtacgtgtgtatacgtatatgatgttttatgacagcattggtatacagatgaatataatcttcaactctgaaagttcatttttttcttctgattctaaaagaaactaagacattttcatgggccctggcactgtggctactgtccctaaagcataggtgggtcagccctggcatgtgttatagcaaaactcattagctcttcaggagaagcactaatttaatccaactgcctcattttacaaagaataatactaagcttcacacatgtgtgagaacctgcgggtctgagagtgaggaaggacaaaatcagaactagatctcagatgccagcctcctaatctttccacttcattacactgctgtcttcctttgagcctcttctgcaaaagccctttttcttgtcccatctgcttccgagtcttcacatcagaattaatcatgggtccttccgtgaatccagccccacctcaggtgtgaggactgctctgtgtggaggtgacacccccttgtggatctcttctgcaaatagacctttgtcacgggaggctggtcagttcacagcctccatggcagtggagtcagttcactccgctccatcacgggggacccaccaagaccccattaagaaaagcacaaatgatgcaataaatcaggatagatttaggcttcgttttttggacacaatcttccaaatgatagctcctcattaaaactagctaaaatggatgatagagcttgggataggttcaccacttatatcctagaccagtactttctaggatggactttatatggaagaccaaaggtttactccttgggctgtcaaccttcattttacttagctcttcaaacaagtcaagccttgtttttagctcagctcctggggaattgttctgttgacaatgtactgcagaaaacagtccaaacaattcttaagagctaagagccacctttggtgactagactttgtaaccatctcatttatcca

SEQ ID NO: 123183 - DNA, 1052 bp, Homo sapiens
ccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaa

SEQ ID NO: 123184 - DNA, 1041 bp, Homo sapiens
ggatgtggcaatcaagcaaaatgattaaatttgtacaaaaatattgtgtgtgctgtaaatagtctctagcgtcactgacacaggccaagcatcaccaaacttggtagagcatagagctggtaacgttcattgaataaaaactccaacagcgagagtgtcttcaggcatacctaacggtgttggtgaagagtgttcggagtcagctgcgaagggtggactctccttcaggagggagtctgttaatgaagagaggtaggcactcatctagaaactcttccctgtcatcttatactgaggcataaatgaactccaccagaggccctgagatcaaagatgtctgattctatcatcgtttcttcgtatactggccacacactagttattcacaagcccataaagagatgaaaataattagcaagaaagaaaaagcataagcagtttgtattacctgaaatggtctcccagtgtttggtaggtcagcagaggcaatatttagaacagagccacaaccaccaaatcgttcattctgacagccatatacaaccagcgggatttataagacagaattaaggtcctgcatagaatgtacatttcaagtatgtatcgtgacaaaatcagagtaggtttataccagccatcctggagaggaacgctcatgctactcttcaaaccagtgaagcttaggattcgtcttataaaccatacaatccagctacacagaagaaaaggggttaaagtattgagaaattgacatttaacaactgcaaacagaatgaaaactgagtatgtgtttgcttaaagttcacagttcagggctctctctgctctttcctaaatcactttttcagaatcattagggagtcagaaccagaaaggatgcagaaatttaatccagggattttcaccttttagaaataaaagattcttccctgttcttgccccaaataaaatataacctgtgccctaatacaaaatagactaaagcttagccactctgtaaggcaggatgaggagagaattctaagttgcctataacaaccc

SEQ ID NO: 123185 - DNA, 1065 bp, Homo sapiens
tactatgtacggatggataattttaacactttaaaaataatacagaggtttttgggtatgataaaatgtacagtctctataaaagggttgttataggcaacttagaattctctcctcatcctgccttacagagtggctaagctttagtctattttgtattagggcacaggttatattttatttggggcaagaacagggaagaatcttttatttctaaaaggtgaaaatccctggattaaatttctgcatcctttctggttctgactccctaatgattctgaaaaagtgatttaggaaagagcagagagagccctgaactgtgaactttaagcaaacacatactcagttttcattctgtttgcagttgttaaatgtcaatttctcaatactttaaccccttttcttctgtgtagctggattgtatggtttataagacgaatcctaagcttcactggtttgaagagtagcatgagcgttcctctccaggatggctggtataaacctactctgattttgtcacgatacatacttgaaatgtacattctatgcaggaccttaattctgtcttataaatcccgctggttgtatatggctgtcagaatgaacgatttggtggttgtggctctgttctaaatattgcctctgctgacctaccaaacactgggagaccatttcaggtaatacaaactgcttatgctttttctttcttgctaattattttcatctctttatgggcttgtgaataactagtgtgtggccagtatacgaagaaacgatgatagaatcagacatctttgatctcagggcctctggtggagttcatttatgcctcagtataagatgacagggaagagtttctagatgagtgcctacctctcttcattaacagactccctcctgaaggagagtccacccttcgcagctgactccgaacactcttcaccaacaccgttaggtatgcctgaagacactctcgctgttggagtttttattcaatgaacgttaccagctctatgctctaccaagtttggtgatgcttggcctgtgtcagtgacgctagagact

SEQ ID NO: 123186 - DNA, 2651 bp, Homo sapiens
ttagaaaatgtgtctgaaatagaatcagaatactgtagtaggattttgtgatctgttggattgggaacaataggttattttcaaactttttttgaaattattaaccttgtgaaatagttgcattgtagggattttcatccagaaagagaagactaagagatggttttaaaacaactgaattgtggaaagactagaagtcttattttctagtaatgttattaatggaaaactcaaagcatttgacatttattttttaaggtatttagtaaatattttcattgttaatacataaagtcatagctacaaaagaaacattaaagctcatataatcccagtctttcatattgaggatgaagaaatttagacacagagggaggaagggactttctcaaaagtcacataactacttgataccagagccgtcaatatctcctgttttccaggctaggctgccagtcgagtatatagatagtcatgagctccatgttttagctaatgaattacctgtcctcattcttatttttctaagggaacaaatctgacaaaatcagaatttatgagcctggatgaattagaccttgtataagaacttagttcagtgctaaaatcaagaaaaataatggattgtgtgattttagcctgatttccaagtaccacaaaatgggcggcttaagcagcagaaatgtattatcttacaatcctgaaatttagaagtctaagatcaggattggttccttctgcagagtgtaagggaaagatctattccaaccctctcaccatggctcatagataggcatctcctctgtttttgctttgtcttccctctgcaattgtcgatgtccaagtttccttttataaggacaagtcttattgaattaggacccaccctaatgacctcattttaacttgattaccactgtaaagattctatttccaaataaggtcacattctgaggtgttggggctcccatggcaattcattttcttttttagtttagttagaatatcaaagtgtggctaactaactactctgtaatgttcacattctgatttcacgttcaggaaaatttcgcactcaggaaaactgacttcccctcagatatagaccaaatgtacacacttatatcatactgcctatgctgaaatgtgttaaatagcagttcctaaaaaaaatcatcagatttgttgagactctgattaaagcagtggaccttctccccagagaaacacaccaatcaaatttactattgttaaagaaaaaaattcttagctgtgcaaaaagtgtcatcttagtgttgattttacagtataatttgagaaataatcattttacatgtaactttcagtaagctgttgtgcaaataagatacaaacaattccttcagatctattatgtcagaattgcctgtcatagagtaactttgtgaaatgtaagtcagtttcctttgttggtattgtagcactatcatcagtttctttagaatggagtacaggaaaggtagccatgtagccacttatatgaactctcatttcttctttaagcttggttataatacattaattgcatataaacatagcaacagcaatcatactgtagttctaattgtttttagcacatacccttttactgaactactatttttaagaatatgtaatatcttatcagttcacctatagcacctgtattagtgaaaataattcaggatatgtatttgttttgcagttgctagagggctacccactttctacctgtgacagaccaaatctaattacttaggtcatgcacaattcttaggttatgtttagtagatactgggggtcacagacagtgggaggtaggtgagcattagttaattccttacagccttgctctcaggttataatgaaaccaagttctggcacacttaaaaacatctactggcaaacagagattaaaagtaacacaacctgttctgtaagcttattgaagtcccagtgttctgcccttgtttcatgctaccgcagaactgcttataaaagatttacctgaagaaaatgcaacaatattctagctgtaggatttggttggctacctggttaactcagttgactaagaatcctttgaactagcggctaaggatcccaggcaaaggtgaaggacttgcttgatttgtatattctagttcatatgaatattactaaaatgttttagctagtccagtatcttgaaaaccattaatctatgaaaatccattcctgataatcattatgctaatcaaaaatatttggtgctaaatcagtgataaaagctagttgaagagcttaagctttggaatgtggcttttgatcaagtgtggctaactaaccactctggaatgttcacattcccagctaggaaaactgactgcccctcagatatagactaaaatgtacacatatatatcatactgcctatgctgaaatctgttaaatcacaggccacatgacaccacctatattcttatcctgtggtgttagaatttaggagtttctgtaccctcttccctcttttttttccagttaagttactaatttttagatgagagagttgtattttctctccttatctcaaagagatttttctaacacatggatggataaatagacttctgcctgactaactacctttcttt

SEQ ID NO: 123187 - DNA, 1345 bp, Homo sapiens
cttactcatttctctaacattctttcaagaacaattaatttagaaacaatttataaaggtacattctccttatttaattttaaaattagaaattttttagagttaaaggcctttattattagtttacttacctcattttacttgaggctgagattaagaagggtaagaggcacatccaaaattacaattggagtatgatttttaatatttgaagtagtaatactcagaaaaataccttcattctgcaaagcgaatagtaatcataaatactatacataatgacaattctgagagtaaaatgaacattataaaagccacttcataaatgttttgtgaggccgtgatgagataatgcctatacagtgcttgatgtatgataaatacttggtaaatgataactttttaaatttacatttagcattcaatatattgccactgcctaggacattttaatgaatttttagggaatggtccatttctgcttattatttgaattttcaaaaaataataaaatgggccaggcatggtggctcacgcctgtaatcccagcactttgggaggccgaggctggtggatcacctgaggttaggaatttgagaccagcctgaccaacgtggagaaaccccatctccactaaaaatacaaaattagccgggcgtggtgttgcatgcctgtaatcccaactacttgggaggctgaggcaggagaatcacttgaacctgttaggtggaggttgcggtgagctgacatcacaccattgcactccagcctgggcaacaagagtgaaactctgtctcaaaaaaaaaaaaaaaaaaaagtaaaatgtagctgctggggtcttaaaatacatcgcagtttgacatggacccttgtgtcagtttgggtcccctgggaagcagatgctaggatgggattagatgtacaagagatctactagtagaaatgcctgtaaaggataaaggggaagggaggcagaagaaggcaagcgaagcatttaggccacagtgcaggtctgacatttgtgaagggaaaaagacaaggaaggaagaaagattaggcaagaagagtctcagactacagcacagttctaagaaagcattgggagaccatgaagagtctgcaagccaaagtttctggtagaggagacctgcagaaatgggcctgctttactgtgcccatacaagcagtgtcattggctgggagcagtgcaaacatggtgatggatccagagcagtggcagatggggttgtcaattatgtatgctcctccagcaaaagataggggtcacacgtttccatgatgcaaccctaagatgaacaaatagctgactataggcaattaaaag

SEQ ID NO: 123188 - DNA, 2044 bp, Homo sapiens
gtacacagggaggagaatttcttaaattctggagaatttaaggtgggccacagttctcctcattcagtttcctctttaaatatctcaatgttacttcttcttggctttcttttgatttgaaattactatttgtaatttggtggggggagaagggtaatatccatttgaaaaatatttgcataaataagggcttgatcccttacaaagtatcattaaataaggcctccaatcttatgactgcttttatattaattttatatgagactctggtctcatataagcctgttgagcaagtttttttttctttaaactatttgtgataataactaagataataactaatgagaaataagtagatgatttgatagtcttattttgccaacttcataacagcaaataaacagttatcactgtttttgatatttggcactcttcttgaagactgataatggcaatgaagtttcaatggcaaaaacaaaaaaatcttaaacatcctccatcataagagaagtagaacacttcgaaaagattcgtttaattctctttactttttatttctccatgaaggtattttagtgacattaaagagtctggttgtatttaacttgcagttgatttccatcaaacaaatcatttgaaaggaatatttgtgttgaaggtacttttctctgttctacatagatttggaatcttttatgtagattttggagttttttaaaaaaaaatagcatcagtatttaaaaatctacttttaaggtctaataatgttaagtgtaaacatgaagaaatgtcctgggtaactattactgtcttctcccaccaaaatcatcccaaataaaatacagttttttgttcgtttggttttggtttttttttagatagagtcttactctgtcgcccaagctggagtacagtggcacaatcatggctcactactaagcactttctatattgaaattttcggaaccactgttttcttatcttttttcttttagaatttttataagaagtacttagaaatttttctgagggagcattcaaaaagagatatgagtcacttaggatacattaaatacctcacctttgaattgtggttgattcccagtttaatccgaatacatatgacattctgccgtgagtcttgaacactagattagattaaggttgcagcagtgtcttgcatgagttactcaacacattttctgaacctgtgccatctaggaaagaggtaactgaaactatagagtctgctcattggcaaagaaagacaagaagctagtagtatctttaaaattgtaatagtaactcaatttcttgttggaatgcaaatttatgtctgaaagtaataataaagaatatggacttgtgttttctatatctgtggttttttttatttcatgttttctagtaatttatttttattgtatttaacaaaagtgctgctctgtgacagattggaaaggaaaaggaaaaaaaatggatccttccactagtggtttgaaaagcactaaactacctccacatagtacatccatacaatggtgtactacacgttggttagaagagaaaagtggctaccatctgtatacaatagtcccatccaccttatccatggtttcactttccaaggtttcagttagccatgacaaccatggtctaaaaatattaaatggaaaattccagaaataaacaattcctaagctttcagttgtgtgccattgtgaataacatgaagaaatctccctttgtccagcggatccatgctgtagatgctatctacctgttagtcacttagtagccatcttggccatcagattggatgttgaggtattgcagtgctttgtttttaaggaacctttattttacttaataatggccccaaagtgccagagtaatgatgctggcatattacggttgtgctattttattgtgagttattgttgttaattttttacactgcctagtttataaattaaactttaacataggtatatatgtataggataaaacatagtatatgtaggggttggtactatcttcagtt

SEQ ID NO: 123189 - DNA, 1219 bp, Homo sapiens
agtcattgcatcacatacatacagtgatacatacatgtattcatttatgcatccaacaaatgtttattgtgctctaacaagttaaaaagttattgctgtagtccaggcaagagataatgctcagcttggaatctgttgggcaacggggagaattcttggcacttatttgaatataggcaagggaaagaagtgccaaggattttcaaaagattttaagattattaaaagatttcttttgagaaatctttagaatatctgattgggtataggcaagagaaagaagtgccagggataatgcccatatttgctgcttctagaacctgatagataatggtgtggttcactggagtaggggggaaatactcaacattgttagtaattaagagaaatgcagatttaacctgtaagatactattttcacctatcagatgtgaaagattaaagaaaaggataatgttggatgttgaaagaaggcataatggagcagatacattcataccctttgacccagtgatttcatgtttatacaaaatcttacttagattaagaaaatttaggcaaaaactgaaatgcccaactctagggaactcatgatataaattgtcacagctagaggacagattactgtatagtcattaaaaaacaatcagacaaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtaatgatttttcagtctttccagtgtcagcctgcctttagctaagataattccaatagtaaacggacagatccattcagtttgcagtgaaacacctagtcattttgttcaggtaagaagaaagcttgggagtgttattaaaagcaaattatatttgtggtggtggtcatgtttgtctaacataaagttacattctctgctgagaggttttttcaaaaaatcacagaacttggaactacatgtagagtatggtagagtgtcccatgagag

SEQ ID NO: 123190 - DNA, 1058 bp, Homo sapiens
taagtagaagtacactctaaaataatgacaaaacatatagcacagtaatgcataaaccagtaacctagccatttattaagtactatataccttacatcattttatgtgctagatttttatatgactggcagcacaggtttgtttataccagcatcaccataaacaacatgattatcgtgttgtgctaccttatgatggctatgatgtcactaggtgataggaatttttagctccattataatcgtatggcaccaccaacatatatgcagtccattattgactgaaaagctgttatgtggtacatggctatatttcgaaacagggcctttaaagaggtaactaaggttaagtgaggtcataagggtggggccctaaagccaataggattgatgtccttataagaaggggaagacacaccagggatacaagtgcacagaggaaaggccatataaagacagtgagaaggtgccatctgcaagtcaaggagagaagtctttgaagaaaccaaatctgctgataccttgatcttggattttcagcctccaacactgtgagaaaataaatttctgttgtttaacctgagtaggggttgtgttttctattcccatttgctgcaaggtatgtttaccaaaggctgtttgagtttgtgactgtagtgggtcaaatagtgttccccagtaatttatgtccacctgcaacctcagaatgtattctcacttggaaatcatgtctttgcagatgtaataggtaagtattgagataagctgatattggatatgagtaggttctaaatccaatgacagtatccttataaatgacagaaaaggacacagagacagaaggccatgtgacgactaggcagagattggagagggagcatggccctgctgacgccttgattttggatttctagccaccggaagtgtgagagaataaatttctcattttaagccacttgtggagtggtaatttgttacaactgctctaggaaacaaatacagttaccaaacaaactgattatgccaggtgaactttttatgatgataatatgagccaag

SEQ ID NO: 123191 - DNA, 1050 bp, Homo sapiens
tattagaaaatctgggggaggaacgctgagtagatacttgggcagactctggtttcagagccactttctgctcctgatcctctctttagctttttctccactctgagactccattcagtcttgaaaattctccttccccaacccctgcacacttctatttccctcttgagagtaaaatagaagcaagaatatagaggcaagatacatacactcaattggatgaagagtgattgtgaatcactaaataaaggtaaaaatgaacctcttgtctacaattttgtttgaactactaatcactccttcccaatagaaagtgggtgagataaagagataaatttggagacatttgcatgtatgtttttaatttcaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaatttttttttgtgccaacatcatagagtgtatttacaaaatcctagatggcatagcctactacacacctaatgtgtatggtatagactgttgctcctaggctacagacatatacagcatgttactgaatactgtaggcaatagtaac

SEQ ID NO: 123192 - DNA, 2102 bp, Homo sapiens
gttctcttccatgccacctctaagaagtcttccctgactattctgtttaaaataacactcccaggcccctcctttcctacctagcatgccctgtccttctaacctggcttgttttctccatagcatttaatcaacacctgacatatttgttgattctaatttcttccactagaatgtaagccccatgaggacaaggactttgttcaatgttgtatatagctctaaaacagtgtctagcattttaagatttcaataagtatttcttgagtaattgaatgaataaatgaatgaaatccacttttttttttgtccacagcatacttcccttaccttcttctttgctcccattcatcctttaagtctcagattaaatgttatgttcctggagaggcttctttctgatgttctaatctaaagagatccttttgttataatctctcaatttccttttctttcatggtgcttatcagaactcacactttcatattatttgtgtgattgtttagtgtctgctttccccactctagtctaagctccataagaacaaggactatgtgtgttttgttttttattgtaactctaacactgagcacagtactaggcacagaattgacacatgcatatcttgtcttgttgaatgaatgaatgaatataaaaatttgaataatacatgaaaagccatgaagctcttgcatcctgtccccttagatcatctccctccccttttcagctccatgagagcagtctgatgaagaggaatgctagctcaggaaaatctttgtcttccaagaacttccttttggtcttgggggaggaaggtgtttttttataccaccatgaggctatttttccttcccttctattagtggtgacattgtggaagtatctgtaaaataattccagattgttcctgatccataaatagtgagaaacatgggatgtaacttgctactatgctctttatttttttcttttaaccaggtacacatccaagcctaaagaaaaattagtctatgccatttttcttaaatggcccacatcaggacagctgttccttggccatcccaaagctattctgggggcaacagaggtaagagggaattttaccttattcctttaaattgctgattagaacatcttgatgcaaacattaacttttaaggggagccttataactgtttcacttatacttcataaaaggaattgtaaatgagctccagccaagcattgtggctcacactgtaattccagcactttgggaggctaaggcaggaggatgtcttgaggccagaagtttgagactagcctgggcaacatagcaagacccctgtctacaaaaattttttttaaagttagctgagcatggtggcacgcacctgtagtcctagttactcaggaggctgaggcaggaggattgcttgagcccagtaggtcaagactacagtaagctatgactgcaccacttcagcctgtctctgaaaaaataaaataaaatataataaaataaaatgaatttcaccaatgacagtgtttggtcaaaatctttgaaactttttgtttcccagaaaactaagctgataaaacagctgcagtatctctatgcatatcactgtaaaatagacattattcttcacagtcattttacgttgttcaagttcactgcatgcatccaaaatgattcttctcataaaactagaattcggatgctttccctgacaccccaccccagaacatatctgaatacaagatgtcatgactctactattttatgtttataaaacattttggagaaagttagagattaatctaactgttgaaaccaccagatctggcattgagttcattctgatatattttataacttatttttttaaataaattatccctttggaggtgaactgtccatatgggggttctccttgcatcacttttctgcatttcatttctaatacatgtggttgatgaggcagaaagaagatgagttcaaatctaatgtttaattacagcttagtagcccaggtatgatactgattatgtttttattttatctatgttctttttggtgccaattaacattattatttaaaagctcatgggctttg

SEQ ID NO: 123193 - DNA, 1450 bp, Homo sapiens
cacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaaggtacagtgaaatgtctggtggctattaacataatattcttaatagtgtggtcatgtaggaattatttcttctatggctcaatggcctataaatataggacattgttctatcctgtgtttgttcttctaggcagtgactatatatacatgtataaatatataaatgcaacatattagcacattaaagatggaattattttatttatctaaaaacattattcttaattttttagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtaagtcattcttgttaccaagtactcttttataaaggaagagatttaaaatttatcagacatataaagaagagtaggataaaaagagaaattggatgaattcctacatatacaaagcactttccaaactttgcttactctaatataaagagaaggggaagaatttgcatgttttgaaacatttattgtttatcagattgagcttacatcatttctaggtatctcccagtagtggacaaattttggctgaaagtactcagctcttagaaaaattgtaagctgttcagaccaatgaaaaatgctgaatggttagtctaaaacggagattactgtttaaccagttcggtaaattctgacttttgcagatgttgcatcccatgaaattagcaaacaagaggtacccaatggcagagaaaatgttagattaaaaatgaatcaaaatagggagggttcagggaagatgcttctctctgagcttgaggaggttctgtgtgtcaatgagtacccgaatcagactccacaaatatgacagtttctgatatggtttcttaacatatataaaataagatgagtattggtgaagttctaaaaattcgctttcagttgccacctgagtactgtctgatcaaataggaaccgaaagattagactaattgttcttcaatctacttgacttatgacttaaaacattaacaacccattgaataaaatggagtaaggcaatctggacagagcaaataattgtggaattttaaaatgttgatctgggagaagccataatgagaactcaataccaatctctcatgtgacagagaatagtagaaatct

SEQ ID NO: 123194 - DNA, 1117 bp, Homo sapiens
gcttcccaactaactgcttatggttctgaaataaagacgccttttgcgggttgctggtaagaggacccgggatatgagtttttcctccttgcaaaaacccatgaggttaatgggggagagcaggggagagtttggcgggctgtttgtgcctctcatcctttaacatgttttgaaaaagcctcggccaggagcggtggctcacgcctgtaattccagagctttgggaggcccaaggccggccgatcacttgaggtcaaaagttcgagaccggcctggccaacatggtcaggaaacttcgtccctactaaaaatacaaaaaattagccgccgaggcggcgcatgcctgtagtcctagctactcaggaggctgaggcaggagaatcgcttgaacctgggaggcagaggttgcaccactgcactccagcctgaatgaaaaagtgagactccgtcttacacacacacacacacacacaaacacacaaaagcctcaagctagcccctctgcggtagcaccggcccatgtgttctcagaggctgccctgtgccccgtgcaccgggaccgacgaaatcaggaactcagctaaggccgatgctgccggccgagttgtgtgacgttgggcaaatcacttaaccttgtctctcctatctcagtattcagagtgggaatcatagtatggtaccaccacattgggaggttatgtggattaagtaatcattttaaactgcttttgaacaaagcattagcctaagaattgtaggactgttttttaaaagtccaccagatgcgtcaagtttccaccagttgtctgatgtgcaatctttgtaggatgcatgggagctgggaaattagaaatgaagctagctagcatcaaaaactacccatagcggcaaaagccctgccggggcgtgaacgtgcactgtaccagctaccactgccctggttttcaggctctgtgctccgggatcaggccttctttgggttctaactcaacctcagctaaagctgagcttcctgttcaaaaaagcacatttccatgcctctgactccacttcagctggctaactctctcaccatagccttctgtcttcttattcttgtcatattgtttttgccgcc

SEQ ID NO: 123195 - DNA, 1013 bp, Homo sapiens
actgaaagcagagaggatactcagaaagggtgtggcaggccagacacagcagtgtctctggtgatctaagctataggccttgcatcatgctcagtaaataacatgatgatgatgatgactgttcttgttttcagaggatgcatgaagagctaatttacttaaactagttaagctctagtttgtgtcagtacctcagtggcagctctgagacagatattaaagccgtggatttattctggcccctacgtactgatgaagatgctgtaggcaagggcatatcttgatttttcatttcttctttcaatcaacaaatggctagtgagctaacacaaaggttgcaaagacatccctcaggaactcacagtttagtggggaaagacaggccaataagccaaagaccacagtgcaataaagtataagctatgattagtgccctgtcctgggcctgggggagaacctaggatggtcggctatagggaatggctgtggggagaaaatgcctctggcaagaggtgaaacctgggctatctctatgcaaaaggaggaactgaaagatggagttgggttggggaggaagagtgtttggggatgggaaacagtacatgtaaaaggcctgaaacaaactggcataatcagaaaacactcagcagttgcttttggctctgagcagggttcttttgggagagaagggagagtagagagctgggcagagactgagtatgggaggttgctgtgtttgcctttttcctgggagacacaatttaggcatttgcaagtttgatatggatatattctgagtatattctgacatgaacactgaaagacagagacaatggtagaaagagcacagacaactgagattgggactgtcagggctcagaaaacaataccgcaaagcgtggtgctttgatgtgctgagtatttctaactgaaggacattggaagggcctcagaagtaaagcctctctctgaccttctcttgcccttctcttgacctcctatcttctgttccc

SEQ ID NO: 123196 - DNA, 1048 bp, Homo sapiens
gtatttttaatagagacagggtttcaccatattggtcaggctggtctcgatctcctgacctcaggtgatccacctacctctgcctctcaaagtgctgggattacaggcgtgagccaccgccccctatctttgattttgaaatgccagtctgcatcagctagaaccttccctacactggggtactgagttgaggaatgaacttccctctgtgttgtttgctctgtgaaacttttgacctgtctgtgtaatccttagatgtatcgaggtttaaagtatgctctgagatttgggagagaagagaaggggttttaaaaacagaagcaattgaagcattgagcgtcaaactttacctctagaaacgttccagcgattcccacgactctgtcatgccctggagagaattttggtatagtcgctatgcatcttttcacataattataatcacatacgcaattttaccctttctaaattcaccatgatattataaacacttattttctgttgttacatattttcctttaccttgatttttttaaaaaaatccataatatccaggccttcttccttggaaaacaaaaccactgagtagtgacactcaagagttaagggaacagaatcccagacctggttttgccaccaactagagataccaccaaaggattgtcccctgagttccctgagttttctcctccatgaaatgggtaccataattcttacttcacaggactgttacagagatgagatgaattaaggttatagggcccttgtaaactctaaattaatattcaaaaataaggtgttaatgtctatctttagaggcagtaagcaaagctgtagaaactaggtagttagttctctctgctgatcaaggctatggtactcaaaccttgaatctagagcccaacacttaaggagggagaacctgtgtgttcaggctgtgctccagctgctggctcagggtagggggtcttcctcccacatataagcaagaggaatcactaaagcagagttcaaatattcaatccagaaagcaatcagtaatggaaga

SEQ ID NO: 123197 - DNA, 1049 bp, Homo sapiens
ttgtgccttttcagttcagctcccagagctggtcctgatgaggtgactggcaactcaccccaggtgtggcaggcccctccccactctcctggggctctccctctccccgcttgctctccttccctaatccccacacctttttatgaagatcagtcctttgcacagcagccatggccagcgtgaggtgcatgtgcaagtggagaagtagcaggttcatcgactcgttctggtagggggcctctatcttattgagcacacttttgacggtggagatgccgctttattgcaaatccctccccggactcctcctcttcttccaaaattcaggctgaagacaattgccctgattccctaacctaagggatggctctgcaagtggtgatcgatgtttatcaaatgcccctgagactcgaagacgcaaattatattcctatttttcatgaaatttaaaaaactttctaatttaagatcatttaacttttagctgctgcaaaactggtacatggagttctcgtatactcttcacctggactccccaaatggtaatatcttacaaaactgtagtacaacgatggaaatcaagaagggaatgtaggtaaagagcagtacagtacagtacttctaactaatctgcagctgtcattcaaatttagccaattatcccactaacaattatcattgttagtaacaattatcattgcggtgtttgtcagatggtgactttctagttatcatccttctgcatttatcaattggaattctactacaatgaagagctacctcttctgagctatttattcattcagttatttatttgtattagtgtggtctcatggatatttcctttatcctataatccattactatctactttatttctttttttagagaccctccagctctgtcacccaggctggtgcagtggtgcaatcatagctcactgtggcctcaaagtcttgactgagctcaaacaatcctcccacctcagcctcctgagcagctgggactacaggtgtgcactgccacacctggttaattttttttaaaat

SEQ ID NO: 123198 - DNA, 1105 bp, Homo sapiens
cgtttacaatgacaatatgatccctttctcacttttatgattggtaaaaaattggtttatcctctctcaaagtttatcctaaagttgctgagtgacacaatgatatttttgtacttaatcacaaaagcagagagtctgacaagaatttgaaaaagggtgtatagaatacaaatactgttgaatggtgcagcaacagagctgtacaacacctttgtcttgcctggaaggcagtgtgttagtatggagagagcgagggctaaagtagagactgtagatattatgtgcctaatactgtaattttcccagaactgatagcttgattttgccagttatacacccaaagactttggacattggtgtggaaatacatttgctcactacatgctagatgccagactatcatttgttgattggttgattcattgtttggaaaatacctggactactataataggtgccaggcatcatacccagagagggacctagcataaccagaattcattcaaaggaggacttccagaattctgagaggtctagagtgctgggacggtgtcttatttatctctacactttttcttcctagcactgtgtctagcactcaggatattcataataaaagtttgataaaacaatggatttacaaatggtggttgaggctcttttacccactggcaggctatcttcctgaagttgcctatatccctgtctgcctgttagctgttaatacctcctaagccaggatgttccactactgtgctgtgccaaacagctgtgacccatcaccacctcctgtgagatacattctttttaccctgcatcatgctaaagatgttaactcttgactagaaccacttcttggggctgtggttgtacttttggaggcccgtcatggactgggaccagaaaactggagacttgaatatgaacagagatcaatggactagagacttcattttgcgtctccgagtgttggatgaggcatcctgagtccctccactgtacagacaggattgggcttagctactcagggggactgaactttcaagggaagatcaactagcctcagttctggaggaaaaaagataaagagtggaacaaacagcgc

SEQ ID NO: 123199 - DNA, 1006 bp, Homo sapiens
aaactgggtattgctgctactggaggggaagtgaagtaaggaatgcccctgatttgattatggtccagggagcaagcccaggcttctgcctcagtgctggccttggcctatacctagccagccgcacatgggcttcctctagagtttgccgtccatggatctggaaccaacagcctgagctacagagactgggctggagctgctaccaagtgcttggccctgttttgctctcattaaccaggtcagaattgctggctgccgttgctgtcaggtggggtgagtcaggtctgtggggatgtttgacatcataggcgccctcttattctaatcagcttgttttagcagagctcctttgtataaacacatcagctgaaggaagctctgaaatgaagactgttacataatgattttatgaataacatacagcttcctaaaatcagtctttttctgttagatcttcaaaccaggttttagaagcaagacaattttagattctcatagtaagaacaaatttagacaccttcataaggtgtgacgcatttgatgcaaaatatagatggacgaggaatgatgttgcttattaaaaagttcaattagaggatgggcactaaaatatatatgaactaagttaagtatgtcaaatgacacactaaaggctaattaggtaaagggagaagtgtacatgacaggtttctgattttctagctttttaacagtaaaggtaactttatttccagcattcgaccaaaatgcagggatttgggccacatttacttggctccgggggagtttttcaatcctgttgaagcacagcaggcaaggcctgggtcatgagaattctatggtgctgactgcatttggagcttaattatttaaatgtttccagactcaaatgactgatgagctaacatatttttaattcagactttcacagagcaagctataaggtgtgtcttgagaaactgatgctcacttgaagttccatgccatgtattttatttcaata

SEQ ID NO: 123200 - DNA, 1029 bp, Homo sapiens
gtcgaagaatgccccccgcgcccccaaaaaagaaccatatcttaaccccttaaacctgtgaatatgttactttacatggcaaaagggactttgcagatgtgaagacgttaaggatgttgacttaatgatcctgggcgaaatgatcctacattatttggctgggctcagtgtaatcacaggattccttataagagggacaagaaggttaaaagaggagaaggcaatgtgacaatgaagacaaattttggagcaatgaggctgtaaccaaagaatgcaactgagcctaggaggtggaagagaccaagccagagcctccagaggaatgcagcccttcagaacaccttgatttgagccctacaagataagactaattttggatttctgacccagaaccatcagagtaaattttggctgttttaagccactaaattggtggtaatttgttacagtagcaacaggaaactaatactgatgaaaagataataggaaaggaaagtaaaagcagaagtgtgggccagggagggatcgcagtcatctgatggcaaagcacttctctaagaacaaccacatggcttccccttcctggcctatgtccctgtggatatgttagaacctggttaaccttgactgttatccagtgcctttcctggctttgtccttcgtatcagatgcagatgttttatctcctttttttatggctcccaggaactttctatgacccccttagaggaatcactagacctcatgtctcaaagactagctaagtgtttgctgtggtcctaacaagtccacctagagccatttaaatggctggcattgatgctttctgttatctgttccaggtttagtggcgtgaatagtaaacatagtagattagtcctttgtaattaaatttagatagcatctcacccctgactcttttagaacaatgatggcagtgggaggagtcagagaggtcagtccccagttaaatcagtcaggcatttattgatgaccctctgggtactcagcgctttgctctaggtgtcc

SEQ ID NO: 123201 - DNA, 1008 bp, Homo sapiens
gttgccacctcagccagacaggcccggcatcccaaacatcatacaaccaaccccaggcaaacactctcttaaaaaacccagatagtgaggggttgtgtccttctttcgaaggtgggatcacactgagggtacttggatgcaggtgctccaaattaccccagcctcaaacaagtttgtcgaactctaggcaagctgagtatatactcatgggaaggttaataaaaatgggaacgaaccccatgtttagaaacataatggagaacattaggcttatcgatgcctctaccatgcccacagcatctctggggccataggaaagggcctggtgaacattttataaccaggcattccccagctacagcatattaattgtgggtgtgaattaaatcaagggagggagtggattctccctggagcttgaggaaaatggtccacttactgtgctttttcacggttgcattgcccttcctctgatgctggggagggacagaggaggggcagtggtggagccagttaccaatacagagaattgggaagcagttaggtcctcggcaatgaatgcagtttttgaacagggcttaatttataatggacactcaacattaattttctgatttctagacatttttccatgttgcccatttcttgtttatctcttagtggagatgtttaagtatttataggcaagggagggagatgttaagttcctaaatacctaggggaatcctgtgacaaaatagtattaagaattattttctgccattttatttttattttattgtaaattgacaaattataactgtatatatttatggggtatgatgtgatataatgacatatgtgtacaatgtgggatgattaaatccagctaattaacacatccatcaccacaaatacttgtcatctaccattttaaattgcaaaaatggactgaaggaccacagtccttcaactgaaacccttggagtcagttgtgtttcagaattcagaattttattttagaaaggt

SEQ ID NO: 123202 - DNA, 1018 bp, Homo sapiens
atttttagacatgatttagtatatgtattttaaactaaattaataaattaaatattgttataagaaaaaagccaaattaccttccctagaaaaagaaattattttcaaactcctaaaatgtattagtatatttaaattgtcccttgctcttaatatatggagagagaaaaaaatgtcatcataatacccaaatgaaggcccaggtgagcagatcacttgaagtcaggagttcaagaccagcctggccaacatggtgaaaccctgtctctactaaatatacaaaaattagccgggcatggtggtgcatgcctgtagtcccagctacgtgggaggctgaggcaggagaatcacttgagctcggaaggagaaggttgcagtgagccaagatcatgccactgcactccagcatgggcaacagagtgagactctgactcgaaataataataatagtaataataataataataccaaatgagagagaaataattctgaactcttgttgaaaatcagttcatgggagtacagcatacaaagttggttttatttttataaaaacattttgtgtgtgcatagagcaatgctcaatccctgaagaataacagaaagaataaaaggggaatttttatattttactctagacttttctatttttggttttgtttgtacagtcattgtgtcctgctttaaaagccaataaattatgttttaatcagttaactggatagcagcacatattatattgtcttaccatgtatgatgcacaatattctgggtacactcagagcacccccataataagttgctaatgacatgggtccctaccccagagtaacttggggtgagtgatatgaagaccctgcctccccacccactccccaccctgccccagtgtaagctattattgaacttgtttctttgttaattagaactagctctgaaatcttgttaattttttttgttgttttttttgtttgtttgtttgtttttagacagtattgctcttttgcccaggctggag

SEQ ID NO: 123203 - DNA, 1047 bp, Homo sapiens
tctctagtagctgggactacaggctcgtaccgccacgcccagctaattttttgtatttttagtagagatggagtttcactatgttagccaggttggtctcgatctcctgaccttgtgatccgcccacctcggcctcccaaagtacaaccaccacttctatctggttccaaagccttttcatctacctcaagaaaaccctatacccattgtgcagtcatgactattgtccccctcccccagactcttgcaaacaccagtctgctttctatctctattgatttacctatttgggatatttcttataaatggaatcataaaatatgttaccttttgtgtctggcttttcaaattgaacctaatgttttcaaggttcatccaggttgtagcaggttatcaatacttcattcctttgtatggctgaataatattccattctatggatgtaccacgttttgtttctctattcatttgctaaagtacattgggttttccccaccatttagctatcatgaatagtgctgctatgaatgtttgtgtacatgcatttgtctgcattagtttcctattgttgctgtaacaaattgccacaaactttgtgactgaaggcagcatatatttattacctgacagttctggaagtcagaagtctagcagtctagtgtcagcagggctgcattccttctggaggcactgggggagaatctgtttccttgcctttaccgacttgttagaggctgctggcattccctagcctgtggtcccttctcctaggttctaagccatcagagtagcatcttctcatctcagacctctgctcctgtctttgcaccttctccctctgactctggcccttcgcctccctcttataaggacccttgtgattacattaggcccatccagataatccagggtaatagcctcatctcagaatccttaatttaatcatgtctgcaaagttccttttgccatataaggtaccatttataggctctagggattaggaggtagatatctcagggcagggaggggctgaaggtgggggaagag

SEQ ID NO: 123204 - DNA, 1022 bp, Homo sapiens
taatgagaaggaagaactataagaaagatttttgtaaaatacatttctgaaaaggaggctgagcccttttcccttttagaactgtaggcggcaaattctgaaaattccaaaaggaagcaatcatttatttaagacttctgttcatgcattctgtcttggataatgtttggctttttattttcgcctctgtttgtacttcaggcatcctttcctttcaattgtgtgcctatttgcagcccattgcccactgtgaagtaaattccattcagtcttaattggggtctcttaaaagctttttctaaagaatttttcagcctccctatggaaggccactgttcgttgcctaaggtgtttcagggtgtgctgagcattccctctgaccttccttcttgtataaagatgtttctgacaacagctgggtggctcacaggactggggagggcagtctaaagggatgattcaggattgcactgatcaatttcatctattataaagggattttgtgtttttcaaaatttcttctgcatctgtaaagttagcttgtgttgacctgccaacctgtttatgaaagagccgggtgagaatggaaacttggaataaaccagaacaagttaactgagctcatgccgtgggttcctgttggcctgactgcgctgtttcattttcctaaaggcctctaaaccagaattgtatacatctaatgttctgtcgcttggaaagtacttgactgccaattttttaaagaaaacatgaaaagaataaaatcaaacatgagatttttagaagaatttagaactgtacacttttaaaaaactgaatccccttcagtcatccaaccacagaatgtcagaacacacgtatacctcattttccaaacaagaatgttttaatttaggaagccattataaagtaatcatagcaaaatccttcaaagaacttttctttttccttctttcaagtgggctgaggtggaggtgaggttgaaagctgtgtgacattttcactttaccttcgacatgtta

SEQ ID NO: 123205 - DNA, 1049 bp, Homo sapiens
ggaaaaaaggaaggaagggagggaaaggaaaggaaggaagaaaaaaggaaataaataaagaaagaaatggaatatgtgacattatgtttctgccattgtgtaagaaatcaataccagtatcttgtgattggagcaccaaattgatcgagtaatgttcaggaaagaaacccccaaactacttatcaagatcctaatcccagtgtggtcagtaactaatgtggccacctgactggttttataatcttctttgagggccctgaatgtgaagccctgtatttggagaaatgttttgttctcaaatgtcactacatatatagtcttccttttctgtgtttggttttgctggctctgtatgctttcattgtcttagatgtgtttgaaatccgcagggtgacatgtctcttttcaaagagctgctaaaataagaaagaaaatgaataagcgtgttaaagaaagatggtgtttaaacacctgtcaaagtaaagtcagaacaagaatgttcttgccagaaaacgcagagccccattgagacaggttggtaattcgaagatgattcattacgactaactgcatttgtattctagcccatatgcattgtaaaccacctagcaggcttccaatgatgtcttcctatcaattcgtaaatctcacaggaaacttttaactggtgcagtcagttttggtggactgcttatcttgtcaacgtgaagataatgcttcaacagcacacccacctcctctaggttcaaaattccttattttattgaaaaaggtccctcaagctggttaagcacacaaataagaattgggtgcatcagaatctagtgaccctaggtccttttgtaaaatgattaaaactctccttaaacctcagaaattatttaattttataggcatctcttggaccaggaattgccttgagatggcgagatacaagcattctacaaaggctgcaaacaagactcacttctcttaggccctgatccgaatccagattatgatggattgggcatggggatcagggcatgcagaagctcttagccaaacct

SEQ ID NO: 123206 - DNA, 1086 bp, Homo sapiens
tatttcatatgtatattagtctgttctcgcactgctgtaaagaaataccagagactgggtaatttatgtagaaaagaggtttaattggctcatagttctgcaggccagcttctgcttagcttctgggaagatctcaggaaacttataatcatggcacgtgagtgaaggggaagcaagcttgtcttatatggctggatcaggaggaagagagagagggaggtgctacacacttttaaacaactggaattcatatgatttcactcactatacagtatcaagaggggacggtgctaagcaattcatgaaaactctgccaccatgatccatacctcccaccaggctccacctccaacactgaggattataatttgacatgagatttgggtgaggatacatttctaaaccttatcaatatgataattatctagcctcatttatttttggcttatatggtcacatttgcactgggactgcctaactgatacatttctgtttaaataaaaaataaaacctgtgtatattttctgatttcttagcaattggtgttgtggggaaattctgttaggggtgggcttgtttcagtgggaagatagactgagctgtgtcatttaaagtctctacatttgattagctaatgactgtatttcaaaatatgctgtgttttaaaatgtagaactcaagtgtgaaaaggtaagttctgatgaatgacaagttactcttagtaacataaaaatggatcaaaattaatgctgaaaacaatcaggaaattttacctttcatctgggatttacctggcagtttgttcttatctgcatgtaaatgcaaaattcaccagacttactgtgaaataatttatggaaagtttcaaatggattttaatggaaaactgatccacaagaaaaattatagaaatatcaatagcaatgcccagtgtcctgggtatctaaagaggagagttaatattctgcccatactactcaaaagcagatgacagtggtcctcacattcatgatttaagagaagtacaatggcacatcggccaactgtgccaacatatggtttctaattgcaaatatggtctatgat

SEQ ID NO: 123207 - DNA, 1078 bp, Homo sapiens
gttcccaaacacctcccttcaaaagaaaggggaaactatccaccattggtaaaatctttaagccttggaaatggaggaaaaagaagaccagcgacaaatttagagaaacctcggcaggtatgagtatcataacttgttagaagatgggataaattgtaaaacgttttaaaaggtagaaaattatgttttacagtgtgttttttcccagaaaaaaattaatccgtatttgaaatgaaattctttattttaagaataaaataaggatgaaacaacttaagagttctgatttgccttctttctatactgaccttgactttctaatatattcttatttaaaaatatatatttgtaaatttatataaaaaatggattggtgaggcgagggagtgaaatagtagaaaatgataagtggaaatgctattcatcaacattgtgatgacaggtatccatttttatatacacatgatgttatatatttagttagactatactatttatattaatatataaatatttaacgatttaactagtagactatactgctatacacataacgtaatgttaacggtcttgttcgttaattaaaacttttttaaaaatgtattttttgatgtatttattctttaggaaagattttagtggctatatgaaagaaaagttttgttatatttgattttagatttctatcatatccttaggacaaataaatggtctctgtcttaagagagtagaggcacaaccctattggtgtgaaaatgtttgattgttaatttagtttgtagatttgtgaaaccttaaaagttacattgcttagtgcctttcatatcaactcgtggacaaagctggctttaaatctcaggccagaattcagcccaatttaaacaagtgttagtgtgagtgtattgtgtctaagatagaaaagtgtttagtaagttcaacgttccccatgcttactgtccaaggcaatcccttcatcaaaattcctcactgcaccacagtctaatattgttagtggatgtacagggtcacagagcatatcttattggtctgtactaagataagaaccagagttttgttc

SEQ ID NO: 123208 - DNA, 1050 bp, Homo sapiens
ccacgcccggctaattctgtatttttagtagagattgggtttctccatgttggtcaggctggtctcgaactctggacctcaggtgatctgcccgcctcggcctcccaaagtgctgggattacaggcatgagctacggcgcccagccagccccactgtgttgtggtgtagtattctttttatatgttgctggattttattgaataatattttgttgaggattcatggtattgatctgtagtgttcttgcactatctttgtctaggtttgatatcagggcaacaccaactttatacaatcagttggcaactgttccctcctcttctgttcctggaagagactgtgtagatttgttgttattttcttcttgaaatgtttggtagaataaacagtaaagcattatggacctgaagatttctcttttgaaagatttaaatagcatattcaatttcttttatagttataggaccattcaggtgatctcttttaacttgggtaagtttaagcaggccctctggtgctttgaaatggaaaagaaagtgaaacttttcctctagatttctttatggttaaccaactgccttatctccttccataaagtctatgtgcaaatgctactttctcagtgagatctatctggattgttctatttcaaatctctcctctcccccagaattctttaaattaaatggccttgttgacatataattgatataccaaacagttcacccatttaacgtgtgcaactcaataggttttagtaatattcatgagctgtgaaaccatcaccacaatcaattttaaacatttccatcactctagaaagaaatcccatactcattagcagtcattccccatttcaccagtctcccagctctactttctatctctgcgggtttgcctattcttgatatctcatacagatggaatcatacaatacatatgtggtcttttatgactgatatctttcacttagcaagctttcattggtcatctatgttgtagcgtgtatcagtacatcatttcattatcaaataccaaacattccattg

SEQ ID NO: 123209 - DNA, 1034 bp, Homo sapiens
tttgagccctcatgtgaggagaataaatgtgctcaattctacttggaatgtttttcataattatcttaaggaatgacttgattcttacttgtgcttgttctttttaaaagtattagaaaggaagatatccacacgacaaagtagagaggagctgataagaaggggagtgcttaaggaattgcctgatcaaggtgaggaaattaatcatacattttaaatattttggtccttcattctttggtttttcttttgttttcttttgaaatttaaagggatcatggtctttgtaaggtaaagcggtgattactgcattccaagcgccgtgcttccattggtaatgcctttgtgagctgcagagaatctgaaatattatagaattctagtgactttcctggtgaatccatcaccatatgtcattctaaacctaaaactctgcaaaggtacatccgagggcaatacagatgagatacaaatgcttacggctccttctcttctctattcttgagcttcagtctttctattcacatgaaactcatgtgtttgagtaaatgcaaagttttagcttggttcatgctattttgtttcttaagactaccaataaaagagaagagagaaggcacacatacctcttgtcctttgcactctataataacactgaaatgtacaatcaataaagcatgaataggcaaactaaactaacctgctttctgctttctctcatgtaattttgcagtactgttctcttttcatttctctgaatctttccctagcaatgattatttctaattttttcccctatctctgatcttctctttttttctctatcctcccgaggaggaactttgttcagaaaagacaaggatcagatagaaactggtactgaccctcaaaagaagacgctaacattggttatttctccaaataaataatacctaatgattttcatcgcttccactattaaatttaaaattaaaggacattttgttgcaattttgttgattaagctcatgcctcccttcccctcacatttactg

SEQ ID NO: 123210 - DNA, 1049 bp, Homo sapiens
actttccagcttttccatggtccctatctagaaccgtagaaattatctaatggttgaaggttcctgaggatgtcagtagtaaatggagtccttccccttttcagctgagggctggagaaaatagttttctgtgattttcccaaaagcaattatctggagaatttcagtctgagagactagaagctgctgttcttggtaacaacctcctttctgctgccagtgaagattcattgtttgccttgatcttcttgaccttgcgtctgctcttgacagtgcctgtccatcaagccctttattcagtgagccagatagactttaaaaatccctctagctaccctgagtctgaccccatcccaccatatcccatactctcccggctattgttatttttccttttaggttctcttatttacatccagacataccttcaacctaaaagttcagtgattcgtcttctctcctgggaagtctatgatctagtccaagtttgctgcttacctctgcttttttccctccatcttttcccttagcttttgacatgaggttgtggaggtggttttgcctgtgtgccatcctttccttttctcccactgtggacttttgtcacttgccttttggtcatacatgattttctctttctatctgtccctcctttaactatgatatatccccaatacacctgtttactagaaggaggtgacccccttcaaacaccctcgtgttccttatttaaccacttgttcctgtttgtgctttatctctgttttctttaagctgacaactacgttttgagttttctctttcctttgctctcgtgagatgtgttgacttgggccgcttattgtcacctgccatccagctcagcatcttcttgccttcctttgctctgcttgtattttacttacacacacacacacacacacacacacacacacactatatcaaggatttaacttattttaattctaaaacaacttccttaacactcaatactagaaagccttttcaatatacacaccagctaattaataactttacttcccctctgt

SEQ ID NO: 123211 - DNA, 1050 bp, Homo sapiens
gattacctattgtaactgaagtcatctatgctaattatatatgtggattgatggggaatgtggttaaaagagaattctatacttcacactcattaggataagaaacaaaataatataaataataataaaatgcagtatattccaatattaaaaccctttctagagcattcaattatgggagccttggttaaggctcgatcttgtcttaacactgtctcaaggtttttattgtgccccatttttaaagaaatgctgcttagctttttggactagaatggtattttagtttaattctcatcagccactattagaaagaatacagatgtgaatatatgaatgaactttcagcatctcatctgtctttcagtaacaagagactaatactctttctcctccggttacacaaaaccttgtgagaagctgctattcttaggtatgagttttggatgaattttagcctttgtctttccaaaataattatttggtttacattacaaaatagacctaagtatttcttcgattcggcaccatctagatgtacctatagttgtgacagtatttgaaaaggccaggcatggtggctcatgcctgtaatcccggcactttgggaggccaaggcaggcaaattgcttgagcccaggagttcaagaccagcctgggcaatgtggcaaaaccccatctctacaaaacattcaaaaattagctgggcgtggtggcaaacacctgtggtctcagctacacaggaggctgaggttagaggctgcagtgagccgtgatcataccactgcactctagcctgagtgagagagcgagaccctatctgaaaaaaaaaaaaaattttttttttaagattttctttcatgcacacacatacaaaaaaaaaaaaagaaaagaaaaggaaggaaggaaagggcagaggaagttattttagaacaggaagctgccaatgtactgggaaagctttagaaaattttgctagtagaagatgattcattctaaagcgcattgttgcctcatgtaaaagattctccagagtctctcttagcttac

SEQ ID NO: 123212 - DNA, 1053 bp, Homo sapiens
atgaagtgcctcccattaaaaaaaataccaaggctcctggtaagcaggcccccgtccctccacccaagccagcaagccgaaacacgacccgagaggctggtgagtatgcccccagtgccctgtggggtcacttctagggtgcttggctctgggatggggctaattgtttcttctaggtgtgatgggcttttggtgtcttaggacattacaccagcaggttcagctttgacacaaagaatgcccaggagattcctttgttgctctctaccaaaggaaattcaacccattgaatagttcacctcattagtttttgagtgaatatactggtttcatcttgagtatccactatcagcaccagttgaaggatactgggagtagtatgcctgatgaatgacaatgatctgatataacattatttagacattgactgaccttctacctatatgagcctatgggtggctttttggcttggattttctttcaaaatatctaaggtttgcatataaaaatgtgacaattataactttgatatatttactggatgttaatgtgttaaatcctcagcatccatagtcatctcccttctgataaatgacaaagggttcatgtcacttgtttcagctccaccccaccactttctactgcagtgaaaactatttcagtggagtggaaagttacactctcagtgttccacacctcccctgtagacttgtgtgttctaaggcaaaacatcctggtgtcatgtggttataagttactattataaatcaccagtggatgtttgagtgacctgcaataactcatgcaatatgtatccagctttgctttacaatcagatatgcttgatgcaaagtggaaactcccatttttttagtgaagaggaagaaagatgcctaccatgtcatttatcttttaaaaggacattaatcaggccaggcccagtggctcacacccgtaatcccagcactttgggaggctgatgcggatcgatcacttgaggtcaggagttcgagaccaacctggtcaacatggtgaaaccctgtctctgctaaa

SEQ ID NO: 123213 - DNA, 1095 bp, Homo sapiens
gccaagactagaatccctgccttctgactcccagtggaccgcttttcacttcctctgctgaaaccttacatttggagaagaaatttaaaatgaacatcaagacaggattctctgccactattcaaattaaaatacctcctttcggccgggcacggtggctcatgcctgtaatcccagcattttgggaggccgaggcgggcggatcacaaagtcaggagtttgagaccagcctggccaacatggtgaaacctcgtctctactaaaaatacaaaaaattagccaggcacggtggtgcatgcatgtaatcccagctgctcgggaggctgaggcaggagaatcacttgaacctgggaggcggaggttgcagtgagccaagatcgtaccactgcactccagcctgggtgacaagagtgaaactccgtctcaaaaaaaaaaaaaaaaaaaaacctcctttcaaggaagaacgttttatagatgttaattggcgagtggtatagagcagcctcactctttctccttctggttctaggcatcactttttgcagtaagcaaaagtatcctcactgttgatcggactagtgagacaaactggacagccatgtcacagaggactcaggctcacacatatttctctgcttgcttcttcatttccaaaagtcagtagcaagcattattgtcacagttcctagtcacaggttctccatagaaactacaggggctgaggaatatatctggggagaagagacaatctgtgacatggacttaaatatagcattgaaaggagtgttgagggaaaggctcgtgtattgcagaatgatggttagttatgagagagagctagagacaggcctcagggctttttttctgtctgttccctttcctaaaatgtattattttccaaccacaaagaagactttttatctcccagtgaagtcactccctgtgacttatcattcttagttttggctgaagagtccattttgcctagaggttacaggggtgtttttattagcacctttttaaaaacatgagtaaaacattctttatagagaagttaggaaataaaaataagcaaaaatttgaaaccacgaacca

SEQ ID NO: 123214 - DNA, 1025 bp, Homo sapiens
catcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgc

SEQ ID NO: 123215 - DNA, 1025 bp, Homo sapiens
taaccctccaaatagatgataaaataaattgtatgtttgtttcttgactcaaaatgttgcacagaaatgtctagtggaaggagcaattgttatttatttttattgcccttttaaaagcatgaatgttttcattccattttaatgttacgtagcactctggttttgaagctgtacatttcctgtttgtcaagaattctttgtctttttcccatcagccaaaatgttcatgtgccatctgcctcctacttggaaagctgtactcattgtaatattcccatgccttatccttggaaggcttactgattccattttgtttatagatagtgaagaaagtactaattccatttcgtttatagatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccagtaaggcttttcagcaatttaattgtgggagtgaggtgaagaaatcatttttgaatcaagatatctgtttggggcaagaaatggtgtccgtatgaagagcacaaagatagaccacgcctccacttaaaattatatatgtgtatgcatgtgtataccatcaggagagaataggtcacgtcttctctggtggcaggtgtcaacagtaacagcctttttataggttcagaacttttgattgatagacatggccatgttagacagcacttttcaataggagaaaagcagctgacattctacatgttaacaacataactgttttcaggatcataaactcttgttctaagataggacttaacttttgtggaatattcagatctttaacacttttgtaaaagctgcaggctactcataagcaaacagaatgagtggatgataataacattcctgtcttgtaaacaaatgttcggtccactttaataccttctctttcaggac

SEQ ID NO: 123216 - DNA, 1078 bp, Homo sapiens
gcaagcacatgtttgagtagattgcagcgtgtgaagaaggcgggaagttcacacaaagggaagttctaggacagtgatcagaaagggcttcatgtcggagggtaggaaccgagctggccaccaagtggtgggtactgttgacaggagaaggaacattttcagtcaggctgccgagacagtgagcactgtggttccgtgtcaggcacatgcgcgccaagtaaagtgttttgcattattacatgactgaggaatgaacttgatttgcatggtcatatagaataactgagaaatttggatacacagagtaggccttgattttataggtccttgagaaccagggccttaaatacagagtgaaaaattgagacctgtcagaaactcaagaaggtcacatgaaaaactattaaaggagcttaatctcgccatgggtatgaaggttgtagtagatatagactagctatatgagcggttgcagtcatttatgttttggttaactataaatgaggtgatgccccaaagaatagagtgaaatcactgtatgtaagagatttcaaggggacataggacagagcaaaatgatttataaccacccgaggatttaagattgccaattcatacaagggctgtgccattactagagattaggacattatctctagtttaagaggaaaatgtttaattttggtttgaaatttcaggcaagtggagttaagaaactctgggatttgaatcccagaatctcacttactgatcattctcaggcaggtgggccatttaaactttcctagtttttgttcttttggtaaaacatggtgatacctcatgggatctgagggataaatggaataatttgctagagaaggcattgtgatgtattatagagagttacttttgggtttatgatggaatatacatgtttaacatatatacaacctggagcacaggtgagagaacacagaatgtagttgtaatagtttcctaggactgcagtaacaaattaccacaaactaggtgacttaaaacaacagaaatttcttccttcatggttctggaggtcagaagtttgagatgaaggtat

SEQ ID NO: 123217 - DNA, 1321 bp, Homo sapiens
tggcatgtgcctgtggtcccagctgcttgagaggctgaggtgggaagattgcttgagcctgagagtttgaggctgcagtgaactatgatcacgccactgtactccaggctgggagacagtgagatacttaaaaaaaagaaaaagtatcttcaaaaatgttctgacgtaatctgtgctgcctagcattttgttctccaagctgagtggaataatgcctttcatttacatgttaaatggaagcctatttttaggctaaatgtaagtcttaaagtactgagcagaaatatcttccacatcctattgttgcattaaatccctactgatattttaatggtaattgtgatagtacctgaataactattgtgtaagaataaagttaatgtaaaaaaatttttaagtgtgtagtcttactgagtacatttgcttttcatggtatcttttctctgtttatattcaagttttatgagcaatatgatgatgatgaaattggagctctggataatgcagaattggaaggttctattcaagtggacagcaatcgcttacaggaagttttgaatgactactataaagagaaggcagagaagtatagtgacttttccttccttgtttagctgttcttttttttaaaaaagaaaaaattccaaagaaaggtctatagtataactgaattgaggaaaaaattaacctagtcaaaatacatattgagaaaatgaaaaaggaaaaaagaaaaggggaaaaaaaaagatagggcggaaaaaagaaagtggtacattttccataaacttgggtcatgtatagctcattgttttgcctacattttggtgttaaatgttctgaagtagaacgtaatgggaatatacgaggagccactttctccgtatctttgactggagaagagtcatggtagaatgtgtattcgtttattaaatttttttttttttttgagacggagtcttgctctgttgcccaggctggaatgcagtggtgcgatctcagctcacctgcaacctccgcctcccaggttcaggtgattctcctgcctcagcctcctgagcagatgtgattacaggtgcacaccaccatgcccagctaatttttgtatttttagtagagatggggttccaccatgttggccaggctggtctcaaactcttgacctcatgtaatatgcctgcctcggtctcccaaagtgctgggattataggtctgagccactgtgcctggccaatttttaatttttttttaacttttatttattttgcttaaaagttttgttttgatagaagcatgaatattattagggtgtgaaatataagga

SEQ ID NO: 123218 - DNA, 1040 bp, Homo sapiens
gcaattaagagaaaaagactaggccatgagtcttgatgaagcatattgtgatttaggcaggttatactccaaacttaaatattttaattttattctgaagaacaaattcatgatactttaaatgaattttctgatatcttggttctctaaaaatctataaatgatgattgggaactgaacataaaagctccatgctaaatgttgggagcccaagagatcagagggtttttgccttcaggagccacatggtctgaggaggcaggataggtgcagcgaaatgtaactggcaatactatcgtggtaagtaccacttgtaattagaatcttggtacttgctgttcccccagaagtgctttcactgcagacagaccttcctcatggttggtgctcagctgtaaccttcactataggctattccctgagcttgtatttaaaaatcctgcacgcatccctcccctgcatccttgaccctccttccctggtttatgttctccacaacatctgttgacgcagaggactgtttttcagtctcctctcgcaggacaaaccctgaaggcacagtgttttatttattgctttatccttaggtctggaagggtgcctggcattcagtatacagtcacaaagtagtgtatgaatgaatggatagatgggaaagatttcagaaaagaattaaacatagaaccatagcagggcctagaatcactggggttagggaggagagaaaggcctaagagatccaggcagggggcaaaatcttgaagaatttgtatcttaaactttttttttttgccaagacaggtcttgctctggcgcccgagctggagcgcagtagtgcgatctcatctcactgcaacctccaactcccgggttcaggcgattcccctgcctcagcctcccgagtagctgggattacaggtgtgcaccaccatgcccagctaatttttgtattcttagtagagacagggtttcgccatgttggccaggctggtctcaaaactcttgaccttatgatccgcccgcctcggcctcccaaagtg

SEQ ID NO: 123219 - DNA, 1347 bp, Homo sapiens
aaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaatttggcttgattaatttttcatacagctccacctgtgtcaacaacatgaactacatacactcagatcaagacagaaaacacttccggctccacctggctccctcatgccccctcctggtcattacttcccccacagaaaccactgttttgacctctactgagcatctattagaaacttcactttttttgagtaaaataattatgacttaagatggaagcttgtatgcgtccattaaattcacagcactaagagcttattatttctaaaaatgcaatatttaaatcattctataatgtgacataatttatttctaatgtatagatcagaatactatccaccagagtttagtctaacctgggctaccatgatccacttttacaacggtgtttaccattaatttctagccaaattagaaataaatgtacttatttcttattgggattttctcaaggtattatgcccctta

SEQ ID NO: 123220 - DNA, 2004 bp, Homo sapiens
ttccaacttccagcaaccccttcataccatgccccccagtgtcacctttaaaatgacatcattgcctggaggtgaatctgaatatcccactcaggcttcatttcaaagaaataatctcattgttcaccatgatccatcttgctgaaataagatttagttgtctgtaatctaccaaatcaggtgggctcctttccatctggaaaataaaataaaacatattcgagaggcttttcaaaaacaaaccttgtacatcttcagcctagaggattctttcactgaaaaccagggcagacttcccagtgtttgagggttgcccaattctttcccactcaaatcattagaaataaaaaagtcagtttggagaatttgcttaagtaaaaccaggagtcgctagaagtgaatgagctgaaactggaaggaaatccctttgttcaatgtgggtttcagtgaatgcccagcaggcggctaaaccagttcattaagagagaaaaagacgggttcttaaatgctgttctcagaagcaaatgcctagaaaaacatattgtgacagcaaaaacacatcctggaactcatacactctatgaaactttggtttttgtcatcaacgaataaacaaactttccaaaaaatatttcccccttcatttaaaacaattaactaatctgtttaccatctgccagtcttcactcccacaaaaatgtgattcttcttgttactctggaactcggaaacatttatctttaggattgtttaattttatagggtcatttttaaccacatacttaaaaaagaataattgacgtatgaaaacccttttttccctctgctttagaaatctaaattctgacctgaaaagcaatctgcaagtagcatcctgtcaaactgagatgtgttatttttcctgtctgttctctgctttattaaatcgtcatatactgcacatgattttccccccagaccaggcctgccttgggctctctgttgcattgttaactatttaagcattagactggcgcagagatggcaggtgggaaaagctgagggatttgatctcctccctgccagagttctcctctttcacgagtgctgcttacattgaacagcttaagaataagctcctgtgtgagcccttggaggccaaggagtattgttgaattcagaaaggaatcgctttctttttgtgataatttgaatattttgacaatgaagctaagctacttcactgcctggtttgcgtacctcacgttatgtgcaccctttcctgggaagcagaagaacccctgcctctttgaatacataaattggtattgtccgtttgtgagatgggtaggtgcaaaggaagaatcatccggaagaattttactcttttgctttaatgtctttttaaagctctttcaaaaaaaattttatacaagcctttggagaccacccaattaaaccagcacaataaatgttgagcattttgaggaaagagatggaccataaagatgatttgtaaagtgtttatacaagcaaaacaaggaatatgttggaaacaatttccctaaatgactcaggcaaataacctgctcacctccagtattttcctgtattgtgatgcattaacgttaaaaacagttgtcccaaaatggccttggtttttccatttttaacttaaaaggatgttctcatacaaaataaatggacatagcctttttgatcaaattcacagaagaaaataggcaagtgaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttag

SEQ ID NO: 123221 - DNA, 1033 bp, Homo sapiens
aaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttg

SEQ ID NO: 123222 - DNA, 1125 bp, Homo sapiens
gctttagcacagcagtgaactaatagaggctgcgtgtatagccatcttcctctggctattagaacgaaccattcgattgagaataaagtttccatatagtttgggtacggtgacatgaaagaagttgcagattgttcagtgagactatcgcttgtagggttgtaggatggaggaagaaagggagagtgagagggagaagtttatttatggaatgtcagggggccattgaagctcagcaggccctagaagcagaggacttccccccgtgcttgttttctccctctgaccttggatgaactagcgagcagtatattatgctgggtgattgtgctggtttgtcatggttagcattctgaactgtcactggaatgtaggaaacggatgaatttgaattaaaccatgaggtggtctgctgagccctctccttgtctcaaggaaacctgtcgctgtttgtctgggctgggcctaatgaaagcaatggagggaaagagaggtgggcctttgatctctttgttgcagctgctccctgggaactcgctgaaatcaatgccctgttttcctgaaggaatgaatggctctgcctaactagctttgtgaagccgtggggaattcactgcctctgtttattgacagctgaaaaggagcacatggggtggaatggaccttcttgtgaaaaccaggcacagggaaaattagacctcaatttaacacagaggaattgggaaattcaccccaaaggagacgggagtttctcatgcttacattagaattactcaagtttggggctagtgtgtaatgaacaatggaggttttgtcacaactatgttataagtaggaatatggtctgcataataaatgatgttaagtagaagttgattctccacccgccctctttttttaaacacagaagtagagtaaaacaaatattaaccatgatacaatcaggtgattcttttatttttgccttgagaggaaagaaaacagtgatacagtaagcattattgatattatatgaaactctctaaaatccatctttcattcattatattttaaaacatctttgaacttggaagctacgttccactcaagccagtgattcatgccattctggattgtgtgtattgc

SEQ ID NO: 123223 - DNA, 1014 bp, Homo sapiens
ttgaaggctaaacttttaatgcaaggaatcatgcaatctagagactgaatgttaaattttatgtctttttctttaaaagaaatttttccttttaacaagtttacactgttttgattttcagcattgataatagctataattattgatctttcactgtatgccaatgctgttttaggagctttatattagttatctaatttgatcctccacaaaccctgtgaggttattattcctcttttacaaatagggaaactaaggttccaaaaatattgttaattgcttaatttataaaattattacaaagtgacactaaaatttaaatacagatctgactccagagtccatactcttaagcaactacctcattgaatggaagtggtacaacccattggcctcaaaaactaggatgacttatttaatataaccttggtgagagaactccagtgaatgattatatccccagtacatggtagctggtgtaatggaaacagcatgagactcaaagatagaatacttgaatttaaagttttaactgctgattattagttctatgactttggcaagtcaatttacctctcttgagcctattatctcctcattcaaaaatagattaataaaaccatctctctcaggtggttgtggcagagatccaatggataatgtttctcagtgttttgtaaatgcttttgaaagatacgtaaatggattgataagtgtttttggtcatttgccaaagactttctttcagtagtatttttcctgagtgcttttaaaaaacaatttgatttatagaaatgtagcaagtttccagagaacctctactgagttacagggtgatcattatataaggaagttctactcataagcctaggtttctttgatgagatacatagtttttgaggaatggttatttcatagtactgcgtcaaggaattcacagatatttctgtcgtgattttggaagagtgggaagacagaggggttaaatgtgtcccctaggcccaaagcaagtca

SEQ ID NO: 123224 - DNA, 1038 bp, Homo sapiens
ttgggcccaggaattcaagactagcctgggcaatatagtgacaccttgtctctaccaaaaaaaaaaaaaaaaaaaaaaagccagtgtggtggcacatgccagatcttgcctttcagggaagatcttggtttcctcctccagaacctctgatgaagtagagccaacctgccattaactctgctgtgttcggaggctgaggtgggaggatcaattaagcccacgagatcaaggttgcagtgaaccttgatcacgtcaccacacttcagtctgggtgacagagaccctgtctctaaataaataaataaataaataaaagccttgagtaactgggggagattataaagctagttaaaatcaattaatagtgatttctagaaatctcgtaagatgtaagcattttaatttaaaggtttctttttagctaccttttaactgaaaatgtttttaatatatttcagtgttaacgaagtaatgaattaacttccctcccagaaagtcaagaataatagcatgtatcttcctgtggaagatgaacttcagagctccatttccctagttcctatgtataacttggttatacgcacaccaaaccatgctaataatgcattctcctcccctggctgcctcttgaacttagatcatccaggagacgtctgtaaaattagcactgtaaagaaagcctcgccagggtatttggggcagcatatcaatggcttattgagcaggcgccttttaagcactgttgaatgataggcaaaactgtcacagctatgcataaatgtgctgtgtagtttcacagaagagaatattagtcctcagtaataatgctatattattaagctaataaacctacagaaagtttgtcacaataggtgtctgtcaaattactataatctgaacatgatctttggagttttagatgtctctattggctgaagagcctaattttgaagcttttatctgttcaaaaatttcagttctcccatcatcatctctgctcaattgaatatgtctttttcaagagtaatcttgactatg

SEQ ID NO: 123225 - DNA, 1037 bp, Homo sapiens
gtgatcattttttttaaattaataaaattgaactttctcttccatttgcattctgaaatacaggaaaaaaatttgaactttctaatatctttccttcctgcttctttcactcccctcagcaccttggtttaggcccttgtcaccctatgctatttttccctgtattgacttttcttcccttcctatcatgtgtagtgaccactggggtcagttccctgaaaaagtcctttagtggcatcccaatacttacaagattcttggcttcttagcatgacaatggtccttttttttgtctggtcctaacttactttactggccttctccgatttctcaaaactaatccagtggcacaggtggtcctaaccacgcatcagcccctaaaggtttcactctcctgcttttgcagctgtgttcttatttgtgccatttcccctgccttaaatgttttctccccaactaattttcaaccattttttttcaagctctgttcagagaatactcactctacaaccctactagctacatagaaaccctataatttataatctatagcccttgttaaattcttacctttcgtcaccaatctttatatctaaatgtcttttccagatggtcaggttcttagatagggttcaagtggctgacatgatactttgcatacaaagagctattgccaaatagctaccactactaagtacctactataattgtgctacaattttgcaaagtaagtattattatctcttttaaattgtgaagaaacttagtatcaaagagattaggaaactttcctaacaccatatagttagtaagtggcaaaactggtttgtctgaatcaaagctcttgctctttcttctatgccatactgcccttgtgctaaaaatgaagaaataattaaataaaattatgaacagaagcatttatggtaaaacacacactgaaaatgacatacacagtgaaagctttgctttcattgccaatatactatagaatcttcactttggtgaccatgatagttgctatggattaactggtg

SEQ ID NO: 123226 - DNA, 1084 bp, Homo sapiens
tttcccattccatatgagttttagtacctgtttatgaagtttcttgaaaagtcctgttgggatttttatagaaatggctttgaatttatagatcaatatgagaagaatgggtatatttgcaatactcaattttttcatttatctcacatgtcctttttgtgtccttcaatgatatgatataaataaaggacttgtacatattttgttacatttatttctagatcctgatgatttttgttgctactgtgaatagtttctcttagtttcttattttctaaccagctagttactacttcataaataacattatatttccatttacataaatacataatttgcaagaaatgatttttttcttttccttctgatcttcaaatctcttattcttttgtttatgtctaatttcactggctaggacaaccagtacaatgaagaatagtggtactgatcatgggcattcttattttgcttctgacttacataagaatgcttttgtagcactgaagcttagtgtgatgttgttgcgggatatttaaagttctcttcttctagttctctaagagttttatatcatgaattgtattggattttattaagtattttttctgaatctattggactgtgaagccagattgcttgcattcaattcctagttctgctcctctgctgccatgtagtataatcttgggcagttacttctctgtatctcaattttctcatctttaaatttaggtacaactgtctaccatataaggttgttgagaggattaaatgagttaatacataaaaaggggtaagaattgtgcttagccctaggaagtactcgtttttttcttcattacttagtgttaggttattttaatttaaattatcataataagtaaattaattactaaatcatcttgcactcgaaagtaaccttacacatatttattcacatgatttggatttaatttactgttttaattttttcatgtaatattcatgagtcataaagtgactgttcttttgctatagcaaagaatgatggattcctagaacaacattacacaagagcttagcaactgaggtggcaacattccca

SEQ ID NO: 123227 - DNA, 1178 bp, Homo sapiens
tgtgcaactgtcatcccagctactcgggaggctgaagcaggagaatcgcgtgaacccaggaggcggaggttgcagtgagccgagatcgcgccattgcattgcagcccgggcaacagtgcaagactccgtcttaaacaaacaaacaaacaaacaacagaacgcgaccaggagtcccggaagcctgcgtgcacgaactcccaagaccacaagtcccagcatgcaacgctccttgttggaaaagggcctcccttagccactaagtggaccatcatgcaacattctctgatggggcggggatctccatggaggggggaggcacacttgttgcgtcgcctcagcaactccaattgcgtgacagaatgtgcttccgcttccgcctctgagccctatgagcgagagttacgctacttagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaact

SEQ ID NO: 123228 - DNA, 1590 bp, Homo sapiens
ttgctttcactaggactcttctccttcctgcccccattatcctctcatgttttattttcaaattttataaaagataaatgttgttttatggagcaatgtctcaacatcactttactgtgagaagcactttacatatattatcttatttcatttattttatctaatttcccccatttcaattttacttgtttattctttaagtattctgcctctattttgtttttcctactttgtctttatttatatttccattaaaaataatactttcacatccttttgaaattatatttattcctagttcagcctagaatttttgtttttaatccatatttatatttttcataaaagactaatgaatctagcttttttttttccccgctcgctcccctctccaccttagcaccgctcaggctgcactgcgcttgctgcaagcttcaggctcctgctaagctagtgctgcatcgtctcccttcagccgccatcatgattatctaccgcgacctcatcagccacgatgagatgttttccgacatctacaagatctgggagatcatggacgggctgtacctggaggtggaggggaagatggtcagtaggatagaaggtaacattgatgactcgctcattggtggtaatacctccgctgaatgaccctagggcgaaggtacagaaagcacagtaatcactggtgttgatattgtcatgaaccatcacctgcaggaaacaagtttcacaaaagaagcctacaagaagtatatcaaagattacatgaaatcaatcaaagccaaacttgaagaacagagaccagaaacagtaaaaccttttatgacaggggctgcaaaacaaatcaaggacatccttgctaatttcaaaaactaccagttctttaattgtgaaaacatgaatccagatggcatggttgctctattggactaccgtgaagatggtgtgaccccatatatgattttctttaaggatgatttagaaatggaaaaatgttaacaaatttggcaattactttgatctatcacctgtcattgtaactggcttctgcttgtcatccacacaacaccaggacttaagacaaattggggctgatgtcatcttgagctcttcatttattttgaccgtgatttatttggagtggaggcattgtttttaagaaaaacatgttatgtatgttgtcgaaaaataaaatgcatttaaactaaaaaaaaaaactaatgaatccaatttgtatttttattttattttatattttatacctttttatttccttgatcatcagtctaattgttttatcttataatcattacattcatatttaatctgtattttaatttcaatatttgtttttttttaaattttctctctttcttgtataattttacttaaaatttttcttttttcttttttttttgagacagactcttgctctgtcatccaggctggagtgcagtggtgtgatctcagctcactgtaacttccacctcctgggttcaagcaattctcctgcctcagcctctcaagtagctgggattacaggctcttgccaccacacctggctaatgtttgtatttttagtagaga

SEQ ID NO: 123229 - DNA, 1050 bp, Homo sapiens
tatatatttaccatcctgcccagcataaattcctattccctttgccccttcctcaaagtgtctgtttctggcttctggccagaggctatatttcctcgcctgtcataatggccatcctgcaggctggaactctttatgagaaataaagctctcctttccaaatttaagaacctcatcattcttcagttgacaattgtatttgccacagcaattgcaggagagtagaatgagatcatcagcaacagatataatttttaaaagagagaaaattgggagagggacatagattgcattcttctgacttattaaacttttttcatgtaaaagttttgaaatgtctaatttttcatcatcaacagcctcttcttaaagaaaagtctgggtaattccctgaataatttctgaaatagcagagttctaaactctaacttttcaaatgcacaataagagaacttattgtttctccctgtgtatcacacccactgggttagtcacaaatagctatattaaggatgtttttcacattttttaaacactagcaatttggacccacccagttcagctttttaaatgcaacctgacttaaaaaaaattgtttttaatcccacataagaaaaataagaaacccgtaacactcggaagatgtgcaaaataatatatgatatcctgcttttaagagcagcaaaagtgcaccagagagtataaagtggaattgaagtctattattataaagctcttttactgtgattcagtgtaatgcctaattccattagtgctctacaaagaacaacatgcacaaatgtactcttttagctgcagataacaaatgaagttttaaagtggcctaacgagttaaagtgacctcaacattatattaattgagtcaattagtcaatttctttctttcttttttttttttttttctttgagactgagtcttgctctttcgcccagactggagtgcaatggcgcgatctcagctcactgcaagctctgcctcccgggttcacgccattctcctgcctcagcctccctagtagctgggactac

SEQ ID NO: 123230 - DNA, 1031 bp, Homo sapiens
tttgagggaagggaaatctagggcagaggtaacaataaattgcatttgtatagggcttgaagcttctaaagcaacatctcattcattgattctcagtttctcacctagccttctgtgaagatggtgttccctccattttataggtgtggaagacggagggtcacactgggatgcattgttcgtggtgaaactttgattctgtctcctgagaaccaaagattctgcatttggcaattagaaggagtcatcctttgccttaagtgtactcaaattcctctggccattaatggcaagtaacctcagtggctatcactatttaaatagccttctgttattcttctttctccccattttcctctgtactctgatcaccttttctgctgtatctttgcaacctgtaagggattttcattatcaagaagagaaaaatttgaaaaatcaccttgaggagagtggcaagtgaaacattatagtgaagaagtgttactgataatgggcaaatggaataaagtagtgtgtaaacagttgacttttctcttttatgggtgaataaaggctttgggtagcatagaagtggagatcttggctaagaccaatagtgaagaaaagcattagacttactgctccaaagtgatacactgtagttctttccaggaaagagaatttttccctgggcaaacttaattttccatgataaacttttatagacattcttctgaacaaagtttttgattcttgaatataataaaatacacttaagaatttagcaaatcctttatagttatgtacttgaatgaaagaatgtaatcatataataatccataaatttttagcagtagtagagcctataaaaaatgaaaaaagttttttagactctcataaaatctgtcagattgatgatccaatcctttatatccaactctctctctctctcttttttttttttttttttttgagatggagtctcacccactcggtcgtcaaggctggagtgcagtggcagcgatcttggcccactgcaacctttacct

SEQ ID NO: 123231 - DNA, 1067 bp, Homo sapiens
ttctgggctcaagtaatcctctcgcttaagcttcccaaagtactgggattacaggtgtgagccacctcgcctagacccagatgccctttaacaagttttcccacttactttattttttttgagatggaattttgcccttgtcacccaggctggagagtaatagcacaatttcggctcactgtaaccaccgcctcctggattcaagtgattctcctgcctcagcctcccaagtagctgggattacaggcacctgccaccacacccagctaatttttgtatttttttttaagtagagatggggtttcaccatgttggccaggctggtctcgaactcctgaactcaggtgatgcacctgccttggcttcccaaagtgctgggattacaggcgtgagccaccttgcccggcctagttttcccacttattttacaatacttactgcatttttctgtctgtctgtgtgtatgcatatatacatctacatacatatatcaacctaaatatacctatatcagtatagacagatatatgctattctgtttgaacttaagttgaagataccatcacacttcattgctaaatatttcaccacatgtctcttacaatcaaagacattctcctgcaacaataccataattaatgttaaagaaatttaacattgatacaataatattgtctaatacatagtccaaattcagatttttcaaatgatcctcaaatgttttattttaaaattctgaattcaatcaaagattacatttcattgtcatgtctatttagtctcctttaattcacaaagctccccctctcccaggtaattttggttttcaagacgctgacagttttgaagaaaccaggccatttcttttgaaaactagccacagtctagatttgtctgctcatgagaagattcacgttcaacatcttggcaaggatattgtgtagatgatgtggtgattttccattcaattgcatgatgccccatgattggttatgtgaattttgatcacttggttaagattaggaatttttccccaacatattactatgaaaaaattctcagacata

SEQ ID NO: 123232 - DNA, 1039 bp, Homo sapiens
gaaacactggcttgtgctccattctttgactgctccatgattctttctgccacttcacataggaagctcttaccttttctctttctgtttccctttttggctaattaaattcttgtcatctttaaaggcttggctcaaatgtctcttcaagaaagccttctctaattgcccagggcaggtcagactcctctgctgtgtgctcttaatactctgtgcttctcctttgtatgatttgtagtctgtcagtattgtaatgaaataattcattatgtaattaattgcttagtgtgcataagcgccgtaatggcagaggctatgtctcttgttcatagtcataacaccattgcctggcttggtgctttacacgtggtaggcactcaataaatatttggtgaatgaatagttactacgaataactatataaaatatataaatacattttttcaagtcagtactttcccttttccttttaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctggtaggtaaaggaagctcaagaaagctatggatttttatgtatttagaaaacctatgtttcttggattgatttgcattgttcttgcaagaacttcttggaggtgaagttcttttaagaaactgaattctgacaaatgactataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccgaacatttctctttctattttctggaaattgaagggattatatgcttaatgtaggaagtgccacagtttctggcaggaaagatctttcacagtttgatttcattaccata

SEQ ID NO: 123233 - DNA, 1236 bp, Homo sapiens
tatcccagagccctgtagaaagagtagacctcagggctaaggacagtgtgtcagctggctccatgtggagttcttgacagtttgggattatagactctcagctgggaaagaactgtttgatgaatgaaatagttgggcaagcttcacatttttggataattcaatgtgttcttcaagcgaccttgggctggaagcctgtgtgtaacaattttatcatttcttcctttgcattttctcttcttgtctaatcttaggatctaattgttgagggaaccttaaacgccctataacccagccattcctgtgatgtgctcacccagtctctgtttgcacacctccaatgatggcatctcactgctgctgctgatgatgacgattctagcaacttacactaattgaacacattctgtgtgcagatgtggtgctaacagtttaatcctcacaaccgccattttgcagatgataaatgtgagccatactgaagtgatttgtggcactggacttctttctatttctccaaaggcccagtgtgtcttcctcagggcctttgcacatctctcttcttccatctttgcctggctggttccttcttgtcatttagatgtaggcctaatgtcacctcttcagagatcttccttgctgactttagaaagtagctctcccagtcactcttgactgcatctctgtatttacgttccctgtgttgttcttagcactctctggtaccttttctggtactgtgtgttcattaatagccttcccactagaacagggctccccaactcccagggcctggactggtaccagtccgttgcctgttagggaccaggtggcacagcaggaggtgagtggtggctgagcaagcactaccgcctgagctctgcctcctgtcagatcagcggcagcattagattctcataggagtgagactctatggtgaaccgcacatgcgagggatctaggttgcctgctccttatgagaatctaatgcctgatgatctgaggtagaacagtttcatcccaaaaccatccccctcatcccttggaaaaattgtctgccatgaaactggtccctggtgccaaaaaggctggggactgctgcactttaattaactccccaagagcagggaccaatacatccctggtactgagcccaatgcctggctcataataggtgagcaataaatgtttattcaatgataaaggctacagagtctggaagtgccagagctggca

SEQ ID NO: 123234 - DNA, 1026 bp, Homo sapiens
tcctaactcacaagacattttattccattgctgctcggtgactcttcttcattttgtgcctaattctgtcccttacacattttgcactgtattaattgtatttatacagctcttctatctctttttttgtagttttcaggggtgggaccctggactgtgaggtagagctcctctggaccccaggttagtatctcagagccctgacaagggaaggccaattgtaagagacacagcctactgcttctgggccagttgcatcctttcttgatttttggctctagtctctgtcattctctgttgagttagcaaaggggaaaataccagaggacaaacagtcctttgggtggaagatagagaaatggataatgtgtttctgacatgaattcctttttctcttttcttctgactactgctcaaggcttttaacgagctgaagttaaaaaaaaaaaaggtagtggatttcataaggactgacatttggcacagtgtaggtcctggtccgatgcccagataggtatctgtggtactgaaagagttggttgaggagtgtaggggaaggaagcaaagggttggttgaggagtgtaggggaaggaagcaaagagagaccagtgaaataaaaataaaacaaattattaaatatgaaatattataccaggttacatttatagcaagcctcctgaaaatctgctatgtttggaaagtaaacttgcttaacaagattcaattttatgaaaattctgaggaggattaccttatttgtttatctttctgaggcctttcttgaggaaagacagtggttaagttgtatttaggcagtcatcggtctatttctttcttttatgtttaaagcagtatctgtgaggggatttttctaaacagctcaagggactgtgaaaaaatagttcattttttgtttctcctgaagctttccttggctggaatacctgtgctttgaagggaggtctttgagcaggtttgtttttttccatgagccctggggatttgtagtgatagacagtaaccct

SEQ ID NO: 123235 - DNA, 1028 bp, Homo sapiens
ttaaaagtcatagaaccaaagtgaaaatgatctgcattttagaggagcaaggaaagctacaacgtttattatttctacttataaacacttccctttaaataatttgaaaagataatagatttcatgatgttgggcattttttcttttacactgtattttgaagagtttgggttgtgttgggtgaagttaaaagtgaggaaagtgggtcaggagagtgatgaaacctggtgcatttcttattttggcccattgaaccagaagatgataccaatatatctagtgccgacatatttctccactgcgctccttagttattgctgcagtgtgttcaaggtcttcttgctgtgagtgtaacatcacatcttgaactctttttctagggaatgcatcagcttagagtccgctgatgcattcattataaaaatgtattgtgtatattttctattacattatttcaaagacagacgtgtttttgaatcatggtgggaaaaaaactcctcacattcaacctctatgctagttttcttatcttaagggggggtggttagagaaatgtattatatatgtattaatatttgcctccctgttttttaattctaaataggtgacatatttaatataactatgcttgcttttgaaataatttgcctaccattctttaaaatgagtgaattttaaaagatgtatagtgatttttatgtgaagatgaattaaagagttaagtgacatagaccaccgtagcattttccctatggatctgtaaaaacagcccaaaagtcttgtgatttttttttttttttgagccgtagtcttcctcttgctctgttgcccaggctggagtgcagtggtgccatctcagctcactgcaacctctgcctcctaggatcaagtgattctcccacctcagcttcatgagtagctgggactacaggtgtgtgccaccatgcctggctaatttttgtatttttggtagagatggggtttcaccatgtcagccaggctggtctcgaacttctgacctcaagtga

SEQ ID NO: 123236 - DNA, 1312 bp, Homo sapiens
gtatgaatatttacactaagtggaacacaaacagggttataaatagcctcaggtcagttcaggtcacgttttgctgccaaatgggttatggaaaaagcctttggtttccagagcttttcagatcctggcattgtggataagggattgtgcacctggtatggtgactgctttctcagtgtccatttggtgccattttacatgtattgcatttgaagtactcacaacaaaaatacctatgtatatatatacctctctctatatatttttttccttatttatttatttatttatttaacagctaaggaaacaggtttcatgagctcgaatggcttacacaagatcaagaggagatgatctcctttgcaaacagaggccaggacccagggcctgggcacttagtgggctataagagtttctaatttgcttgtttgaagcattggaacataagccagcctgcagaatcctgtttcacatttaatggtagctgaaagacaatactgcagtaaaagtgccataggatgtaattatcctaacattgtttcttaagaaaagacatcttaagttcaaccagcggggtcaggaagtggggtccctggcctgaacagtggcttatcttccttcctggatggctggcaggggcagtaggtcagtcagggcactgttccaggacccagtggcagtgtgggcagcactgtggtgagatgggaagagaggaaggaaggttcgggtgcttgatgtgcattgaaggggtcagggaagggggaattggctactggctgaggttctgacactagttggacagggcccgatgccaaactcttgttcttgttctcacctagaaattgccattagttagtgctgctgctgggcattattttaacttagaccaaggcagcccttttgcgtgggcaattagataacggcgcccactctggagagacacagtctgatggacacactacttcgtgggctgtgcctttgtgcaaagcaaaaggtgttctttcctccgtgccgctgtgctggctggatttcagcgtcgtttttcaccttggcctcgtgcctttatgcagtggacagatttcaggcagcttggcattagtaggaatctacctgaaaagcactttatatgtgtttgaatccttggcatgatctggtgatgatctggcagaataggtattaccatgatttgccagatgagaacgtcatggcgctgtgaactgctgaaggtcgcctcggctccattgctatctggacaggactgttccctgtacactccctctttcaaaatggaagaggcagctagaggatttca

SEQ ID NO: 123237 - DNA, 1053 bp, Homo sapiens
agttttctttttaattcatcattccaagtaggtgtctttgtctgtttccacattagaaaatgaaaccaatacttaaatatgatttccctgcttttattggcagctatttaagatctatgtctgaggtctggctccgtgtggtttggaatactttattgttattattattattattttgagatggagtcttgctctgtctcccaggctagagtgcagtggtgtgatctcagcccactgcaacctctgcctccctggttcaagtgattcccatgcctcaccctcctgaatagctgggattacaggcacacgccaccacgcctggctaatttttgtagttttagtagagatggagtcttaccatgttggccaggctggtctcgaactcctgacctcaggtgatccacccgcctcagcttcctaaagtgctgggattataggcatgagccattgcgcccagcctggaatattttctaagctctttgatgatggcggcttcgatttaactctctctgacttaattctgttgattataatgtcattcaatcccattagtatactcatatggaaacaaaggcatgatttcagattttatttatatcttcatgctttggaaaaacaatttcatgagaaatcactcagcccatgaagtaccatccttgacattacttttttgggtttgcttgtttttaaaacagtttttattggcttttgctttttataattttttgaaccataccaacagtcgcataatgagtatttttagacatgtgcttttaaaatcatgtgaaaattcttttaatgtcaacatgaagagttttgtttataatcattgctgtgatcaagaactgaggtagaatttcctagctggacacaaatgggttaaaaaaaaaacccgacatgctctttgattattggataagttgtattctaaacaatattactctgatgaagatattaaggggagttaattagattgtgagactcttgaggacagttgatgcctttttcatttttgcattcttcttgggtgccgtgtagttgatcagtatagtc

SEQ ID NO: 123238 - DNA, 1238 bp, Homo sapiens
aagatcactctgggctctgtaggagagtgatttggagagaagagcccctagaggcccagggaacattgcaggtggctctgccaggagaccaggtagaagatgtggtgagggtgggcgggagatggatgaaactgtggatttcgtaggtacagattcatcatccttcatctgtagctacactattgaagaagacctccgaaaaccagaaggtgttttatttgtagttcatttggcaagaaaacttgagtttgacctgaactcatttggtgttgaagcctgacttgaacagctgggactcttttaaagtccttatgtatgtcaggcatccttcataaacatatgtatttactgcagggctattaatgtgtttgattaggggaaattgccctggatcttgctgttttttgttttcactgtaatatatgacttgtgctatataacttttctcaaatgggaagagttctggttcagcagcacctctggccctagggttttggaaaagaggttgtgaaactctttgacatgtgtttacaggataaggttgatgaaactgactgataagaaatggaggcaagatctatggaagaaaagaacatttctggaaagactcaaaagttaatgatgacactgcctcattaacactgaagggaagtagaactttaggaggggtcagaaatattcattagataggcatgattcattgaaaaggatgcatcttgaatttttgaagtattgcttgtatgtgatcttggattgaattgtagaccagaaaaagggggcaattgcagaaatttgaaaaagacctatagattagttcatagatttgcatctatgtgaattgtctggttttcatcattgtactctggttatgtaagatggtaatatttgaggaagttggatgaagggaacatgagaactctgtgtactcttttcttttttttttaaccacttcttttataagtctaaaattatttcaagataaaactttgaaaaataagaaaaagaggtgtttgtcatatcagggaacagtatcattcatgatgcttttaggtagagagtatctatgagcagaagtctagttttctaggagaattcaaagtctagaagtgcaaatcgagtagaatttcagtcaggccttcaccccctcccaattttttctttttaaaaaagctgacctggtttctattgtaagattatctttttatattctgatctgagaaaaatgcttgactgtagcg

SEQ ID NO: 123239 - DNA, 1954 bp, Homo sapiens
agatcgcttgaggtcaggagtttgagaccagcctgaccaacaaggtgaaagccgtctctactagaaatataaaaattagccgggcatggtggtgcccacccataatcccagctactcgggaggctgtggcaggtgaattgctggaatctgggaggcggaggttgcagtgagctgagatcacaccactgcactccagcctgggcgacataacaagactgcgactgcgtctcaagagaaaaaaaaagaagagttataaaatggagagctcatgggaagtgccataacttgtcctttgcatttagtctccctggtgttggagggtgtggtttggctctagttcttgttggtagctctgcagggcgaggtatagttgtattagttaggactgacagttataatatgatgttcaaagccaagaaggtttacagataacagggaagaatgaagaagatgtgtacccttcatggccaaggtcagcttgcctggattttgtggggctgatgctgctgggtgtatatttcctccgtggagagaggattagtttctgaattcctttgcttccctctctaacttcaacattacctcctgtagtttcagctaatttgttctgtaattctctctccactccaattctttctttccttttttgatgagagtagacctaggctggcagccagttgctattgagctataatagagctagtggtatgaacaaaatttgattactgctgtcaacactagattgaataagaaagcgcataccctagacagatacttgcaacataaatggtctattgatttcacaagaactagaaaatgaggccaccgtgtaatctagcagaagaatggatctgtgaatagagtgggtcctgacattgcacaacagttttcaaaagcgcccccctattgatctttttagaagaatcttcagataaactgattttagcttctgattttcctcaccatcaagtgtttacagaaacttcaatgaagcctttgcacttgtgtgtgttcaatggtttgcttttcctacatagaatctagtttggaagttatattggctgttacagaccttgtttgctcctgagctatcatgatatttccacttagcttaatatgaatgttttagaagtttcccactatggaaagttctatttgacatatgaaagttcaacggtcaatttcatagtcagctccacggcaagaaataaataagacaatggattacagagtatagccttgggacatgggaaattttttagaagatggatgagtcatattattaatacatgttgcaaggcccaaggccttacatcaaaaaataaggaaaaaagtttttattttttaaagttaatagccttctgatattttctttgttgtactttgtatagtttttgttctgtttagttttggggggatcaaaaaataaatcctaagatagaatgttttaggaaaaaggtaattaacatcattgtacatgaatttgctcaaacacagtaaggtctgaaaaaaaaagatctctttgatgttgatttgtttgaataattactattctcccagtactgcacttttgagagggaaggagaaattgttgctagtgtctaaattttaacttgtcttccttggctaccttcaaaatttgagatccttaatcttaaatcacatctggtctaacaattcttcctataaacagttatgactatttactgacaaaaggctgcttttattgtgcctgtttctatttcagaggaagacacataaagacaggtggaaagaactgatttgtaaagattgaaatgtcatatttacattcagaatttcatttccttaccagttttcagaagaaccctttggtagaggaagcagggccaacttctttcacagcctcttactatagatagaagtatgaaggccagcaatatttagctggtatgaacccatacagctgtaccag

SEQ ID NO: 123240 - DNA, 1064 bp, Homo sapiens
gctacttgggaggctgaggcaagagaatcgcttgaacccgggaggcgggggttgcagtgagctgagattgcgccactgcacttcagcccgggcatcagggcgagactctgtttaaaaaaaaaatagatctctatctctatcactatctctctgtctatctatgtatcatctatctatctatctatctatctatctatcatctatctatctatcgatctctatctttatccagctgtatcatcattttcactagatgctaacaataatataactgagataaaccaaagtttcaaaacaagcttgaaaatgtgaaatgaataatttggaggcgggactggccatttaggcatctatgaaggcccagatgactcatgtctggaaattgccactgctcaggaaaccactcctgggagccctgctcgttttgccatccttcctgctttcttgcctgctgacaggactctatgtcagctgtttcctttttagatggaagggttaaaagattcactacttgggtcccccattagaatcaccaacatgcttgtgccccacagtcagagatcgtgacttgattggactgaggccctgctctgtagcttgtcaaaagccagccaagggtgtccaatgtggagggtacaggggaatgtattcgtcccccactagactgaaagctccatgggagggagtagaggcagctttgttactgctgcctcctagcacctgaatgtgtgcctgatgtgcagaagaggctcagtagctgcttgtggaatgaatgaatgaattagttcctttgagtaacaggaagttggaagaagattggacagaggcttagttatggtctttgctgatgtaggagagtgtgctatgttaggctgaacagtggctgtcatcttggaagacactccaggaaaaggtcacaggggaacaggtggctgatctgggggaatgctgaacagacctctcagaagagacaaggctccagggcagtggtgtccttatgaggcaaggcaggttgagaactttgggaaagagaatttcatcaggggctgagtgtgtgtgtgtga

SEQ ID NO: 123241 - DNA, 1002 bp, Homo sapiens
ctggggcaaatatgcttttactgttaaatcgtcatctacaacagatgacatgtagagagatgaaatgtagtctatagttgtttgaacttgcatttctttttttgtggaactgaacttctctgcatatgtttattggctctttggacaaattcgtcagtgatttggcttttcatgcattgctcattttcttttgttgcttggatccctgacttttatactcttaatgattccaagggaaattcctacaaaatggcagatttgggaggacttatttgaatttcttttgagttctaaaatggttaactgctaccttaaaagatagatattattttcagatatctaggacagaggtttgagtctttggacttagattctatagtattttctttctttttttggctgatatggaagacgtcatcatcccaaactgtgctgagactagtagttatttagatacactattttattacattttcgtatactgataaattatttccatatggatggtaagtcccagatttatttatgaaaaaaaccattttttatatattttatggaacatggagttagcagaaagatgctgtggagttaggcttaaaattaagccctaactattctgcctcctgttttggggctgttgtcagtctttaaaggtacatctttgtaaaattttttgaacataacttgacagattgcaagaaggattataataaatggtgtctgtttgtgttagagtatttcaagtcagtacaggaaaaaatacatttagatgctaagtgaagataagacattagtttaaatgaggccccgtatgcaccatcatattgaaaatttaccagtgtgtcctcgtccttcaatttagattcgttagtgatttttcacatcaaagcattgaagctgtaattctatgttgggttcatttaaccacagatccagtaaatggcaggaaatagagagctatacaggacagcaaatggcctgcagttgtgtggaggatatctt

SEQ ID NO: 123242 - DNA, 1040 bp, Homo sapiens
cttgttcttccagacttcctcacacccacccatagcctgcttttagttgatagtggctcagcaagggtaggagcctgtactttggctcataccaaattcccctcatttccgcacgatgatatgttattagtattctgatccctgttatttgttaagttaagctgtgcttcaggaatctcagaagatcacagcattttgttttcagtgacttcatttcataatatatgctctgggcaggtgagactagacttagagacattgaagcccaacaatttaatatccacaaatagtgttttatttgtagtcttcctatcctttcctcttcggtgttctagaaacagatgcttacattgtgtaaacactccttctgttactgattctatggtatccattttcctattaacaggatgaagattttgttttttcatcctcaagtctacaagaacggaatagtcagtgggatatgaggatcagataaaaatccccccactttagaatcactgatcttagtacttcctgcagaaactctgacagccttattttttttcctcctttgaatccacgtaggtgtttttgggaaacatttatttgctgatattggttggtaataataattgttatttttatttcaaataagatgctgctggtaaaattattgtgaagtctactcaacttagtaaacttatatcaaaagccaggttttacatctggtagaacagagatagtcaattccttgctgtagggagaggaagggtaggagcctgtggctccctccccgccatcttgtccccaaccattcttatacactagtttgattcaagcacttgagctttggagccagactgcctgaatttggattcagctacttttacctgggcaaactgcttaactttaaatgtctgtgctctttgctgaaaaatgtggacaatagaagcatctatcttatatggatattgtgggtattagactatatggtagtccatttaagaaacgttcagtaaatgttgctcatagtaacagcaataatgttactactccta

SEQ ID NO: 123243 - DNA, 1056 bp, Homo sapiens
tatcctttccatgttttctcccatagttaaacaaggagtttttacttcttttgggcagtagctacatagtatgagacttctagtagtgcactatgctaacatcatcacacttgaatgttttttgaaaatattttacgtaaaatacatgtcccagatggactctattctttagttggttatctagaattaacatttggattatgtttgctaaatgcgtcagccatatcctaagcgctgtgatccttttagaactattaacagatgagactggggggcattttatggttataagagctaaatgatatttatgcaagtgtgtaaacattaataactcagcgtttataagcatgttagaatatttgattatggctagggaaatgcatattagctatctagcacagatctaaaagtgatctgggctatacctttcatttctggatttctttccttaagcttaaagggtgttctaatttcattattatcaatctcaagatcatttcacagtttcctggtggttgggtgtcatggtgactttttgttttccaggctctttgtttggatatgtggccttgtttgagttgtctttgattgctatatatctgtacccttgtttgcttttgcctggctactgattctcagtgtttcactttgacctttgataaagctgtgactctgattcatttttaggggggattcacctcgttggtggaatctagccttgccctgccaggcggctgcctgggtgttgcttgctggttggaatgtatccattgaaggccttagatgttggagtccttgcttcctagctccacctctttgtttcagggcaccactcttctggtctagtgcacagcctggtctctgtcaatcagcacgttctgcctggcgttttatggcatgttttcttcccccccacatagggtagcagcctttttataagttgtaatgggtttttgatacccactgtcatttttcttttcttttttttgagacagggtttcactctgtcacccaggctgaatgcagtggcacgatcacagcttcctgcagtcttga

SEQ ID NO: 123244 - DNA, 1040 bp, Homo sapiens
cagattgtttaggactcttctacaacaagatgaaaaatagaagtttctcagagaaacactgttgtggtcttttaaatagtataaaagctattttaatgaagagttgcttttcaaaatttttggttgcttttcaaaagttgtaaaggtcagagagacaaacattggtatttcttgaggaaaaatgaggatatcttaaggttactttgagtagcagcatagtttaaaaaatgctccacgtcccaatatttatagttggttatttgatttcactgctttttgggctttgcgagtttatcttgaggggtattttatcttgcctgtgagtatgtaaggaacatgaaaaccaactttgacagagggttaaaaatacagagaattagaacataaaggtgcttgcataattggcagttatatgtgtaggattattccaaatcacatgcaggtgtgttttggtaaattttagtttgttttattccagagacacaggtaacatatgtgcatctcgggcttgacatgaataaaaacttttgaactattcatctgcatgtgaccattttccagagaatgtagttttagcaactgggagtctggatatgaggtgttttattccagtggtcttatgattgctcataaaagtaagattatttttcctggttattcacgaggataacacagtaattgtttagatagaacaagtgaagcagtttttagcagcttaatttagtctttggggaagaattgccttagaactaattttgaagattgttttgaaagcattaaacttggtagacctaagtttagagagcatttgaaactgggtaaattactttttacctatttatgaaaatggagagaaataggtagtaaaataggacatggaaagggtttgtagaggaagagagatgacaactgagacagaataattgaaaagaaatttctcaatatttatggtgggtcattgacacctttaaaaagacctcaaagaaaacaaaatctggtagtaccagactagtttattaaatgaacttgatatttaaatt

SEQ ID NO: 123245 - DNA, 1030 bp, Homo sapiens
agctgttgagtgtgcagaaatatggaatctttattcatctttgtaattcaggtctcttcaggtacacacacttgtgcgcacacagacacagacacacacacacacacacacacacaataaaaacagataaggaatcacgagggaaggaaggaaggaataatgccaaattttaggaaacttcagaatggctccttcttccccctcctccatttcaaactcagagtaaagttttgcttcatatgaatgatatgtatatattttttaaagtgagaaatgaagaagataaaagaagtattggttaaaaaatatctattattgacaggaagtgggactgttcatctctgtggagattttattatataaggcagtaattcgatacaagataatacaacatttattaaatattacattgtattctgtagttctcagggcattttcttataatattctattatttgatctttacagtgacttttgatttaaaaggttaggtagctgagccaggttcaccaggtagttaaaggtcaaactggacttaaagccgaggcttcctgattttctatgcggtgatcaccccattgcataataattcattgtatcacagacaggcaaggatctaccaaacttacagtgaatggagtgggattttctggcatcagacactagagcaggattatctgtgggagttgatgctatttatcaggaaaaagagtttagaaattctataagctttgtcagttaaaatcttggactggtactagttttaagcacaaaaagtatttaattgttaagcccaaagtgccttaagtgttaagaaattaataaccagaaatacagactgaacacctcagccctgaaattgatgaccaaatcacgtactcccataatggaaaggctggaagacattgtcacactgtgatgtgagacgcagtgatgaagtgacagtccttatacttttagttggcctctgcacccggatgttgtaggctcatttacatttttaatgcgtctcgttatcattgctttctca

SEQ ID NO: 123246 - DNA, 1054 bp, Homo sapiens
tagaaaacacagtaatgtataaaagtgaggtaaaaatcacctcaaattctagtcccccaaaataatcactgttaaaatgtattgctctagtgtctacagaaaaatctgaagtaaaatgaatgccagttacctgatccataatggttaattagtgcaatattgctttttcaaggacttcattgaagtaagttgaagtaaattactgaagtattagttatggacaggcctggtttctcttacataggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataagtgagacattactctatctagaagtgggctttacaaattcatgtctcctctctgtccctttgctgccaccactactccctgaagccccttctccagtgccactgctctcctttctgcacatgttctaccaaaaccttaagaaaagaaatatcatggaagaaaactacccatcaggtttttatttccttaggacttaaatgctgcaatacaaggtccatagtttctcctgcatatttatgaatttaaaaaatatgaaataattcacaaagttcaaccccactcattcagcactaactgataatgtatacaaaaaattgtgttagcttttcttctcaaactgaaagtaaaactctgtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacct

SEQ ID NO: 123247 - DNA, 1978 bp, Homo sapiens
tcacttgtaccactttaggttttaaactgacctttcatcgtgttctataatgatctgacattttaactataccttttgtgtgtgtgtgtgtactgtctacatgttctgtctgatggcatcattatttatgtgcatatcttaccagcctcactagactgaggacagtatccattggggggtgaaatatagaggcaaggaatagttgttaaatatttaattcataaataaaattgctgagaaagaattgattccgttgcaaatacagaaccaagttgttttcctccctactaaatagaaaagggtttccaccctaaatgctacattttgggagaaattatcacaatgtagctacggttgttttccatcccttcttcaggattatctctctacatgactgaatatcctctgcttagaaaacacacattgttgtccaatgaagttgaaaaatctttatatgggctttgggtgctcttcagactccctcctttaatcataattgctgttgaaccttgaatgctagtgtggatttcctacatgatgccatggaaaacactggttttggggtgtggaccctggacccagctctgccattaactatccaagtgatctgggacatgtaacttgacttctctttccttcctttctaaaatgaggggctgggacaagacaatctccgagcttacttctgcctctaggaagttgtaatgtaattcctttggagacttgcatagttggattttcccttttccctccacctatctccttgagaattaggtttagttccctaggtatgaggctaatgtctgattgttctgttacaaatctgagaaggataatattttaaagaaaggtatctttctgggtcatttgtgcctcagacttaggtgtttgaaggccttcttatccccatgtaagggtgaagcctctaataaaataaaagttagaaatttggatgcatgatttaattgaattaccaaatgattttgcagataaagttcaacttttgttattacttgtagtgcttgttgaaagcttggttaaccgaaaaagaagaggctttaaataaagtccagacaagcaacttcaaagaccaaaaggaactaagtgtcagtgttcgacgtctggctgtaagtgatggggttgtcagcatctgtgttgtaagcctatgatatcttaatgttttatagctaatggttagtagaatttagtgaatgcagattacagctcattacctagcattagactgctgccctgtaacaatctggaaccacgagtcttaccttttagcatagtgaactgcaaagcatgtacattttactataaaagatacatgtttaaaatttttggctggggaacagaaagacaaagtcctgttaaaaagagtcatctaataaatatctgaaatactagattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtactttttgatttggatcatatgttgtgccatgaagtaaacatttaaaatttaaatgttcaggttagttttaatttgtatgaaataaactaaaaagttgtttccttacacctgatgaaaaattgacatgtgaaaatcaccttcagttttctaaagtaagttttaatagattatcttaatatcctataatttaatttatagtaactgattatacttagccaataaataatcttaacatcttaaatcttaagtaatcttattaatcttaaaaatattttaatgaattagtcaaacataaaacattggtttgtagacagatattcttagcagcattatttataatagccaaaaagtggaacaactcaaatatccatacacagatgaatgg

SEQ ID NO: 123248 - DNA, 1841 bp, Homo sapiens
agttgtgactcccgttgctttcacagcctgttctcgactcgtctctctttaatgccttctcctcagtgaacactaaaggataaatagaatcatgtcagttccatgcatagaactctcccttggctctcaactgcctttgggttaagtccaaactccttaatatgtcctgcagggccttcttgtagctggtccatgtgattcttggccacatcgtcaattgtccctcccttgtgagttcagtactcattattccagacacgcctaactaatacttgcagtttgcaaaatgtgatcttccctttctctgctttcccttggcaagggaaactcctcagtgtaatgctgttgttctcctttaggaagccatccatgccccaattggattagaagccactcctgtgaattcctggaattagcacctagcaaattcttttgttattgcctgttactttccattgcttactagactagaagctccttgggagctgagatttgtatctggttcactttcatatcaagagcccagcccagtgcctgacatttagtaaggctcaatcattacatattgaacaaaagaagatgttaactttagtaatgtctgtacttgttctttgctgattatctaaccaactctggtttttattatctataagcatttataaaaatacaagtgattccttataaaggtgaaaattgttttaatatgtaaagttttaaaaatttttatttaaggccaggcatggtgggtcatgactgtaatcacagcactttgggaggccaaggcgggccgatcatgaggtcagcctggccaacatggtgaaactctgtctctactaaaaatacaaaaattagctgggtgtggtggtgggcacctataatcctagctactcgggaggctgaggcaggagaatcctttgaatctggaggcggaggttgcagtgagccgagatcgtgccattgcactcaagcctgggtgacagggcgagactccatctcgaaacaacaacaacaacaacaaattatttaattattttcttcaattgtttattaaccctataatattattactcttttcatacttttagttgtaaatatatgatctcattttgcatggttaccctatttctgggttgctgtttttgggggagtgataaaaagacatattcctgatgagcatttgagttgctctttctggagtcaagtaaaacagtagaaggaaacatgacaaatggtcacctctgaatcttcaaacaggtttgatgctataagtgcagagctgttgaactggattttgaaatggaaaactgccattcagaccacagagataaaagagtatatgaagatgcaagacacttccgaaatgaaaaagaagttgaaggtaaaaaacataaaccacatatatcctagtgcataaaatagttcatcatgctggattttctgctggcataaagacattatggaattcaaaagcctcctgtaaaataaatgtaggcagaaggtagcttttagtacattgtagtgaattttgaatccattcatgctagctgtcatcagatccctatttggaggacgttttttttttttcatctttgtcagtcactgagatgtacagtgaggaatacttcttatggtgatccagttagtggtactactttttagttagtttagatcacccttaatctggtatctaataatttatgactctatattaacattatgctgaagatgttttgccttcggaatacaacaaactattttaaatcaaaaagtgtattcaatatattttctttagagttgtaaaaaataaatacaattaaaaggtgtgggatcttagccctgcc

SEQ ID NO: 123249 - DNA, 1033 bp, Homo sapiens
gagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcctcccaaaataacaggtgtaagccattataacaggtgatataacagcctcccaaaataacaggtgttaggcaaaataacagatgttagcctcccaaaataccagggataacaggtgtcagccattgtacctgacctggatataatgatttttaaagattttttttttttttttttttgagaaacaggtgcaatttcttcctttggttgaggaggccacttaatatcattgctaggaggatcaaaatgaatgatcccttacttctgtttcctcaaaatagttaaagttttggcagtctcatactgtcttttaaaagaaatcatattccactgtcagattcagaaaaattttagagttcttacttttggaatacacttggttttggaaggttcactgttaaagattttgaaagctcatccctcctacgttacactatttacttcctagctgccatttgagttaggaactgtgttgcattgtgcattattttgtgaaatgcattgagcattgtgtgaaatgctccacatgtaacccagcctaacttcagcaattgtagattgtgtgatgactggaagtgtctgtatgtgtgcatgctaggcaaatgtgtcgtattgcctttcttctgaaagtgcatctggacagcatgtctttgttccttgaattcagttatgtgaaatatgtctttgagggtacctctttctccacttattggtacaagctgtgctttcacttttgacaaggatcagtaggcagtttaacttttgctgctagttggtttcacctctttgtgcttcaagagaactcacttcctttccacgcaagtgttacttctg

SEQ ID NO: 123250 - DNA, 1040 bp, Homo sapiens
tagaacaagcattaatgttggcagcaattaaaaaagtgaaacccatgcttatgcaaacacatgctcatcctggctgttcattcctgtggtgcctctgatgggacataaacaccaaaacttggatgtggtaactcttttatggtctcaatcttggtcataataaagcagttggttttgtagatcttagtataataatcgctaccatttagtgcattcttctatgtgggagtctctgtttttcagaacaaccagacaagatagttgttatgattccagtttcacaatgagttattaaggctcaaagaaaaattagtttctcaaggccccatggctaggcaggtgctgagcttggtagtcagacctcagcatttctttatatgggcacactgtctcttttagagcacagtgtggttagaattacatgcaggatttttagtagtgaaaatattatagtgtggctttacaggttcccttctattccctttgtcacttttgggatgatccattggcctacatggcttctctgtctgtttctttcctttttttttttagtatttattgatcatttttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgttccagagagcacggggttgggggcaaggttatagaccaacagcatcccaaggcagaataatttttcttagtacagaacaaaatggagtctcctatgtccacttccttccacacaaacacagcaacaatccgatctctccttcttttccccacacttcccccccttctattccacaaaactgccatcgtcatcatggcccgttctcaat

SEQ ID NO: 123251 - DNA, 1200 bp, Homo sapiens
aagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctg

SEQ ID NO: 123252 - DNA, 1021 bp, Homo sapiens
catgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcagataatcgcacccagattcgagagcttggccagactctgattgatggggggatcctggatgatataatcagtgagaaactggaggctttcaacagccgatatgaagatctaagtcacctggtaagagttgggacatacatgggtgttgattaggtattgatgaagtggagctggccctaagctccatatcatagagctttaatgttggaaaaatctttaatgttggttaaagttggtaaccaatgctaacaggggcattgagggtattgaaatattcagaaaggaagaatagatctaacactctaagacagaactggatgattaaaaaaattatttttgagattacttctacttacaaacatttaattttcattaaggatcatatgatagctgtatataagaacaacaactcatactatcctagtaaatattagggccatgatatttcacataagctgctgtgaaagccatagtctcttagttcatatccaggttgtaacatacatattcgtatcacaaattagagaaagaacatttcttttataggaaggttgggtatgaat

SEQ ID NO: 123253 - DNA, 1939 bp, Homo sapiens
ctcactctgttgcccaggctagagtgcagtggcgcgatctcggctcactgcaaactctgccccacaggttcaagcaattctcctgcctcagcctcccgagtagctgggattataggcgcccgccaccgtgcccagctaatttttgtatttttagtagagatggggtttcaccatcttggccaggctggtcttgaactcctgatgtcgtgatccacccgcctcggcctcccaaagtgttgggattacaggcataagccaccgcacctggcctacaaaaacttattaaagcttctgtggaggtcaacattatgtaaaatacgatatcatgtattacacaacgatatagaacttttgtattgtctctttttatacttaagtaaaaaaaaaaggacatcctctcccctttccaatctctttttagaaaatccaagcagagatctcagcccatgagctaaccctagaggagttgagaagaaatatgcgttctcagcccctgacctccccagagagtaggactgccagaggaggaagtcagatggatgtgctacaggtaaagaaggccaggagcttccttttacttttcaacttgttgggaattttcttcaaaaaagagaaagaattgattacttgggcaccgtttgtattctttgtgatgtaaaccatgggatgggagtgatgatgtgttgaaggttgcatcctagggcagcagaaacaaattgttgcatgtgtggaaaaatatgaaatctgattttgatagctgagatgagaaacaagagagtgagccagatttagaagttagctttatatacactttttctttaatgcagagcctctgtcagtatcgtgtggctgatgctgtgggcaggccgagcatgaattggatgcagcatcatttagttctttcatggttgatatgacattgactttcactctgaacttgtgatgaagggcattttgagttctaggttcctgaactatctttttgaacatgaagttttaattccagtgaggtcagctttatctaaatttcttatccaaatctattacttctgagattgagacactgagtgttgtaatttttgacactgggctatgcagttcacttaggtgatcgggtaccctcactgagattcattaggagttttttattttgggtcatatttctgaatttttttcttttggtactttatggtacaaatttttagtagtatctgttatgctcatgatgagagagataatcatcctgatgggaattgcatattttcatttctgcaaacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatggtgaggcttttgggtgattggcacatccagtggctttttcagcagctgttatggcttggtctagcaagtacatgcctagtgtgtccagtgatcactagtctacagtgtgctaaacataaggattgatgatggaaaacgtgttaaaaaataagaagtgtggtctttccctccaaagaaattagaagagataagagagatagctaaggaaactagaatagacatgtatataacatgatgacaaaaaccaaaacaaaagaaatacagcttaatcaccatgtgaagttaggagggcttcagcagagtgtgactaataagcaaagttttcaaggataaatttgaattagctagaagaaccatacttagaatggatatcgtaaaaattccattttctaggaaaataaaaatttcaatagaaatttaaaccttaagataggaaagaagaaatgatatataaggccttattacttttttagtcttgaactttat

SEQ ID NO: 123254 - DNA, 1074 bp, Homo sapiens
ttttgatgggagaaactgagacaataagagacaaaataagagacgaacttgaaattgaaagacttgtaagagatttcagcacaatcaaccggagtaagacctattcacataagatgccaatgagtcttgctgattgctgacttttgtattctccattgagtgctgcttacttctgtattctccagtgagtcttacttacttttgtattctccaatgagtctgtcttacttctgtactctccaatgagtcttacatacttttgtattctccagcgagtcttacttctgtattttccaatgagaattacttacctctgtgttctccaatgagtcctatgtgaacagctctcacctggttgattatgctgaaatctcttactggggatcccagatatttatttaaactacctttccttctgtataagcatcacactcatgtttgggtttgatttttcccatgagataattttgtgttttcttataattagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcac

SEQ ID NO: 123255 - DNA, 1017 bp, Homo sapiens
ctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtttggagaaaacgggtcattcagagaagtctgaattggtaaaatcattgccatataaatgaatgaaacaaaagttagctgagctgaatagaaaagtcagttaaaaaagtgttagtttctctcttgacaccccatctctctgattaatgatggaaagtcaaattaaaaatctattttcagagaattcttttccttctacagttgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaaggttggttcaaggagatttcaaaaccatggtggtctcatttttcttctctattaatttcatttttacatcaagatgtttgcccatataatctgtcaaacatgatgaaacagattcaaatgtgattttttgatgtgtgtcaatgtaagagtcacatgattcatgtgcttaaaaagaaaatagactcagtttctgaactagacataatccttagtattatctaatgtttgctaaactctctttgagacattttatcttcaaatataaaatatatttaaaaaaaacataaattttttgatcgttcaggttaacatatcttgacgtatactatactaagtaggttagttttcctccttaggagttgataggaagtgaccttatgcatttttcttttgagtcattttttttttccttttaaaaatttagatggatgaggagagtgcccagattgaggaagttctacaaagaggagaagaaatgttacatcaacc

SEQ ID NO: 123256 - DNA, 1052 bp, Homo sapiens
agtattatctaatattttattacatgtattgcacgattatgtgagaacttttgtgattaaaaatgaaaactcctagctgcaaaaacataaattcttattaggaatgatacaatacaatttatttaaaaattgcattcagtttttaaaccagcagttaattatagcagctataaaaataaagataccaccaggcttttaatagctttcaaatccttttaaaaaacacataatcttatttgtcatatgagttctaatcatattcctctcttctgacagatggtttatattcttataaatgttattcttataacactataaagatctaattgaggcagttccttttttatattcatttgactgttttccttgcatcatttaaaatttttgctttgtttttttctatatctctttttgtaacagtgctctattcaaatataatagttattttaataaacaagccaaattcacatgtttcttgtcttccctaatacttgtaagattctcccattcttgataccttgctttgttcttattctttctgttctatgaataaagcagagtaatagttaccacctaatgtgataacatgtcatataatgattcctttcaatattcgtgaaacactcaaagagaattatgctttttccctattattttagataaagacatttttcatgttttaaaaaatttccattatgttgcggagtggtatctaactgtaaaaaaggcttttgtattcaatttctacataactttttatgatgagggaagataatattctttagtttcaatgtttttgaatttaactaaggaaaaaagcttcttggtctattattaagcaatctttatattgtagaatatatacattgtttcacttaaaatatatattaaaataattattagaaattatttattttgggaaatatttagtcaggatattcaaagcaaatatgtaaggttctgcttaattggacagtttttcctcaatatttttaaataatatattcttttaggctaaaaggagaaagtaagcaggtgatgaagtacaggca

SEQ ID NO: 123257 - DNA, 1047 bp, Homo sapiens
aaaaatttcagtggtttttttgggaatgtctcttttgtaaacaatttgaggagagttagaaaaggtggaacagtatattaggatggagtagcaaggaggagataagaacagaatgttaaattagcagtgtaaaaataatatatgacccggttaagagacagtgagtaccagagagcccgtttgtgcacaggagtgcaaaaatacacacagaaggcatgtgctcactcccttcctagttatcatttgttagcatgagcttaagcttcttataagtttattttttcacttaacaaattagaaagttacatttgtaataataccaaaaaggtttctaatacagttcttgaattttcccttatctgactaccttctaaccacacctatcttttaacttctccaggacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataaggtgtgtgtaaagttactatcacacatttctcatatttattgattttgttgtcagagatgtgggatcatgtaactgctttactttcaagtatgtccaaatggggcaaattttactaaagcttactaatgtttatattttttatctgtcatagacagaggcatatattctagaagaatactttttattttatacagaactctttggcctaggggatttatacattatatactacattaaataatgaatatatgttggaattagtaagaaaattccagtgatgatattctgaaaatgaagaccttaaaatagcattctgagccgggtgtgttggctcatacctgtaatcccaacactttgagaggccgagatggggggaatcacatgagtccaggagtttgagaccagcctggccaacacagtgaaaccccatctctactaaagatagaaaaatttgccaggcgtagtggcacacgcctgtaatcgcagctacttgggag

SEQ ID NO: 123258 - DNA, 1069 bp, Homo sapiens
tgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgct

SEQ ID NO: 123259 - DNA, 1049 bp, Homo sapiens
ccattgtcctccaccatgcaatcctaggcaacacctaatctactttctctatatatatgaatttacctattttggaaattttgtataaatggaatttcaccatatctggccctttgtgtttaacttctttcacttaacatagtgttttcaaagttcatccatattgtaacacgtgtcagtacttcattcctttttatgggtgaataatagtctatgtataaatatagtgtattttgtttattaatttctgtctcaatttaggttgattctactagttggccattatagataatgctgctacaaacatttgtgtacaagtttttctgtggaaatatttccagttctcttggatttaaatacctaggagtgaaattatcgatactaatttttaaaattgagttgttttcttattatagagctctgaagaatataaagttttaaatgttgaatttacaggtgtgtgtatctcttaactcatataactccaagatagctctgtgttctaattttgatgtagatttaatgaagggtttatagaagctcatttgtccaatgcattctaaatattactaaataagaaaccaacttgtatatatatgaattgtttaaaatatataaaatcagctgcttcaattatttttattttgtcttaaatatttcttcagatattatttcttcctagaattcatttagccactgactgtaggagtatttgttgatactgtctttatgtaagtcaacacaaaaggtaattgtattgacttacataaaggcagtatcaacaaatattcgtatagtcgctgactgtatgaatatttaatccttaaaggagtggtaggattcagtgactgaatgaatagaattgccttttgtattgacctacaacatatgggggaataatttaacttacaattatgagctgtaaaatgtagttataattattttatgatatggatgtgattttaatatttttatggctctccccctttcactcttctcagaattcacatgatccctccactaaggattattcaagacacacatacaga

SEQ ID NO: 123260 - DNA, 1021 bp, Homo sapiens
aaatagaaatgtttaaaatctttcaaaataaaaatatctaagcacaggattacttatggcaaacagcatcaagaaagggtgctgataaaaatattaaaatacattataatgctttataaaatataatacattattactttagtgttgctaaaaatagtctcttttggctggtagaaagtaataaagaggacatttactaagagtccactaaaattcctttgtttaaagataaatatgtacatttatgtttagaatgtttcacattacggtaattcgcatgatttttcactcccttgctttgttattaaatgctcttaattttaaagtgttctctccattctatttttaaaaaagttccatggttttattttcagcaccttatagatagaagattgttagagatttagtaccttttactgagtttttctgaggcaagagaattttaatttttttatggtgttgtatattaatgattctccttttgtatgagtaaacagacatttaaaatagaaacttgtttggaaatggagagacgtttgttggagaaaatgactgtacagaagcatggcaaatcataacagaaaagttctggtggcatggtggtggcagtggtggtggtggtgctggtggtgcacagtctttgtgcactaaggaagatggaataaggagctccgtgtatctttgctgcatgcacaggatgtgtatgtagaactacttagctgacacattcgctgtttatacttgcttcatgtcttatgacaaccagatccaaggccatgggagtatttcaggaagataaagcagtttattctatgctcagtttaaggtgaatcttgggtgaattttgataaggataggtctaaagcacatggaagatgattaacttttgggagtatgctatgatacatgccattcttttaaggatggatgatgatttggatttatgtatctatgtttcattgccctgctgcaaggctgttaggatttattccccagcagaagccttttggcaagagaaaag

SEQ ID NO: 123261 - DNA, 1017 bp, Homo sapiens
tatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaatt

SEQ ID NO: 123262 - DNA, 1055 bp, Homo sapiens
gagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattct

SEQ ID NO: 123263 - DNA, 1080 bp, Homo sapiens
gtactatctagggcagcttatgttaaatgctatgtaaatcatatctataaaatatgcacagtaatgtacttttaatagaaattatttagaatacagtacaagtaaagtataatgggaaaaatgctgaatttggaatcacaagatctagatttgattccttacttgtttgatcttatgtaatacccaagtgacatatcagtcctcagttttgtcttctagacagtgggaataatttacattccacatattttagaaagctgttataggaccagtgtattaatgtttatgaatttgctatgcagagctggagtattatggaaatcgaaatattaaatttcctatgaataaaaacaacaaataacaatcaatgacaatatttacctacatttgagtttctcaccatgcactgctgaaatgcgttttgaaaacagtgactaactcaaacttctgtgtgtctcaactgaggcggaagaatgttgaatactaaccaccttaggtctttctgcaatgcagggtcagttcatttttcttctttcctggggcacacagccagcttccatattgaggtacattctctgccagtaaaatcatactatttccaaacaacttagattcaaactggggctacataaaagggtccatgtcttcagagcaggactaatagcccctgagtctgcagcatctagtcaaatgaagtattttgaagtctttattcaatccagaattagggcagccataattttaaaaatctatacattagtaatcttagatgctgggaaggcttgaagaaggaagatctttcttgaatttcaataataattaaacattctggtaaatctcaagtggctttgcataatatgttttttgagagtgtgattttgataggtagtgaataacctgaattaatgaccataatgactgagtgctgttttgcattaattcttgaaacaaaacctagattgcttcattacatggcctgtctttgtggaagatccttatacggtgtggtggtaaagaaaggggaacatttgctctattttgaagtaattgcttctaatggaagcctaatgacctattatg

SEQ ID NO: 123264 - DNA, 1341 bp, Homo sapiens
ctaaaagctgagcagtaagcttgataggaagctagagaaagattggagaaattatgtcatataaaccaaaatttcaggaagttgcatgtggttgagaatcagtacctcattagacaacttaataattcaatagtttacttatgccaaatgtcatccttactttaaaagctggagtgatttctagaaatgtgtccacatccttgcgggttagggtacggggcagcttctggccagctgtcgtccaggtgtcttatggtttttccgagtttcatatgcagatcaaacagggcagtgagagtagagttttcctgtgggtattgaaatggtaacatttaataacctatggtgactttggatattctcaagtttagcttcctgattttttcaagatcaggagacagaagcttaaaagagttaatcctataggattaattagtagtggcaatgaccaaactgcgatgatatggatatattccatttttgggtttcatgggactgtactaccaaagtgtattttatatgtttctaatttggactattgacatcaaatgaatcaaatagttggagtaaatgatttacttgaaggtggttccaaaaattaattaatgaaatgtatctctttagataaaacacatatggtaacatcttaacagctgttgagtctggttgtcagtatatgggtatttattttactcttttttcaattattctgtatgcttgaatatttttatgataaaatgtcttataggtaacaacaaccctattctaataaaagcttgtcagattacttgagcccttgcatactttactgttgagcatcataaaagaacttgaaatgcttttgtttttggattcttcatgtttcaacttcagatggtgacaagtgcaaaatggcttaaaagtgccttggctaggcacagtggctcacacctgtaatcccagcactttgggaggccaaggtggacagatcatgaggtcaggagattgagactatcctggctaacatggtgaaaccttgtctctactgaaagtgcaaaaaattagccggatgtggtggcacatgcctgtagtcccagctactggggaggctgaggcaggagaattgcttgaacctgggaggcgaaggttgcagtgaaccgagattgtaccactgcactccagcctgggcaacagagtgagactgtctcaaaaaaaaaaaaaaaaagtgccttaacttacctggcaataaacatttattgagtctgcagctttcattcatttagctcatttacatttaactgaaacacatttaaaaattcattttttccttttgcaaaagctaggcatgcctactataaaagt

SEQ ID NO: 123265 - DNA, 1031 bp, Homo sapiens
gagcctcatatgatttccatcaaataaaatgtttgaattataggggtgtgtttgaaatatgatgctttccagaatatgaattctacctctgcatcctgtctccatttttctgcttccttgtaattccagatccactgggctttaaaattagatactgttttacatttgattatgttactttcgaggtctatgagcccttttcacatctaggcagtagaaacagtaagtcatatctctgagctcgtaaggtaaaccatgcatggccatgtcttacccagcacattgcctacacatgtataaggtatgccatatatgctgtagttatactccgtgtggccttctgaaaagccatataggattatgagagaaaaagaagagtgtgaagtggggcaacttccactcaattatgaatgatgttgcctgaagaaatcaattagctgattttaaggctttaaagaattaaaaattgcatgttgttactatacttcataaaattctaggccgatctgcaagattatgaaactgactttagactaatataatttgtttaaactcaggagctttgtataaatgaattattattattcagctaatggtgtgttctttctatcatgaagaagttgtctttttctgtcatgtgtctccccagtacaatatgtggaatactttgtaattttttttcaactttgaatattaaagtttgatagcataaaaaggccaggcgtggtgactcatgcttgtaatcccagcactttgggaggctgaggaaggtggatcacctgaggtcaggagttcgagaccagcctggccaacatggtgaaacccgatctctactaaaaaatacaaaaattagccgggcatggtggcaggcatctgtaatcccagctactggggaggctgaggcaggagaatcacttgaacgcgggaggcagaggttgcagtgagccgagattgcaccgttgcactccagcctgggtgacaagagcgaaactcggtctcaaaataaataaataaatgaaaaataaacgaca

SEQ ID NO: 123266 - DNA, 1028 bp, Homo sapiens
agattcctgggaaggtttccagtgagtttttgaacctaaccgctaggttaaatacatccctttagtctcagctcatcttcctaattaagtacaaattcgaaaataattgtaaggttttctcagatatgtgatggattacatgtcagttgcatcacattcttcaagcaaagtaaatgaatgaatgaacaagggaatgaataaacaaaaggagctagatattccctgaacattgcaagcttcctttggcctgtggtgcttccattaccagcagcacttcagttagaatgatccctatgaattaacttgtaaatgaggaggtcaaatgtgcttttgcacagtggtgttaaatatgtggatgaataaattctttcttgtactttgggctatggagtctatgtagggttagaaatataggctttttctaagttgttctcctcttaggaaagttatttacatgataattaaagaagtttagaagcaattcctgaccttaaacaaagataacgtgtagctttcaatatatgaacctttaagaaaccctcaacatttcaaaggcacaaattagagcattagtctaaataacaaacccccctctttcccgatattcatttatagggtataaaatacttgacagaaaagttgagatacagaaaagatgctaaatttcatgaaacattgttatgaatcaattacagacattttagtttatttaaaacagtttgtttgtaactgttcagaaatacttacattgaaagaatgtccacaaagcactagatctgtagtttcagtggagagtcagtattatatattataatattataaaatgacacacttctcaatggcgcagcttcctagaagtcatttcctatattacttggccataatcactattaattcagtttcataaatgattggacatgatcttttaattctgagccttcataaatatgatttcctctgtctgtttagactgttttctttaggagtccacttgtctaacttcagttgccatctcaggcattacttct

SEQ ID NO: 123267 - DNA, 1031 bp, Homo sapiens
attattgattttcaagcagaacttgtgccataatactgttatactgtagttggttacattcagggtcaatagaaatgatttcttgagatatcagtggataattttcattgggattagtcaggaatgtgttctgtcttccatctgtctgcacattgtgagttcttaatgatttgatgcctcttttggctgaattatatccaccataccatcactctggtgagcaaaaagagaagcattctgtattatacaaatgatatgtttagaaacataactaagaatgtttttaatcacccactggcctacccatccaatccctgctatcaattaactattctgaaaccatcatcatgatttcacatgatatttcctctatttaaagtagtgtaactgtaagtcacctcaatttggtatccaggtttgcgtttggcaataaattcctcttggcagcttcagcaagttatatttcttaatactggatctgctgaggttatgtttatggagaccagaactatgagtattgatttatgtttgctttgaacatcttccagtctaaagtcattgtggctatgctttgttgatgaactgcaggagattgcccttgggattgcattgagtgaacttggcccctgtacttcttcagatcatttcaggagagttgaggtggacttctctttaggaaggtgttcttttttttcagctcttcgtaaatgtccatcagtcttgctctgcatagccaagctgttgaagcatgatcaccttgcattgaataagctgcacagagctactgttctaccggggagtatgcttgcaggggagcataatctcaaatttactgctacccactcggtaccatgcagagcttgcttgggagttcagggaggattgtttgaaatgggcagttcaactattcttccagataatcaaaaaagccatccctcgatttagcagaacattgagaaatcctttcctttgactgtattgtattgtttctctaaaagcttgctttgattaaattgcacctgggtgtttaa

SEQ ID NO: 123268 - DNA, 1025 bp, Homo sapiens
caatgccacactaaatttggaaatttattcagctgaaattttttcaagtttaaatattatatttactttttattgatgatactactaagtacagtgcttccttgagtgtattccttaataaatatttcttcaatttgtttgaatattttgccacaaaccagtctttagcttgacatttgaatttaatcttccatgtattaactaggcatgtacaaaacacatgcttatttattaggcatgcactaactgtactttggttacaggctaaaagactttagagttggttttcaaaatctatttgcttcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattc

SEQ ID NO: 123269 - DNA, 1646 bp, Homo sapiens
ctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgat

SEQ ID NO: 123270 - DNA, 1010 bp, Homo sapiens
tcctaagtaacctcctgtctggcattcactaatttcacctggccaactccagcaatgctgatcttaggatatcttattgtatagcttatattccaaatattggaggaaagagagggagtttggaaagaagttttagtttagagagctcttaaagtactcttggctcatcattctttaaattccaaaaatgactaatttgtggggatacataattaaggaagaaaaggttttgtgagggaaaggagtagcagggagtgctgagagcttggcgtatgtattggaaaattgtggtaacttaacaggtaatcaaggatgttgagagaggtgcttgtcatcatttcaaaagagcgtagaatattttatttcattttgtctactgtggatcggttctcctctcatttacttcttttcacatttcatatttgggagggctttgggctctatcttctatttccttctattaaaaaaagttttataagttattccacttggcattcggaacacaataatgtcatacttcactgaggcatactaatgctctggaaagaaagaaaaagaaggaaaattaatttagagggaatggaggctaaattttccatggtgaagaaattctgaccttttctgagttatcgtaaaagactgacattgctaccctttggatgttaagaaaaagtctttcagataccttggcttgtaagggacctgggaagcgccagggtccatcaaaaatgtaaagacatttattagaacatgcatatccgaaagctttctgaattctgtggggaccatctagcttttacatgatcttgagggaaccaaagttgtactgagaaaacccagtttcctcttaattccatcctatgtgaaaacaacttaagtctcaactgcactaagttatgaaaatggatcctctttttttaacatttggtttttggttattcatattgtctatattctgttctataattgtatccaagtgttaaaatatattttataaatatactgacact

SEQ ID NO: 123271 - DNA, 1108 bp, Homo sapiens
aagaccagcatgagcaacataacgagaccccgatctctaagaaattttttaaaaaaagttagtcaggaatggctcatgcctgtagtcctagctacctgggtggctgaggtgggaggattgcccaggacttcaaggctgcagtgaactatgatcttgccactgcactccagcctaagggacagaatgagactttgtttctaaaaaataaaataaaataataaaaataaaagaaaaggaaggcaatgatgttctgcatcagtgacaacagcatgggcattgccaagatctttgatgaccttactgcttacctctccccagattttacataattttatcttcctgtcccattgtacactgacaatactctccttcaagtgtcctcacctcttgatttgtcatatactcttaattttattgctacatttggccatttttttcactttttttctttgttcactttcctttgctccatacttaactaattttccagatttctgtccttaaatctctttcattttcactggatatactcttcccaggcttcccaggcttctgtaacaatctatttgctttgtctccatcccataactctccctgagctctaaattattatatgcaactgctcactggacatacaagttcgtgattcaacagaccctttaaaactcaaatctgtttcccttagtatattcccttgtttgttaatcttgctcagttacccaagccagaaatttaggtatcattcttgaatacattgtttctcttcctttccacacccgatcaatcaaatacacagtcttattgcttcttactttttttttttcttatcttattgcttttattttcagtatttttttgaatcatgaagctgtataaacagacaaggtgatctgtgttgtgttagggctgtctgtgccatgttgctgtgggagtttctatatggaagaggggcattaacaaagctttgaaatgccaaagcagactttccagggaagagcgtctgcagataattctgaagaatgtgttgatagtatcttggccacagggccatgaggcattatcaggggcaggagagagggaggctattcccaggaaaggctccagcatg

SEQ ID NO: 123272 - DNA, 1257 bp, Homo sapiens
ggcatcaaagagatcgaaacactttaaaactattttcttcatcagttgcctgctaacacctttttgaaaaataaaattaatcaacgcgtatttccttttgtgatttgtattgttttgtacattcactcccttttcttttcatgggttggctcccaactggaacatggaacctgtgatccattcaagattgagacaatgtaaaagatagagaactgacttttggggcaggcaggcctccaggaagtgggagtgagctttcacttcaaactgggtgaggggtggtggaaagggaggatgctgattaaaataataaacaactgctggaaagagaagttgattaccacactgctgtcagatcagccaggggagctgccagagcccactgaggctgctctcccctgccacaaagccggcagaagggactagatttgctgcgagagcttttctctggacagacagaacaccttttaaaacaagtttagttctgttgcattgacagcatcccttaggccaggctgacctagggaaatggactgaaactagcttggtggttaccatagcaacccaggctgctggtgtctgggagagtgagaaccggtggcctcttgtcctgtgttttggtgtttcttcagctaagagtacactcctccttcgaactctacataagtcatgctctttgaaaactggctctttacccaggattttttttttttcgttctgaaatcggtctgaatggaggaagttggtaatacttggctttttttttttcttctctcatgcaagtttccaggatatagcttctttttttgctgtatgtaattgagaccaaactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaa

SEQ ID NO: 123273 - DNA, 1004 bp, Homo sapiens
ttcattggtttattggcaggaaaactggaattacggaaaagtatcagtacctcacacgtctcaaatacaactaaccaccttcccccaacaaagcaataatgccatttctagggaaagaccaaggcctactgctataatgcagaagccacaggatcccttcagaagctgagtaacagccattctacacgcagaggtagagtccctttaccctcaattctcagtcctgtctcttcctcagtattagtaacctgtttctagagagaatactagccttaacgatttaccacttttcatatcagcagttgtcattgttcagtctgaagtttaggtgaccacagtagaaaggggattttgctgtattcctgaaggaatttcaggctttaagaaaacgagggtccactgttggactagtagactcaaatcctgatacgcttagtagttgaggccaacagctgagcagcaggccttccaatggtggctaatctggaaagttatagactggtcagatcattaaaattcccaggtgaaagcagaccttcagcataactttaagacagcagtttttttgtgaaggtaaattgaaagggatattttagttgatatttttgaattttggagacatccagtggttttgtgatttttactggatataagaatgtttggcatgttatactcatataagaatgtttggcatgtggttgagcaccttgtctcagcatgtgtgatgctgggattgtagtttcccagcacaggcaggatgggcaatttcttacattgggtactgatttctagtcttctagaaccagaaagggcaaggctaggagtctcttgcaggcaggaagtattatgttcctacaagatgacagctcattacagattaggaaggcccaattggagggaaccatgccaactcgagtggtacctaaagaggaagaacttcttaccaggggaggatgaccccataccaagatgtgcctgccagcaagcaggtcctaatcatctaa

SEQ ID NO: 123274 - DNA, 1071 bp, Homo sapiens
ttagctctttgtcagatggatagattgcagaaattttctcccattctgtaggttgcctgttcactctgatggtagtttcttttgctgcccagagtaattgatagattcagtgctattcccatcaagctaccattgactttcttcacagacctagagaaaatgactttaaatttcatatggaaccaaaaaagagcctgtatagccaagacaatcctaagcaaaaagaacaaagctggaggtactgaagatttaaagactataattttcagaataataagaattttggaagcacttgaatttcttataatttaaggtgaaatgaactattttgcttgagagcaactcatctgtgaatataaagatatactgattcctaacacttgcattatctatttgcttttttctgtttaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcaggtcagaatagtcaatatcaaaataaaaataatggggtggaaggggtagatacttgtgatttttgtatatcagaaagagaaagcgcagccttaccaccacttctatttcatcagaaatagtttaagattttaatgcaaagcctgtttccttgagttatatagttcaagctctatttgtgtccaatactttctgccacctgttctagactattcataaatgttcatatattttaaatctaacaatactagtaacaatactgttagcaacatctgctaattactgagtgtttaccttgactaagtacttgttaggatctttacaaatgttactttatttcgtaatcaaaaaatcctagtaaggtgggtggtaacattatttcttctatgaggaaacagaggtttaatgaatataaggaacttgccaagttttggggctaagaagtgccaagtcagagtttgaatctagatcttttttactcttggcagtg

SEQ ID NO: 123275 - DNA, 1050 bp, Homo sapiens
aattgatgattcatgtctgcatttggagagagtaaaattaaataaggatgaaccttaggaccagaattctgactaggaaaagaccttgaaaattacccagagagacagtatgattagtgttattgggatcaagaatattttaagatcatatttaatagagagtggacagctcctaattatatataaatttagtgaatactggctgaaaaatatgttattgagcaaaaatctaaaagcagaacattggcaggaagtcctggatcagcttttgttttgttttgttttttgccttgtaccaagtgtacatcctttaaaccaaatggtcttgaatttgactctgacttcactatttactctctgatcttgaacaaactactcagcctctttgagccttggattattttatttacaaaatcagaatagaaatatttaacactcatgattgctatgaagatttaatggaatggtttgatagttccctaatctatgtaaatcctgcctaagaaagcatctagttaagtatttttatacataaaggggctcactggatctgcctcagctggtttcaagatttaatggagaacagaattttcaatgattacttatcataaatgaattaaaatttttttttctaagatgtattgaaaggtttttattcttctggagctcagagagtggaatttgcagttcctcttacatgtgaggaagggagcaatgcagcatggacatggatgctctgtgtaaagttcccattgggaaatacaataggtcagcattggccaactactttttcttagtaagagaagaaaattagggagttctatgtagtgagggattatacttttttaagatttgaattttcaactgcctagatcccatcaggttgcaactttccattcctcataaatatgaacaaaaatatttaaaatattaatagtgaaaagcattcactgagcatccagcaagtcatctatgccagcaacctaagaattccagagctggccctagtgaagatggtatacatggtgctgggattttcagaggttagag

SEQ ID NO: 123276 - DNA, 1058 bp, Homo sapiens
tttctgattgcatttatttgagtcttctctcttttcttctttattagtcttgctagcagtctatctattttatttcattttttttcaaaaacccagctcctggataagttgatcttttgaatggtttttttgtgtctcagtctcctacagttctgctctgatatcaccatgcctattttaaaagattttgatcctttttagtccccaaattctctctctgcaggtggccttttttttttttttgagagtgaggctatctgattgatactctttatgctacttggagtatttaatatgcattggttctgtatttcacattatgcttttattgcgctaaagttgatattaaagttttatagcataaaatgtcatggcagggaacatttgctctaatttatcataattttttaaaaagaaaatgtctgctaagatcataataacagctaatatttatatgctagatctaccctaagtgttttacaggtattaacttctttgaccatggtgtggccattggaacaatgtaataatatgtggctcaataccataggttaatatcttaaacgttatttttcattctctttggatagccatgattaaactttttttttttttttgagacagagtctcactgtgttgccagggctggagtgcagtggcatgatctcagctcattgcaacctccgcctcctgggttcaagcgattctcctgcctcagcctcccaagtagctgggattacaggcacccgccattacgcccagctaattttttgtatttttagtagagacggggtttcaccgtgttggccaggctgctcttgaactcctgaccttgtgattcacccgcctcagcctcccaaagtgctgggattacaggcgtgagccactgcgctcagcctaaactttttatatgctaaaatccaacatgctacatctcctttagcatctaaaacaatacatacaatgataaatttcacttcaatctgtacaagagaagaatgctaatgatttgaaacgtcagctagaagacaggctgtcaggaacttttattatatttt

SEQ ID NO: 123277 - DNA, 1050 bp, Homo sapiens
tgtatagagataaaatgagaaaaaaatatatttggatgtgcgtatatactatacataaactatcaaaacttggtttataattgtacattctatcacggacatccttcttgaaagccttcgttttgtataggtctgtgttttaaattttgatagttattaccaataaatcctctgaatattatagcctattcaaaatagctgtttcttacaggaaatggatatatgtgtgtatacatatgtataaatatatatacttatgtaatatatgtattgtatatatgtatatcatacatatatatgtatatatagtatattataaatacatatatatatgtatttacaaggagtcagtctcttttgtggaagtaaacattacttggtcagataagattattatgctaaaggaaggtagataattttgtgaatgtaatttgcatttctaaatgtggttattattattattattatctctcaacagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggtaagtggataacctatagtgagtcgcttaattcaaattctagtgaggtagatatttgaaatacaattatagataagtatcagagttgaaccaattatcacaggattcccccccccaccaccgtctgcttttagttgccagtagacatttaaagtgcatacattgtttccatttgtattatcttcacatttaactaaatttttttcaaacactaccagtatctgaagtataatattgcttttagcttattatgaagtttatctaaatttctaataggttttagaatcataatatattgaggttttgggttttttttgttttttgtttgtttgtttgtttgttttaccaagtttcactcttgttgcccaggctggagtacaatggcatgatctcggctcactgcagcctctgcttc

SEQ ID NO: 123278 - DNA, 1025 bp, Homo sapiens
agatggagtctcgctctgttgcccaggctggagtgcagtggcatgatctcagctcactgcaaccttcacctcctgggtccaagagattctcctgcctcagcctcccaagtagctgggactacaggcgcatgccaccatgcccggctaatttttgtatttttactagagacgggatttcaccatgttggtcaggctggtctcgaactcctgacctcaggtgatctgtcttcctcggcctcccaaagtgctgggattacaggcatgagccaccttacccgacctgagaaaatttttaaactacaaattaatcttaaattcaaaaggcatcgagtcataaggaattacaaactatcttgtttgtgtttaataaaagtgaaaaataaggacttgtagtaaaaaaaaaaaaaagtaatgcagatgaagaccatactatttaaaatcattttatgtgttttacttttctgagccaagccttttctttgattacatttttatactgctcaaatttctgttcctatgcaaatgtatacttttactctgatcagccaaaagatatgctgaaatgttatcaactgacacattaatccttagatccttgtgtgattaaatttgtgccttgttcactttccattgatttctttaatatctctttatgcccattttcttgtatatacatatcatcttattttattgtatttttcactcctcccatgtaatgaaagttctcattctaaatctggtcattttaaggtgacactatgattctatttccattttaaaaatgacaaacacgaatgcacacatctcctaaaggaaaatgtcatttatgtaataagttgctttaatacaaaatgataagaccctgaaatttatttatttgctttttgaacccttgtgactagattatcaaaattaccatttgggtgtattttttttctttctactcgaagcaggaatatgatagagaaatagctccaagataagaaaaaggaaaacactgttgatgtatgatatgcaagataata

SEQ ID NO: 123279 - DNA, 1019 bp, Homo sapiens
cttagaatagggatataaagcaatgctttaaagcatctcctatgttcaaacacctagcggttatagatcaaatataaaaaacagaaaaccaaacatggcattgtgggctccaaaacatgacaatcattctacaggccagaaacaaagcagaaaagcaaactagctagtgatgttgatgctgctggaaaaatgtagcagaccctagtgatgagcaggcaggaagccccatagcaaagactcagctcaaaacccttctcttacacacagaaatgagtgattcacagattggcatcctttccttccgtagtgtaaatgccccaggcactgctattatgaaacttcagtgtattgttgatccttaattaaatgtgcgtactttcttgggtgttttaatcagtgtctcagaacattgatatattttcagcaacatcaataataaatactttgttcagtgcttcaacaatacataaacatttgagacctggggcctagcacatagtaaacactcagtaaaaggtggctgatatcttttcccataattgttgggagtcttttctgatagttttgatcatttttattttgtttaaaactatataggctacatgagcagttttaactaaataaaactgtattaatacctgttatttaccacctagtataacccaacagaactagctttcaattactatctagattaacccgtcaaattagacaagggtcaccttatagtctttgcaagtatcagtttggtaaacagcacactcattatttttttcgtgtaagtacatgtttaattccctcaaatgttaacataaattgctacttaaaaaatatgtagtgttttaaggactgttttaaaataaatggataggctaggcactgtggctcatacctgtaatcccagcactttgggaagccgaggcgggtggatcacttgaggccaggagttctagattaggctggccaacatggtgaaacctcatctctgctaaaaatataaaaattaggtgtggtggcgg

SEQ ID NO: 123280 - DNA, 1043 bp, Homo sapiens
aagagcaccctgagttcgaaggagtcggagaggtgggacaggaggaagggtgtcttcaataaagtgaattcaggctcttagacattctgttgagaatggaaactgtgatttttagtagctacattctgatatttacaatcaggtcttcattaatctgccatttcacggcttcatttagtttaagtaagtatgtggaaggtacacaatcggacaagccatgagagactacattaccttcaatgtgtttattctatctgttttcttgagttgctttccaccttattacctctaagctagttacaattttttttcaacacacagctcatgtgtgtttgagaaggttgacctccctccctcctctgtgtatttattcataatgaggctccttggtaccccgtgtgtacctctttcagagatttgtggcacttaaccacgttctgggctagtattgttctctcttcccctttatactataagtttctcaaagattgagtttatagctgatttttgccttctcttatgcctaacgtatttttatatattgtatatatttgtactttaaaatttttattttggtggaaatctttgttgaaaaatctattatatactttaatgccacctaaggatgggagaaaatttgaatgttttcttttggacacaagataatcattgtgctctccagttgttatttttgactcttgaggtatttgggattatatctccttctactaaacacctcagagcatgcgacttctaaaacatgatttcagtattccctttgttgctgttgttgttgttttgagacagtgtcttgctccgtcgcctaggctggaatgcagtggcaccatcatagctcactgtagcctcaaactcctggagccaagcagtcctgcctcagcctcctgagcagctgagactataggtgcatgccacaatgcctggctaatttttgttgttgttattgagacggggtctagctatgttgcccaggctggtgtcaaatttctggcctcaagcaatcctcctgccttggcctcccaaag

SEQ ID NO: 123281 - DNA, 1424 bp, Homo sapiens
ccatttggcaacagcgttaaaattgcacctgggaaaatcttcattactcttatcttgcagcagtcactgaaggagtttggttgtttttataggtgcaggggtgaaagtttagctccacttcaaggaacaaaggtgctaaagagaaactattctgagaatcatagatttgcatgaaaaacctcacaaaagaaaaatagtaattgcctcagcatgagagatggaacatattttaagataattggagactgttttatatgtgccctcattggtttatttttgatttcatgtatgtactttgtttctatcgcttcatttttttttcttaatgtattctaaataatgtaaaacccttctgaggatcttattgctacttgtgaaattacctttctctgtatcattggatgtaatttttttgtcagtcagtcttacaagaaaaaagtatcttagcaaaggctattatattttatcaatctgacatcagtgaaaatcctaaaagtacattttgtgtaaattcaaatacactgtaacaatttcccttaagtgaatattttaaagctgtttctttttttgtatacttaacgtttacagaaattatcttttttcctttgtatttttcttcattcatatctataaaatttacattttggcttctaacttagctgaaatgcttgctattagtcattttcttgctaagtgtggtcagaagtggtatagttgaagatgtcccataatttggtgaacacgtgaggttacaaactcaacttttgcttctcttttgaaaggccctgagacgggagttaaaggagaaagaatattctgtcctgaatgctgtcgaccaggcccgagttttcttggctgatcagccaattgaggcccctgaagagccaagaagaaacctacaatcaaaaacaggtgagactggtttctccactacatcataaaaacacatgctaggagaacaaaaaacccaaaatcaagtaggaaatttccttacagcattttaggatctaatatttaaatcttttcttctaagtgttactttattcaaatatgtcattaattcacagatatctagattcttaaattaagaaaataaaatttttgtatacctcaatatcaattttaaaggaaattaactgcagaaaaaatagattgtctaaaaagtgtactgtaactataaaagtaatttctataagaaataaaaatttatattatatttaaacaagttacatgataaataattgcaagtagtagaaagttattaaaatataataaatatacaaaatatttcaaggtctataagtaagattacttttgataatgacacaccaaagtcctttcttttacaagcagacaacatttctttaatttaaaaataataccctgtgtgtttatttactttggcttaaaatttaaataataac

SEQ ID NO: 123282 - DNA, 1048 bp, Homo sapiens
atattaacaggtgaatctgctctgagtagcctcttgttattgtcatccttataatttattaaatggacataattagaagcactaatcagccgtggcacttgatgatgtacttgtaatctggctcataatgagtggttgtcatcagttattgtacagagtaggaaatggtcagggccctctcaaacactgattgaacatttcagagttattaaatggatcttaatcactttatcagaaaattaggaaataatgtatttcccaatattttaatcagaaacatcttttggtcatgaggaaagagagagagaaataggaggggggtaaagagagagagatattgagagagagcaagtcaagtcttttcctttgagttcttattggctaatcaacctggtttgcttatgtgaaaatctctacagatatctaagcctcccagagctagttataaaatagtaaaaaggaatgaaagagtaaccttcctcaagaacctactgtgtgccacacatgtgccagtagctttctatgtattaactgaggttgaaagagataaggaatatatctaggattatgtaactagttagtattggaactggcatgcaatctcctaatcttttcttctaccaaattgtccaacagtaaaaatgccagttgtgaatttttttctttacttgattgttttaatatttccttttcgtcttttggtagaataaaacaataagattatagatacatgcaaaaaagcaaatagtataaataaggtatttggaattaccatacctgaaatgactttgtaaggttgatccttctatttcacaatagtttttttgtaagtgctttacacagatgtgagaaggaggaagaaaaatgaagtgaaaatatgtccacttaaaagtgtaaagttgaatgttctcaataaagaggagcactaaaaattcaattccgtccaactcaattaagtaattatatactgaggacataccaatctctagactggctactataaaatcaatatggaaggaaagaaaacattcttgacattgggctttaa

SEQ ID NO: 123283 - DNA, 1614 bp, Homo sapiens
ttagccctttgggagactgaggtgggaggatcacatgaggccagaagtttgagaccagcctgggtaacatagtgagacctcatccctaaaaaaaaaaaaaaaaaattagctggccactgtggcacataactgtgatcccagctactcagaaagctgaggtgggaggatcacttgagcccaggagtttgatgctgtgagccaggcttatgctactgcacttcagctggggcaacagagcaagaccctgactaaaaaaaaaatggtgtatacatatatatatatatatgtgtgtgtgtgtgtgtgtgtgtgtgtgtgtgtataaaatttttaaatatatagatatataaaaattatgtataatatatacataattttacttatgtataatatatacataattttacttatgtataatatatacataattttacttatgtatattatacataaatatatatattttcttctgagtagttgagtgtatatgtacgtaatataattctaccctcaaattttggccagttcaatgggaagacccgaagggaggagaatggagagtgacagggcatacacacacacacacacacacacacatacacacacacacacacacacactttagagaataggaaagtgacataggaaaaaaaagtcttctgatctcagaattgctagcaaatttatttggttttctcctgctgtttcctctgtctctagcattagcctctattactgcctttcccaatgcaaattagattaccctcttatcactgagcttcatttgctctctggcctccagtatttagtgactgtgctctgtgttgacacaagaacccagtggagtggaaatgtcccgtaagcttcagctacatggtccagagaaatcaatttatatgccaataggctagccacattccatcctgacaacctgttagaaccacctggggagctttggcatctatctatccatgccagaccttacgctgaccagggaaatcactaccttttgggggagggttcctggattatcagccttaaaaactcactcagtccctcactgtgagggtcgtttctaacatgacaccggggttcttcactggtgaagcagattctctgcttctacttgtaggtggtccttagcatttaccacaaatacctattcagaaaatctcaagtaacatttgtcctttgattttcaaatgagagtacttttttttttaagaatgcaataatttccctttttttcatttttttctgccttttagatgtttgaatttatttattatttattttaccccaaatagtcataccttcatatttcacatgtcgcttcttcttatgtatttcacagacttctagaaagtttttgttttgttttttactttgctctgtgcttggcttaaagtatgcattcagctgagattgttgctgcactgggaaactcttattttgactcaaaagtgattcgttgatatgtttcctttctggcagacagatggtgaattgaacacagagcttttcttttcttctgagtagcttcttgagtggggattatgtaataaatactgcacaaggactgctcaatcaataaatttttacattaaggaaagataa

SEQ ID NO: 123284 - DNA, 2044 bp, Homo sapiens
acttgtagttctgcggttgctaaatatcaatgtctagaatttttttgaaatttagagagacaaacatatgtgttctgtcacctttgacttggcttttatataatatttaaataaagcaggcagaccaatttacactgaggatgaaagttacagtttaggagagcttgcttctgtgcattttatggtgaagttcatcttatgatgatcattttccaagtgatttggaacattttgaggtgaagtggaaattgctaatgtgatgtgtactgaaagatgagatgttatcacaaagaagaatgtgttttctgtctcaaattaatgtacagtttatgtcaattgcactgcctctttatttgcagtggacagttggataccaccatcaaaccagctagataggaaaggaggtattttaaggtgtagaagatagtgaggccccaggagtgtggagccatgctggagacctttctaagctgtcttgagaatttctcctcagtgttgactgcattcctctgcccttgctttaccagctccccatctcttatatttctgacccttggctttgaacttgactttgatttctgtctgtatcctttgcttctcctctggactgttccagcccacatcctgtggcctgtccatgtgttatgcttgctatttttatctgaaactctaagtttatttcaggcattgtggaagcccccttgctctattacaaacttaggatggtccttgaaatcttgctatcttcctgctaaaatgtctgtgggctgcagatgatgccctttattaaaactaaactgctaaacagccttagagagatgatcactatctaaggtatgttatttgtcttcagtatttatttttaggaacacaatacattaatcttattttctgagagtttttgcttataatttatagtcattcttcattaattatacttaccatttctcttgagaatactgaaatgaaaaagtgtctttggattttgtgtaactgaatttatgataaagaaaaattggtttatttcttgtgttatcttcttacatttcagtggctttagaaatatattaaagttcaaaaaccgggtcaatttattaatctcagtaactgttttattatccttttgagtgtgtgattaaatgtagcagagaattcatggatgaagtatggagaaattctttcttaccctggacaatttttaccctggagtaattttttcttactttttctccgtatttctcagtaacgatggtaacactcacacttggctattaagaatatataatcagacatccaaattattctttttcttttttttaatcacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggtcagcatcattgtctttgaaggatttttaagaaatgttttcttgttaaatataacacaaataaagagagccacgtatataaattgttataagggattgttacaaagccaacgccgctgcaaccccacccatcaggagtcaggacaggtgctttccatatgaccctcattggggttcattggaaccccctgcccccaaataacaactaatgcaacttttatgataatttacatttatttttattttttatccaactgtgcatctctagacaatgtagattaggtttacctatttttaaaaaatatttttaatccccagatttcccctctcttcctttttccttttcagtttatttgttaaagacactgaattgtttgttttgtattgattcccagagcctggattttgcagaattgtgtccatatggtatagtctccaggttcctctct

SEQ ID NO: 123285 - DNA, 1017 bp, Homo sapiens
tttataccagtggtgtttacctttagttcttagattttagctaatgcagttggtttaatgactctagaccttatttaaatatgcaattttgatgtagcacataaaaacatttgagagatatattttatctataataggtttgctgaattaattcaaatatcaaagcactcaatggttcatattttcttaatgaaattgaagaagtaagaaattagtgtacaatattttacaatcttagtctttgcaaagagtgttaataacctaggattagtaaagcaaaatctgttaaatttatgtgtttttctagtggatggaacatagaaatatttgttctttattctttttttttcttctgctctgtttctctaattcattatcttcatgtgatgattcttatggtccatcttgatttacttcccattctatttctgttatcaccatttccgaagattagaagtcggggaatatgttatacttgaaagaagatatgtattctgtcatccttatctatgatcctggtaacctctagagctcagatgttagttgctggttggaaaagaagagaaaaatctatgctggtgggcaacactgttgaattgcaggagtaatattttctttactcataaagtgtggcatttgaaggcttttaggccttaatgaacaaagtgcatactaatgcaatttaaatagctagccaggaggaactagtgctgtccagggaatcagacatacacagtttcatttaaggacagctgcaaatgagattgtccctctaagtggaacagtaactagcattacatgaccaaggctagaaaaaggaaatggaaatgtcagtaggctgtgtgcagttgttattgatttgcatttagtttctcagtttagtaaccctttacattttcataatgcagagaactaactatagaatgtgtatttttaaaaggctaggcatgggggctcttgcctgtaatcccaacattttgtgaggctgaggtgagagggttgcttgaggtcagaagt

SEQ ID NO: 123286 - DNA, 1159 bp, Homo sapiens
gatccttgtaaggaggtactaacatcaaagaaaatattgcttaatggttattatttgtaataacgtaatgacaactgagaagtcttcaaggtggaacagaaatgaactcatctttagctatggtttctcattggaatgtctgataactaacatagtatcatatcatcattgctttgtcataggcaaagattatgaactttttcataataaagaaatcagttttatcttttaaggttttaaattaatttttctgcttaaaatgtgcttatttaaaacacaccttcaactttcaaagtaaaaaaaatcactccccataaatctttaagtgggaagattttgatttattaggctcgctgcgattatatttagtttttctgctattcgagtattgcgtatgtagccaaaccacctatgcagaattttatgtaatatttttcaactggaattgataaatttatggactattcttgagatcttcaataaacaatttgagcttctactttatcattcactagtgaagatactaaagaatgtcggatttatagtcaaccagattgagtttaaacattcattctgtcgcttaccagacctgtgaatttctgaaggttgatttctttgtcttaaaataccgtattacctatttcctctgattgttttgagaactcaatgacaaggcatatcgaattacacaaagcacctagcacagttcttgacacaaatgctttcaataaatattaattcctttcctttcatttcctttagcaaatatatgtaagaaagcaatttgtttcatttaattcaatttaagtaaactttaaaacttagggcaaagcttatttctcaattatgacagtttttttgcaactataaccatagaaacagctaaaaagtactatatcttctaactaaattgattacatttatatttcctcttaatgtttttgtcactcttgataaactgccttacctcagttaaaggttgggcttttcttttacaatttcaagaatcttaatcagtcattttctgccccttcctgccctacacctctctacctctcaccctcctcactgcccccacccctacctcaactccatacagtttttctgtttcacaaaccttagaccttaggtagttaatctttggtatacgccttcctgg

SEQ ID NO: 123287 - DNA, 1036 bp, Homo sapiens
ctgagctcgaccgtttatttactggctgtcactctttgggcaagttattttatctctacacatttagttcctcatctatcaaatggaactttaacgtgtatcttgctggcttccttaccgaaaacatatatttgaaaatgcttggcaaagtttagaatgctgaatagttgtaagatattaatgtgacatgaaattgagaaaaaaagtattggtgacaactggctacgtgaggatctgatgatatttgcaaagtatgaaaattccaagtattatttgaatttttatatttgttcatttagcaaaattcttttatggcactaaattcacatgtactattcttcttaaataagtcttaaaataattggttaatgtaggaataatatattttttataagtaagaagtaactagaattgtaaaaaaaaaaaaaaaaaaagtacctcaatttaaaaaccccataaaatctcagtcatagtaaggtctagtgcaaaagtaggagactgggctctctgtatgtttcagatgaaagtaagaaattgggatttttctgcctagacgattgccttggttcttcacaactttttgcctatttttaaattccttctttttaaatgttatagaattgaatttacttaaatgccatctgtactcaatagctactcctgtgactacgatgcaaagtaaacaatgttattagtcatctggaaaattcggtcttgaaaaatctaatttttaatctggatataccaggtaaaattaattttggttttagctttatcaaaaatatatatggagtacagtttccagatggcactaaggtttaaactgtagtatttataagcaacaccatttgaaagtttaaaagtatttttatcaacaggttagattagttggcattagaccttgaacctgtattgtttcttgttttacttcaaatgaatccttaaagccattttttgtttggcccagtggatctcataattataggaatccagctcagaaaccagagcagttcattgaatttgctataaaatgttc

SEQ ID NO: 123288 - DNA, 1459 bp, Homo sapiens
tggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgat

SEQ ID NO: 123289 - DNA, 1101 bp, Homo sapiens
ccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgt

SEQ ID NO: 123290 - DNA, 1006 bp, Homo sapiens
gctttgaaaattatgctttgaaaaatgatatgttaaggttgaaaaatctgctccttgaaagtcaatagaagttagcaataaattttaagctggctgcacgaagaattgaggaaagagaggtataatgtcattgagaaaaaatagcaatgcaaagcttgaaaataggaaaagcttaagctatgtatggaagagaagtctacagggctgaaagacacctccagatgaggcaatgcaaggaagaatgagatgaccttgacttttgcataatccacagagcctcaaagataattagcaggtggtagtagttgcagcaagtgttgcagaattacccggacaaagaaaagaaagccaccacgctctggctactgatcagtatgttgagcgaaaagagaataggaagtaaattacgaacacacaaaagggatgtttggtctgcgcaggagtccatggtgacagcagttttgaaagaggctcagctgcacatccaggatccagttgatgggtctggaagttcttctcaggcctgatgagctataaaatgaggacaaatgactcagccacaaaatttccattgacagaagactgctttttgtcattatgaacatggtcccagttttcgacaacacttatgggtggataagcatattaacacatttggtgttttcttctcttggttctttggattcctgaagaaaaaaaccccctcctcagctcttcccctcaaacctgagaggaacagaagggacgcttctccaacttctaaactaaacgagattggtaatgacaattaaacaactaaatgacagttagaaaagggctagattgtattggatttcaagtatatgaggtgcttttttcagagccaactgaccttcacttttcctacagccttctcccactgccctccagccaaggcctctgggccactcctggagctcatcagtttattattaatctgcttcttcctctcccttcctttcagtttactagaaataccctgaccctt

SEQ ID NO: 123291 - DNA, 1038 bp, Homo sapiens
gtcatggctgtctctcattatgtgcaaatctccacccagcataaggcagagggcagtgtcattgttcattcatttgttgggctccaagattgtgcaggagataaaacactataaagagacttgattctcacactgaaggaactcatatttcgagaacgttgcacatggacccaatgccctgcttacaaaagattcctgctgccctcagaatggaatggtctttgcctggctcacctctctgtccacctccttccctctgctccaccggggcatcaccatttcatcatccacttagtgatagaaatggcaaactctgtattccattcctcctgcctaaaaagcacttgtcttagctctttgtataggttgatgcaaaaataattgcagtttttgccgttaaaagtaagttagggtatttcattaaaagtaatggcaaaaacctcaattacttttgcaccaacttaatccttctgttcttcccttggctgggacactcattcctgtaggtctcaatgttgtcgatcacctctcttttaatgaggttttctatggctcctcatagaactgttcttttccttacatgacacttctggtgcttggtttaggcactaaggcagagtgtcaatggtaatttttaatattctgtttattagttattgtttgcttctccatcatgggatggatgagtctgtgttcgtctctacttaggacctcatacaatttctggcacagagcaggggttgcttaggacacactgagtgaatgatttgagtttgaaggttatatagcagtactccagaagatgtgtccaaggagatttatagcagtacttttcatagtaaaactcattcagttttggcatatttataaatataatacagcaacaaaaatcaatgagctagtaatcagcatcaacatgatttaatcttagaactataaaattaaatgaaaaaattaaatggcagaaaaaaaatgtgtaccactctgttccatttatatgtagttcaaacccatgcaaaactaatgctatatacactt

SEQ ID NO: 123292 - DNA, 1180 bp, Homo sapiens
cagtaaattttgtatgtaatgatgtacatgataaaagactgtttaagaacaattagtttggctgtgatacaaagaatgaagagagcagtgcacaggctgcttgcaggagttaagatgaggagagcagtgtaatatttgagatgcgctgccatttggagtagattgagagatttatgccttgctacatttaaaagcaaaaagagcctggcaaagggaaagccagaaaaagaaagtaggaataattaatattccaaagagcaaaaaatgagataagattgggaagcaacagagttcagattcaaaagtatgaaagtgtggtaaaatgtaagaatagaaatgtgtttgtttctttaaaagctgaaatttagctaaaaaggatagattcttaaattgaagaatcaagctaaatacttgagactagaaatgcctttgttgtgatgttgttatgtaatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaaaatacgatcactgaatgaaatatgttaatagaaaatgtctgatttttaagtgaattttttaataagtgctttcaaattactttcccagtggaaatatttatgtttgttgttgaaactgaatgattttacaaatcattgagcttcttaacaaacaatagaacagaaaagaatgtacatctttcattttaaaatgttgcttcaatttacaaagactgtcaaatttatagtattctttgccaaaatgctaggggaaacaatatagctaagtcctactttcttcttgtttcataatgtctcacagtatttcttttttcaaaataaaaaatcttctgtttattgttatgaattacagtaatttattagctcataataatctgctctacaatctttgtaatccaactgaagagtgatttgaatggccatgaacgaggtagtcttttaatatttgcttta

SEQ ID NO: 123293 - DNA, 1125 bp, Homo sapiens
agccactgtgtgcttgagggctcttaagaaacctgctgaagcatgagtctcagttaccataatgaatacgggatttgcgatatctctgtctgatattttttaatacatttcattttaatgcacattttaagttctcctagggtaaaatattaccattagccttaatccaccattaagttgctcttcaataatttgaatcctcagaagatgctttttcatagtaaattcaccaaaatagttggtcaaaggtgttttaactacaaaacctgtaacttaacttttacatcccaggaaaattgctaaattcatagaatacttaggaactccattcagtcctatagaatatggtagaggtatacatcttgaactacattttaaggaagaactggagaagaggttcagttgccttatattgtccatggctctgacacactgttttggttttctggggctgccataacaaagaatgatagactgaatggcttcaacaagagaaatttatttcctaacagttctagacactgagagtgtgagatgaaggtgtcggctgggttgagtctttatggaagccactctttctggtctgcagatgatcgtcttctccctgtgtcttcacatggtttttccttgtctgatgtgtgctcatctcctcttcctctaaggacaccagtcatatcagattatgacccactctaatgacctcattttaacttaattacatctttaaagaccctatctccaaatacagtcccattctgaggtactaggagttaggaccttaacctgtaaattttaggggacacagttcagtgcataatgcacacatatgctcttttcactggacagcccaaagggaatagtgccacttggttgggaggaagcagtgtgtgaaatgccgtgattcatattctagggagttaaatgttggcacagttccacttgcctccatcaaatgggaatatgtgggaaatgctacaatttgccactgtttctcatttagaaagacagtatcttgaaatttctcatttttcattttaaaggaaaaaaatctttcaggactaacctcccttctatgaaaaagaaagatggcaaagaccatgctggatcagaatggtgcccatgcag

SEQ ID NO: 123294 - DNA, 1281 bp, Homo sapiens
gatatatcactagacttttcttcctgtatgaagtcatatatatatatagtgtgcgtagctctagctgttttgaatcttgcatctacaattattaacgtataggtttaattcatagtatttttttttttttttttgagatggagtctcgctctgtcacccaggctggagtgcaatggcacgatctcggctcactgcaatctccgcctcgcaagttcaagtgattctcctgcctcagcctcccgagtagctaggattataggcatgcgccacccgcctggctaattttgtatttttagtagagatgtggtttctccatgttcgtcaggctggtctcgaactcctgacctcaggtgatccgcctgccttggcctcccaaagtgctgggattacaggcatgagccactgtgcccagccaattcataatatttttaaaggtgaaatcttttcagctttataatcatcattttcattttgctttagttcgttcttcttagtttatgtgttgtgtgcaaagtggcttcaagctgtgtgttcttctagccttggccaaacaccctgttaatatatgtcatgaaattacagtattggtttaatattaattgttaaaagttaatagaaaagttgcatctttaagatacaattatttttgatggtttacccccaagaaaatagatattcagaaacaatgaacatgctgtatatggttttaaatgcatctaacacattaacattcttataattttaggggtcgaactggaaaaattagagtgcagagtctgaagattggattaatgtctctctccaaaggtctcttggaagaaaaatacagatgtatgtaagacctttcttataccaacagtgtttttagtaataataatgattataacaatttattggaaacttaaattatataatttgttagtagtaatagttctctctctttttttaacccttactgtgcctataccaagttagacagagggtggcagtgcaaagacttggggctttgtgtgaaatggaaagctgattataactaagaggtgaggtgccaggatggagtgagacccaactacaaattatacttcatttaattcttagaataatccctccataatgtaggcatttgagattttcattttctagctgagaaaattaatgctgagataggttaagaatctagtctaagactgcagagctgataagggatggggctagaattagatactaggtttttctgactccaaagcctaaacttttttttatttctttatacttccaatg

SEQ ID NO: 123295 - DNA, 1038 bp, Homo sapiens
caagatttttaaaatatatatacattaaagatgttattaaagtatcagttttttttctttgagactatgcatacaaaagaaagatgtacgaagttttatactgatctaagttactaatttgaaactgagaaagcactttcatttctttttaatgtttactgcatataaagacattttagaaatgttactactgatgttatacatatgcataaagtacaagtctacagatattttggcaaagcatatccagtgatttatcattgctagggaaaaaaaaggctcacaccgtgtctttgaggagaattgatgtcatgggttattacattttataatggccctttttcttattttagaaatacaaaaaatatcaaatgcaaattctaaatatgatttatagtcatacatgtaggttcacagaatgacctcaacagcaacaggaggataaaattggtagatatttagctttgcacataggaaaattacttagtattgggaattgaagagggattggggagttttatgtaatttatcctgataaattctgcaaagtacatccatagcaatatgctttctgtgtgatgatataatgggactagagcaggacacacaaaaatgacagcttttatttagcatttataatggccttcaagtttgtaaaattatcggtgagtctttcacaagtttttactgtcttagatgaaatttttttttttttttttgagatatattcttgctctgttgcccaggctggagtgcagtggcgtgatctcggctcactgcaacctccgcctcccaggttcaagcgattctcctgcctcagcctcccgagtagctgggactacaggtgcacgccacaaggcccagctaattttgtgtgtgtgtgttttagtagagacggggtttcaccgtgttgcctaggctggtctcaaactcctgagctcaggcaatccgcttgcctcggcctcccaaagtgctaggattacaggcttgagccaccacacccggccaaatgagttttacagaattatttatgtaaaa

SEQ ID NO: 123296 - DNA, 1023 bp, Homo sapiens
agagaatggctatctgccaagggagtattcagcagaaaacaaaatttcatttagaaagaagatgtcagtcatacctgtcaagccatgctgataagccaagagatgtcgttagtgtatgtgattgtttcaaaccaatagcctccttggcaaaagtaagctggctgtagtatatgcagaatgatttccttaagattgatttgcaagtgatttttcaggtcattttagaagctactcagtacttagtagtttacagccacacaacttttaaattttgcttccattttcattctgttggttctatcatttaattttttttctgtagatgtgggtataatttatgttcttagttctaccagcaattctgacagaacagatttcggagaagatgttttccactcagacccatagaaacttatcgtctaaggttttgcttttgtaaataagattctgcaagtacaagtcaatgtgcagtgtcattcttacgccagagattttaaaacaccatttccattcaaggatgcattgtgatcaaggctttatttagtttttcctttgttacacagtatttcttgatttcttttttttctagtgactaatttaaaccaaatataaaagtgctcattgttgaaaactgtatctttgtgagggaattttaaaattcatttcttattggtggtataattgatattttaaaatttgatgtttcaacttaatagatataattcttttcttgcctatcattttccattcgtattcaaacattaaaagaaatcttctgacatgcatatttgtctccctctcatgtataaacagatagaagcatgtttcagagacttgaactccaaaattttatattttattttttggtaattcggatgaatgaaatttcttaccacaaatttagactaaatgatagtaatgcaagccaataaattttcttttgttttctctaggtatagaagccttaagcattttaactatgatgtctgccagagttgtttcttttcgggtcgaacagcaaaa

SEQ ID NO: 123297 - DNA, 1045 bp, Homo sapiens
ttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttg

SEQ ID NO: 123298 - DNA, 1581 bp, Homo sapiens
taccagtttatctcttttatttgtggaatggctaagaaatagaagaaagaacacagccaaagcataggagatacctttttccctctataggtaatgtcgtgtgtgtgtaaacagaaagaaatacaatgcaaatgcatatttagataggtccatgtataacacatacacatacaaaaggtaagaaaaaatttcaactgtgtgattactgtgcttgatatcaaactgtgtacacttaagatatattctttccacttgatatcaaactgtgtacaattaagatctgtgtctttctaaacattcttttgcatagtacaatttagaaaaagttttaataaagcaatttcaattgaaagagagctgttcgaatacattcaggaacagtagacttttggtcctctttttgatttgtgggtatgcttttgtcctttccttcaaaaggttgtgtgataatagattcttatttgtcttagtatctaatatatgtttaactgtgctgatgccttaggataaagacaaaattgtactttttttgtatcccatccagttaacctttggaatggataattctgaggcacagaattattacttggtgctttaatttacgggataatttgataggtttgaactaagcgatgtgccttttaatcttttgctaaaccattggcattttgcatcacaaatatctacacgctttacaggaatcatgcagatagatgcatattttatactcctttaaaacatttttaatttgcctttcaatgtcaaaataatcattggtgtcagtcatcctattctgagtgactctattaggtaaaaattaacagaaaagcatgccaaataattttgtgctgtgattttggggtgtaattctgaaaatgcctcgcctcaattcattcaattgaaaatgaatttatgagcattttttgtgagaggaaaacaagagaaaaaaaggaagaagtgtaagcttgcatcagatgcaccaagatcctttttggacagatttatgaactactagatatagtgggcaggttttctttttttaatcctagaccaagctctcgggatttgatatagttcacttttcggctgagccctttctagtacagggccgcttaatcttctggtgtaacaatttatgtgagtgggtaataaaaaagtttgattttgtttattctcctatttgtgggaggagaacattggagaaaaaccagcgaagtggcaaatgtgttgaagttatttatgaagctaattagaattttcttttgcttctttctttttcatccttgcaaaatgtagcattttgtcctctgcccagtagttacacatgcatgcatggaggaggggatttatggggaaaatgagttattactaaaagggagtaaacaaatccatgctaaggtttattcgattaattttataactatgcaaaattttccagaaaataaatcaataaatgagtagagtttgattaaagaatactccattgaaaataaatctgaggaacaagctaaaatagtagcaaaagtaattcaagggttgtgagaattattattggctaaagagataggttggtttccctaa

SEQ ID NO: 123299 - DNA, 1016 bp, Homo sapiens
tatattcattccatttgtcttatatttcttattaatttaacaaaggtaatttgacagaatatgtgccctttctgtgaaatcctctttcttccactagctaacattttttccataatatctgcatttagcacctctgacccacacatacttagatatatactcctacccttcattgaaaactgttaactcctctgccaatattttattttattagcaactaagaaaagcctcattgactttagaatactaaaaagatattatatactaaaaagctttctagccaattagtttatttctgatttccccatatgtgtatattccacttggttgtggaactttctcagcaaatattttatcactgattatcccactattgtgtgtactcttacttttggaactttttattcttttttttgtgccctggaattcacatttttaatcctgaataatatctaaaagactaatactgtcaagcttatgtgactaacaaagctctattgtggtttggatctgatgggaatctgtaaagtagacagaaaagttgtcaaacatagtagttgggtgttttcactaaaaaaaaaaaaaaactatggagagtgctaggttaaaatacttaaagtgctcaaatatagaatattctctttccatattttctaaaacttgttttatttattatggttataaataaaagttatcaggaggtttttcaatttcaaatttcaaagattgcatcttaatacttgacagtaatgtagtagagatttatacattatcattcatgtactatgagtgtgaaacaattcccaaatcaaaataaaggtgtattcataatgtttgtttcatatttaacctactggtgtgcatttcatgtaaagtagttaagtatcttgaatctttcctaaatcaacaaatttcctcaaggctgaccatagccaaagcgttaaaggaaataaaagataataattcagaacaaaatcttacttctttaaaatgttttgtcatgccctgtgaacaca

SEQ ID NO: 123300 - DNA, 1004 bp, Homo sapiens
cacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagca

SEQ ID NO: 123301 - DNA, 1025 bp, Homo sapiens
cctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggcc

SEQ ID NO: 123302 - DNA, 1706 bp, Homo sapiens
tttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaagatgactttgatattcttcagctggattcactgatagaatgtgagttttgaatgcacatttatgaaaacaagatatagagatagcctgtgtcctgatacatctacattttttcctgcagtttctctcatacacactaatacagtctcctgttgctctcattctctctctctccccatctcttacacatacatataattatatgattctcaatttattt

SEQ ID NO: 123303 - DNA, 1006 bp, Homo sapiens
tatgtgggaattataggagctacagttcaagatgagattttggtggggacacagccaaactatatcaattcatatatgaaatgctacttgacaataaaaaatgaatgaagtactgatacatgtctcaacttggataaaccttaaaaacatcgggctatgtgaaagaagccagacacaaaaaaggccatatattgtgttattccacttatgtaaaatgtccagaataggcaaatctgtagagaaaattgattagtaattgataagggctgaagtataagggtatgtggagtgattgcttatgggtatggggtttcttcttggggtggtaaaatactgtgtgagtgtataaaaactggtgaattgtatacgttttaaaagatgaatgttatagtataacttaacaatttaaaatatccagtatgtaaagtttacagattttaatgtcattaacctaaacagggttttggaattttcacctgtgctttgttttgcctgctcttaatttgatcaatactgtgtgttatgaacagaagtgcttagagcattaatctcatttgtgtacttcagagaagatccaccactgataatttattcatttatatttgctttcttctgaattaaacatttattcatctttaaaatttaaaaatgaaacaaaattgattacaacattacaactcataagcactctcagtcattcacaatcctgcaacagtaaaaggagcagcagtgatagtccaccattaatgagtgtggcacagaaaatagacttctggttatttattaatctattcttgttgactttagcatccattcctttatctcccactccactaaacatttctggaaagccaaatgagtggaaatgatgtttgtaaagggatgaacttgaaatagtggattgatgtcaaactttgaatctttgacactattagcaaattaattataagaaacactggagctgagatcttgaagacagtgcagcctcaggttactgaaatattta

SEQ ID NO: 123304 - DNA, 1146 bp, Homo sapiens
taaattgctttgcagataacagtgcctctcatatagttgggggtatatatgtgaattaaagggtttgtatgcttcaagttgaacaacagtaagtataattaaatgaacttaacagaatgaggttgataaggtaataaacatagacaagtagcagtacagtagctttactgacacattgcaagagtccaaaatcaaagaaaatgagaaggtaatagttgtgataattcacacactaacacatttgttatgattttttaccgtattcatttcttcttaatattttgatacttctacaacagttaggacttctcaccaaataggttatttgacctgaatttccttaatcatccaccttctcttattccatcactttgcactctacatttctgctgcattgtattactcactatttcccaaacacttcatatccttcaatgtctgtgagcctttacatatgctatttcttttgcctagaatgttctcccctaacttctttgttcattggtgaagatccaattctgatctcatctgctttttacctagaccatctccaacagataatcatcttttatctatattcccagtttggatttcatttattttaaagtcatatcattttacagtataatcacactgcactgccattatctatttgctggtatctatatactataattatgaggtcatctaggtagaaaccatatcttatgtggctttgcatctctattcctagctgagggccttacaaacagaaggtgatatggtttggctgtgttcccaccaaatctcatcttgaattttaattctacagttcctacgtgtgagagggacctgctgggaagtaattgaatcatgggggcaggtctttcccatgctattctcatgatagtgaataagtctcatgagatctgatggttttaaaaacgggtttccctgcatgggatcctctctttgcctgctgccatccatgtgagatgtgacttgcttctccttgctttccaccatgattgtgaggcttccccagcaacatggaactgtaactccatcaaacctatttttcttcccagtctcatatatctttatcagtagcaagaaaatggactaatacagtaaattggtaccagtagagtgagatgctgctgaaaa

SEQ ID NO: 123305 - DNA, 1944 bp, Homo sapiens
taatataaatttttagaaattttgtttctcagatgtgaggcaaataggttgatctatttgtttattctttgacagagagactgactagagttagacagctttttaataccccttccagtcaaaaagtaacattgttatattagtatttagtagttttaaagtctgatgacataagaacagtaacaatttgttaatattcaaaagattgaaattgaaaaaaaggggtcctgcattctgctgtcctagaatttttttttgtgttgaaatcttcttttccatattgtcattattgcttctttatcccatgacattaattttctggtgaggtgaccctgaatttagtcattttcgtcagtaattttagatttaagtaacttatcatgcttgttttaaagtctctctcagctcacccgtgaagaaacaaattttttttcatttttttcttcaaaaatcagcaagtattgctgaatctaacaagtatcagcattcaggtttaaccgtgttatttgattgaaataaatcaaaccatggaaataatgggcactgtgtctgctcaagagtaaaattacccaatgaatgattatgtcaactggatgtcttttatatcaattgatgactttttaaaaaatctgtattttaaataaaatatggagagaacagtattggtccctacaacattccaatagctttgtcatgacagccatgtcatatgaaataacttactctgaatggctaataattcagtggagatgaattctaaagatttttatttgcacttaaaatgttaaagtagtattgttcatttgatcaatgtttgaatactactcagtattgaaaactttaactgcattctgaaaggtcattgcgccgattggcttacctaagatgtcatttagcttccttttctcatgatttacataaatgttgttaccttaaatgcagaaagatgtgatattctttggaggataaaaaacctaagtgaatgaagctagacacaaaaggctacatattatatgatttcatttatatgaaatatgcagaataggtaaattcatagagataaatcagattcatggttgctgggggaatgggagtgactgcttcatgggtatggggttttcttttggattgatgaaaatattgtagaacaagatagtggggatagttgcacattgtgaatgtgccaaaatgccagtgaattgtatactttaaaatggtgtatttgatgtgtattttattacaattaaaaagaaaagaatttgatatttgcaatcattaccaaagccaaaaactagtgttctcaacgtttgtgaaatgcccaaaccgtggtttagaattaatttatagcattagtaacatgacaaatctattcagcttaaagttctagtaaaatttgtgaatcccatcatagaagtactcctgacagcagcagaaataaagctgtaattcatcaaaatttccttatatttaaaacttctgtgactgagtgattgacttctgtgtcaatgtttattttttatcttttgaaatttattatgattccttgtggcacatcccaatcacgctttttaaagatgtgtttttaaaaccatgctttgaaaaaaatttgtataattttcaaggtttttttttatagttttatactttgtttcttttaaagaacaaatgcaacttgttgtattagagtaagactaaataaattgtactgatgtgtacatttttatgcttttgtattgtcttgtggggaaaaaactatctgaatcttaagatcggtaggaactctaatgatcatttagcttctcattttatatttggagaaattgaagctgacgttatcaatgtgtcattcattcaacaagcatttactgaatactcatgccaggtaatgtgtaggcttgattctggaaggttatttcatgcttgaaagtttcacaggtaatttct

SEQ ID NO: 123306 - DNA, 1524 bp, Homo sapiens
gatttgactagttttaggtgtttggaagcaaaacagatttcttcatgttttgcatcccaacctgaaaagacatggggtttattaattttaaaatttcctaaggaaaagttattcaaatattttaaaatgtgtttgtttcatgcatgacatgccacattggtgatgtgattggagcttgcagagttggttgtttagaagtgcagtagagagaaagcaattggccctcattctctggacagacttttgatggaaagaatttctctgataggtgtttgactggttatctaaacgttgctgttaagtagtcttacttaagatgctcataaggtctaggaagcagagaatattagttatacctttatcaactcatcagtgacttgtttgatggtgtttaagataatttaataatggggtttgacaggatttgtctgatttccaaaaaagcaaagttcgaattcagaaaagatcaactctaatgaagtcctttctaaataagggaaaaggaaagatggtttgcttttgaagtcatcttttacataattatttccctttatttaaaagattaaagtgagatcaagagataaaacctttcaaatttgaattttatggatgagaaaataggtactcaaaatttaggcagtgattagtgtactgggatatttgagagagaattatgtccttacatagatcactttttcactttacgaatgcaggaagaaaagagatgtttagatgtaaggaaatttggaaaatgttgcctaggatatttgattcctactgctttggaaagcattttggagcaataccaaaaggaaactaactaaccaagtgtgatatgttgctctgaaaatctttgcgaaatgagggcctcttgctgaattttacaagtaggttattgcatctatgattaaacttttttaaataaattgcttatacatgtttatttgacatatataatcttcataattggccagtacaccttgagatgtattaatggcgatacatcttgaggtgctttgttaccttagcacatttcaaaactggcattttgtattcagattgttttatatttcaatgtattatgtggagagtgacttttcattaataaactacaaagaaatgggttataaggaatattcatgaacatgctctatagaaatataataaaaattcattgatgcaaagtccttttttaaaaataattttcaatctttttgataagctggacggaagcatctgtcttttactatgaagaaaacatttttgaagtgaactgacaacataaggcaaatactgggtaaaaatttaagcatctccaaaatcattttattaacccatttgcatgcaaatactagggaatggttcttcaatatgtagctagttcttgtggtggttaatagttcttcgtgtatttgaaagtaacaaaactgcatttgtgttgaactcttaagaccaattaatcaggtcaaattgctcttaagaccaataaattaggtcagttgctcctaacaaaggcaaattcat

SEQ ID NO: 123307 - DNA, 2822 bp, Homo sapiens
taagaaagttgacgaatttgtgttggactgcattcagagccgtcctgggccacatgctgcctacgggccccaggttagacaagcttgttctaaagcatctgcagttcaacgtgtgtaaattgttccctaattagacatttgcctgttgataaacttagcaggcatggctaggcctgtcctaccccattcatgcttgttatctaggtctgtcctgctctgcattcatgcttgttacttatgttcaggtagctttatgtttcatttgtaaagatgaggggcttggggcacagtcttttgctggactaataatttgacagtgcttcagggcttagagcagttgggtggacaaaaagggaagtagctaatatttttacctacagacatgaatagggatggcaggtaagtattttgcctagaaacatgttttacaatgatatggactaaaataggatccactttacaaatattatttttatataaaatttcagagccattttgaacaaattgaagtacttgaatatcactaagtacctttagtacttgtgaacagcggaaaaagaaacttaccttggcacacaatattctagggtattttttagtactgatattataaataggaatgggagagaaaaacttggagaaaaaaaataacacttgcattgtcagtatctccagagtgtaattagttctagatagccaattggagagtatgaaagaatagtgtgtagtatataatattttaggaaatggctctgaatttgtgcagttttgattttttaaaaatcatttagtaagccagattgggtgtgatttttaatactgagttttgtcttttattgtttttagatttattgaagtcataatgtcatagaagtgatttaccttgtaaatatttgacatacatttatgtccaaaaggatttaccaatttttaattttatagctatttgaaactttatattggatgcttctataatagcagaaatgtatgcagtaggagcaaaaagtgtgttttgattctctacacattgacttgtttaaatctaaagtagaattttcttgtaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgt

SEQ ID NO: 123308 - DNA, 2145 bp, Homo sapiens
tttaaatatattcatgaaattcatattgttcttttagtaatacaagatctctgaaatgtggggtacaatcaaaatcagtttagttgaaattagaaaggtaaaagtgaaaaacactctgaaatctaaaatacacattaacttgtttttaacattaaataatacacagtattagaatttaaatagtatattttgaaacttttgcccttttaggcatattgttatatagtatataaaaatgaaccgttatgacattctacagtattgaattgttactagaatgtaagtgcttacatcctttcaagacattgattatatgtaaaattaactggttaagtatgtttattttatatatgtcatcctaaaataaaccaagatattagataaattagtgatttaattattaaacaattttgaaaaatcaaccattttttggctaatttcttatctttttccatttcatcaaccagagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacgtgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagagg

SEQ ID NO: 123309 - DNA, 1069 bp, Homo sapiens
aactacaagcaaagttgtgtaatctccattcttcacataacatcttaacattggatcaccagttacagaagtgctgcctaagttttttaaacttttataagtaaacatacctgttattgtccatggatgttgatcagacgtggagctagaacatacagtcctagctctgccacttactaggtagatgaccttgggcagatcacttgctctttctgaacctcagtttcctccaggttgttataaagatgtgtaaagaaggataaaataggtacataattactgttctctcttccttctaagtctacttcagaaaataataaatgttatgaacttgttgctatggatgcttttttgaaaccttattcaaagggggatgggtagtgtaaaagagactatttgtttgaagcttgactactttccttctacctttgaaaattattgctgtttttgcttttaactcagaccctgttgcaagcagttgctattttaagcacttttgaattaagtgatgtttttaagatatgttttgcctggtgatgtcatgtgatggtgtgtacagtaacataaagtgtccctaaaacttctgagagcactggttacttctggtgaaactgcttgtatttttaggtttctcccttagtaacagtcaagcttgtaaccttcagcatgtgagatcaactcagtctagttcctgcaaaataagaaagctacagctgttttcacagtctaatcactcagtaagatttgtcataattcttaataaagtttttctttaaatgtctggttaatttacaaatgtttgttattagtcttttatttctatatgactattttagtatgtctatttatatatttctatacttatgtctaaaattcatgaagataaacatttaaaagtattcaactcataatttgtagtttttaacacaattaaaaaatataggtttggcgttgaatatataccttgtcttttctttgacatcattgaacaccataatatcaactcggaacttttctactgaatcaagaaaagctctgttgatgatgattcaggtacacttttgttatt

SEQ ID NO: 123310 - DNA, 1021 bp, Homo sapiens
tattgggaagggacgaaggaggagttaaacttagggaaccctaagcttctcgttccgtctggtttttagaaacttgggttatttggggacaaatggcttaaagtaagactggggaggcatcatccactgtctgcacgggatgagcaaagttggtaactttgccattcatggaagtgagaggatcttagccttagcctcggtccttattaaaggggaacttccttattttgcagacctgaggttatttgtgttgttccaagacctgcgccttggaactcctttgcttggaaggggtttatagagcgcgtgctgaattcaaagtaatctgccagtatgtttttaacgggtatatttgggagtatagaggcaaagaggcaaaacagtatgtgtttaccaatgtcctagtactccatttccctctccctttctcttgtttttcttattgagccctgttgtaagtcccagataaaagatgcttgggaacgaattgaccttttattccatgattacttcgttgactctgatccaagatgaagttatttatgggcattctgatatcggtgtagattaatttaaaatcttttaatacaaaatcccaaactttttaaattttaatttccatttgctaaatttcaatactgtttgttctttagagacctatggaaattatattaacaggttttgcatttgctcatactaaggttttccaaagcagtccaattgttgacatggcaaaaggaaaagagtagcataaaataaacctttaggatttttcagagggttagatttcaatatgcggtttccgctgaatcactcttcttcatgcttagtcactgtttctcatcacaaaagtttaattggggataacatggtgttttgctgactttttaaattgccaatttgtttttacctagcactttaatgccgtgacgtaacttttttttttttttttaattctggaaatggtggagtttcgtgaatgctgtaagagaactgaagtttcgaatataggcaaacttta

SEQ ID NO: 123311 - DNA, 1011 bp, Homo sapiens
acaacaacaaaaaactagcaaataagttagatcttacagattattaattctttgattttatttgataaatgcagacagcaaatgcctgtctgaagccagggtgttattcattggcagtgtcagaatagctgggacttagcagacttactgtttggcacccataccactgtgatgtagcaccttgcattaaaaacagcaaaatgccctacagtcccgatgcttccattttcagaacatttagatggctatccttctggagttgtgcagtccacaacttgcaaatccaaataaagtggccatgtatggcttatttctgtattgttgctacacatcacatataggctgattaaagatcaaatttccttgcttgtaagtaaaattatggcatctcaaggtggaaaaaaaattgtttaaactaatgagactgtgcgtgcatgaagagaagaagaacggggataggtaattaaaggagactttggtggtgacgagattaggaactaggtcctgaacttaccctacagacatctggggtttgtgagccaaggacaagagtttagtgaaatgggagagacatctatggtaactatggggacaagtagagcctagaaggggaaacaaagcaaaatactttcttcacatgtttatagtggtgttcatattgaggtggattagaaagatagtttctaatcttagattgaaaggcacctcaagaagccatctctgttttgtttttttaatgtatttttaatttagggaacaatggctttgtctcattttatacataaatccatttaagtaatcaaccacgctataatagggttctactataaatcatatgagaaccaaacattacttactattttttaacacaggaaaaaagtctttaagatcatgtttggaaatatgacatttaaggttttaaaaaaattttataaaaattccaagaaaaatattccatttacaagagctgcaagaaaagtaagatacttagtgacatggtttggatctgtg

SEQ ID NO: 123312 - DNA, 1037 bp, Homo sapiens
actgcataggtatacttcagccaggaagcacatatgtctgatgacttttgggaacattagcagccattaaagattatggctatttatatatttttgtcaagcaacaacagctgtaatcaaattctgtttcttcttgagaattttattcatctcttactataatttgacaaaaaagtgctataacatcttatagtgtaagaaatactcttcatatagtattttgattggccctaccaacaacttatttaatagactttactcttatctcagtttttcccatgaagttactgcagttctgagacaataaataacttttctgaaatcacatgcagccagaagaaagggaattttatgaacctggatcccatgttctttacatcagaaaatattatctccttatcaattatatgtcattgaatcatttgaaaattttcattgagcacctgttatctattaaaacactaaaagtcaaagtggttagtaaaactgacattgtccctacctgcatagtgtttacagtgtagttagagagatgggcattaaataaataataacatacataaatacccaattatcacctcctgtgataaatgctctcatatgtttgttttatagatattttagaacagctattttatgagatatttttaaattgttatttagcctgattcttcatctccctatcaccatttcagaaggcttacactattactgaaatgaatgttttcctgccctttgaactggaaggaaaataccttccccaacacacatatgacctctattcaacactgagaaagtagtagaatctcatgaaatatatatttattggttaaccagttatttaactagtcttatatatatgttagtacttcatttctacagaacttaattgtctttaaaatttgcctaatcaggaaagcagccaataccccagaagccaaaaaggactaaaatagatatacaaagaacaatcaaaatatgtaaaaatactctgaaacaaaatgcatacttttttttcatagagggattccatttaa

SEQ ID NO: 123313 - DNA, 1072 bp, Homo sapiens
ctagaaattttcttccattgatggtttctgggaaggaaagaggcttccacaagggcctttttacctaaaacatgaaggctttttaaagttcttgttttccttgtgtatcagacttcagtgatttttatttaggttgttttaataaaatagcagttatgagttgtttgaaattctcttgaaacaaattaacttcaggtggtaagaaggtaatttgtaaggtgagagccttagtagcagtagtcaagagttttattctttgttctattaattgcacagagaaaaaacactttgacaaacactaaaagtaatatatagaaatcttcactttgacaaggtataacaaagattttatcacttgctttcctctgggagtttcttatatcccaattacaaaaacttaagaaaaaatatgtgtctagttcgtattactacaaatataatcgctgatggcttggggtttctttctgactgtgctcatttgggaaaccttgcagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacc

SEQ ID NO: 123314 - DNA, 4163 bp, Homo sapiens
gtaactatattccagtatgcactccattatgtattttctactgtttgtttatcttaattacattttcaaaaccagcatttgatgcaaaaaaaaaaaaacaaacaaaattactatttcagatagagctaaataatatggatggtactacatttgagggttttggttttggttttattttcttaactccagtataaaagtcattttgatttatttccttttcagatacccttagataaaggctacgtgtaaatattggttttcttattgttttatgtgttctagtggcaagatgtattagatattatttcaaaagctcttactgacaacaacatggaatttgcacaaatcagtcgtgttaagacatttcaggtatgttaagattttactccggtttttgtagtggatacagttgcaaatttaaactgctgttaactagcttacttacatttattgtctcatgccatataagccacataaacagggtctgagttcttgattaattataaagtgaacatttaaaagcagagactgcaggtattttcagtatataacaagaccattggttttttaaagatctcccaacttgaggttcttttttttttttagtacaggaaaagattgcctatgatataccttttgaatggacaggggcctcacaccccaaggattagtttctaaagtcactgtcaggcagaactgcatgtggtcacagttatccttacatcatgctcagcacagtgacaggcgtatgacctcaggcacacacagagaccaaatgaaaatttagcagattcatgtctcttatctcacattcactctagcacattctttttctctttttcctctaacctcatgtagtttaatttgcatgcattacatgcatctgtcttgtgattcctctagatattacgaagaacaagagagcttatatgatacttttcttcataattaaaatcaagcgacaagtttacattttctaaagttggtaattttgcatttaagtttcttagctgttacctttcacaatagtaatagatagcattagacatctttaaagtgagctattacatactgctcttattttaactgatcgagctaaaattaaaatgtacctttcttttttaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaagtaaggactaaaattagaatcagtcacatttgcttcagttttctgagaaaccaaatcagtatttaaactcttcatttatgttcatcatagcgtacttgtttttaattacttccttagatactacattttttaattatttattttataacttatttatttataactttttaattatttaattgaaaggcatgagatttccaaccctcccttctctccaagaagcaaacccccaaattgtcccaatttttttcttccctcccacaaaaaccttatcactttatccaaaaaaaagcttgttagaaatacttaagacagctacaaagttgaaggcatccatcatgcctttgaggagaatggagttttgattgtctaaagtagtcccgtgtttaaaagaagacataccttgtacatgactgaaaataaatggctccttttaaaattcttaacattaggaaaagacaccccctaggtcagctccaagagatcattagattcagtttaaggcccaaagcaaacctaataatgaatattattatatggcatgtattacctttattcatatatcagaatagacagttatctttgataaggcctgctaaatgtattaccttctggatgttagaagtctttgatgtttaaaaaaggaaaaaaaaacacatccataataagcacttactaaatcagtatttattgagcacctactgtatgtcaggcattattctaaatactgaagattcaaattgaatgatacataatttatttccccaaggaggtcactgtgtagtacaggaagcatgacttaaagtgttggggtagaatgtgcaaaagtataataataaaaggactgtgttaacaaaagaagataatgatcactcgggccctacagagtcaggaaagactttatggtgttaagtcttgaaggaataattatttcaaagttggctggaaaagggtattcacacagccaaagagagttatatatgcaaaaatacaatggtgggaaatgacatgacatttctagggactgtaaggagtttggaattgttgcagtataaagtatgagaaagagatcatcggcaggagatgaagtcttctgtgtcatactcagaaatgtagactgccccgtaagaagtagcggggagagaaaataaagggcttacttgaaaacaggaaagagacatgtttattaaacctcttaacaaatagggcaaagtaactgtaataaatgcgggcttgttctaacataccaccaagtggcatttaaaatgcagtcatgtcttacttgttttttgttggttttcttctgtgtttttaaatattgattttttgtcctaccaatgttcttttaaagcataggctggactagtctcatatttaaaaccacgagtccaaaaggccattcagcattacccaacaatcttactatgcctcgcaagtcaatatgtttttttctactttctgaggagtctgtcttaagtgtgtcttcttcctccccatggcgatcttgcctcatacaggggaaacatatacaatcagattagaagtacctcatctttccatcatcaacttgaacagtctgcctgcatcagtactcacatactttttggtagatttttattgagtatcttctgtgtgccaggcactgttttaggaacatgagatgtcctcatggagtgcgattctagctgtaatggggttggtagacagaaaggtggtaaacaataaactaagtacaatctggactatgttaggagctggaaaagtagagcagggtgaggaagtaaaagtgcaatgtttgggcaggaaggcatgcaaggccttattgagaaagtctgagcaaggacttgaaagaaatgggaaaatgggaaagttagtcatgcagctatcttgtgaaagaatgttcaagtaaacagtgctttcggtgcaaaggccctaaatcaggagtgtggtatgttagaagaatagcaaggagctacagttgctaaaagggagagaagcaggagttgaagtgaatgggctcagtggggagagggattacattgggcccaggaagccactgtgaggatggtgcttttgccctgtgtgaaatcgggagccattggaaggctttgaacagaggcttggcatatctcacttaagttttaaaagaatcattctgagtgctgtgatagggtgggagtgaaggggagcaaggaagagtagaagcagggagagtcttggaggctattgcagtcatcctggtgagagctgaaggtgacctgaccatggcagtagcagtgcacatgatgaggagtggtcaggttctggatatattttgaagatagaactgatagtacttttggacagactagacatggggtatgagagggtcaaggataacaccatgggttttggcttggacaactagaaggatgaagtaaccttcaactgagctggagaagtctacagggtagagcagatttggtaagggaagaacagacatccaaatggagatttctattctgtaactagatgtacaagtccattaagtcacgagactgaatgagattacctaggagtgagtttagatagagacagagtttagatagaggaccatggactgaactccagggcaccaaagttcagctgttctaggagaggagaaggaagcagcaaaggtaacaaataaagatcaaacagtgagttaggaagaaaaccagaagacaggagtgtcctaggaaccaagtgaaaaatgtacctcaaagaagaggttatggtcacctgtttcaagtgctatgaaaaatgtcaaggaagataaggattgagaattgatcattagatttagcaacatggagatcaaaaccaggttaagtggtagag

SEQ ID NO: 123315 - DNA, 1022 bp, Homo sapiens
agttctgacaactgccaggcattttggatggtgaagtaggcctcctggcagaacatatggcccacatgtcttgttccctgtgtcttacatttggctaggttttatacaaagcattttgccagtggaaaccctgaccctatatactggtcaagagtcttagataataagaaatttctgtccgggagaaaatagatacagccactacatagatatagtgacagcaatacagtacccttcccacccaccacatgctacacaattgctttttttgtcaaacttttaagtatgtgaccatcaactggcctgctttttaaaataaatatttttgttcaggctctgtctccataaactttgactcattagacctgggatgtggtccagaaatctgcatttttagcaagcatatctcttgataatagagatatcttatacagcctttttgtagagaaaaaaactctgtatctctacattccaactcacagagaagcctagccatactatgtgtagaattctacatgtggaattctattctgttttttttttatttgaatttttgttcatttaatttaaagatcatttgtgacatctgtctcacacttttaaaatataattaaaataaacatctgagtgaaaaaaactgattatgaaattctgagtttaaaataggaataaaataatttggtaaatataatccagaagtgattatatttaaatatatttatctaaatattcttatataagttttatataacatgaacattaactggtaaatttggaatgcagttgtatattttttgttaaaatatgtcatgactaaatataattgcaaaaaaaataccatttctatttctgttcaccggccaagttaatacttgtaattctgaactgttagcctcatgttaaagttagccatagcttgcagtaaattgaacacacagtagagacttctaagatataaactaaaacttatctttatgaaaaaatcatttgttgagtgtaaactccattaaaaggtagaggac

SEQ ID NO: 123316 - DNA, 1116 bp, Homo sapiens
cagatggcctttgtggctaagaagaggtggctcacccttaggtgacagcatgcatcacagtacaaggaactggcataagaaagaactgctgtgtcaggttttgcgcagagaggttaaggaagtgattgctctagctactggtaaacagcacagcctctacgaaactgagtcattgagcccatcaaatccaaacacctgttcattttatggcagctttcctagacacccaggatagagattggcacagttacatgtgctgtgctgttggagcagggatatcggtatataaatactgtttattgtgctctcacttctcgctgtctttcatgagtattgattaacacgtgaattaactgaagcatcttttaaaaaaaattaagtttatagaatttactaaagataatttccctttttatcatagatgcacatgtaattacatttccttttcttaaacataagactattgtaccattgtgcgggcaaattttatccctcctcgacgttgtcacactgcttcacgccatgtttaggttggctcttcactgctttttctgttaccatttgtgtctgccacatttgccttgtgcttcctgtctcttcttctgacttctgtcacatttctggcctgctgtctgtcacttcctccttgaaacatcagcttattgtattctgagacttcacccctctcttgtgactctttgaaacttccacataaatgatcatattgcctattttggattagtatgtaaataaagatggctttgtgtaaataattaaggcattattttcaaattttagaaactactagttccaattatttctaaacctagtttttttctttatattactgttgattatcaaatcgttgttctttaacaagcaatactgacaagtaattttttatttaattgaaatgtttatattatctgaaatataaaatttatttctgaaatgattatttcactgtatttatgtcaagattctcagacatagcaaaccatatatcgtacagaatgcttaatcatatagcttttttgtggataaaagatatttggaaagcataaaactattatttattagtagtagacatttttaagtagtatttcttggaaataa

SEQ ID NO: 123317 - DNA, 1044 bp, Homo sapiens
aatactatgcatccataaaaaggaatgagatcatgtcctttgcagggacatggatgaagctggaagccatcatcctcagcaaactaacacaggaacaaaaaaccaccacatgttctcactcgtaagtgggagttgaacactgagaacacatggacacaaagaagggaacaacacacacaccagggcttgttggggcaggggagtaaggagagggaactaagagggcagataaataggtgcagcaaactaccatggcacatggatacctgtgtaacaagcctgcatattctgtacatgtatcctgtttttttgttttgttttgttttgttttgttttttaaggagaaaaaggaaaaaaagtctctgagggaatgacagttaagcaggtatctaaaggatgaatgatgaattagtcagcctgaggagagaataggttggctcccagacagagaaaaagaaaaccagaagagagccagtgcatggaaaagcctaagacaaggactcaaatggatctgagtggctgaagtgtagaaagcaaggagaaagcagttgaataagcctggagacctaactaggggaccagatgttgaagggccacctgaacatttgagaattttatttttatttaaggagaaagccattaaatattataagcagggatgtatcatgatcaaatttggatttcaaaaagatctctcttgtgtggaaaacagatgatgaggaacagaatagagcagaagaaatttggagagagcagcttaggaggctacagcaggagtaatggtggctttgatttggctgatggcggtagaaatggagagaagtgggtatattctagacatgtttagaataaagttagagaatgttggcagcattagtgaaggaaatttcatagatcacccctggtttctgatgtgaataagcaggtgggtaatggtatagctaatgatacaagatatttggaagaggaatacatttagacatatcatatttaaggtgcctaagacatccaagtagaactatccagaaaagtgttgatatgtgg

SEQ ID NO: 123318 - DNA, 1050 bp, Homo sapiens
tgccccatggttgggtactgaaggaggaatatgtgaggaaagagtgatacagttgagaaagaacacacagagcctttccaaggaattcatattattctttcttcaattaaatgatgagtacttgattgtatattttagtattcttgttgccatttatacatagttgaatatgtgaaatatgttataataaaactatttttaaaaaataaaacaagagattctgtcagcctaaaactggactttataaagatttttggtcttagcaagaaatctttatattctgttactgagaatctaaagaggcagtgtcctatagagatttttttcattcacatttcatcctaaaaatgaccccaggaactacttgtacgttagacacatagcgaaaaagtgtaagatctcattgaagacttttgcttaaggcacatcttggtggttttaaccagttttaattacatgctttaccactgtgtttgtcttttctattccttcagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtaattggcaagtaaatcacagaaaagggaacagcaagcagatgtcacagatatctaagacccatagaaaaggcagaatcagggcactgagctctactgtaagtgtgtatttaatctccatttttaatttgacccatagaaaattgtctttatagaccaaaaatggtcaaagatgagcaatttcatatctattacatgcttagtgttcactattttggggcatcttgtttctctccaggttgcgcattcatctgtttttgagtttaaaaccttgtatgtgcttaagaccaatagatattctcagtcactttttagacatttttgtcacctcagttttatcagaactagaaaaatcttccttaaaaacaactgaaaccttttcttttgcagtgtttcttttgctaatgatgaa

SEQ ID NO: 123319 - DNA, 1229 bp, Homo sapiens
acatttcttcatgtttctgtccaaattctgtttatttatctccaacagatataacttctctaaaatagaaattttcctcacatatttccttgccaaacgttcacttctgcatgtcaaggaagaaaacaagatttttgtgttgttatggcaaatgaatcagtagctttctgtttattacagtggatataatagaatttaaaaaaaaaaaaactggccaaatttatgatgttttcagctttttcaaggttgctttggtttttccaaagacttgcaaacatgttcttttagaactcacattgaaggttgcttttcactcactgataccagttactgttgttttgttctggtatgttttcagagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataaggtatagtattttaaaacttccttccaaaattaaaaattcttcttttttacatcaattttaactgctacttttttctctctccagttttttaaaatcttcttttgagattgaggtggcataatttctctttgcctgaaatgtaactgttgtaataaaggatagcaaataccataatactcaaagacattctatttattaaattactaaaagaaaatcattattaaactggaacttatatgaaactttttgtttagccgtgaaagtgtgttcattctattattagcttgatcttccactgctattatatgaaattagagttttgtttttgttctgtgaataacaagcaagcatcagctaccttaaagattggggaacatagtaaatacttcttatcctataagtttggaaaccattccaataaataaagcccgatatgccctttcatatttgtactttaatgattccatcatattatacctctgtacttgagatttcacaattcattaattttcaattattgttttatttggattagttatccattgtactgctttacaggtgacataggtagaggaaggaaagaagtgtttttttataatgacatttttattcaatttcttttttaaaaagtcttgctttttaaag

SEQ ID NO: 123320 - DNA, 1620 bp, Homo sapiens
tctaatttctcattattaccggctttttttctccattcataaacctatacagacacattcatacttcttttttgcagccttttttattcacagtttatcaaaatggttataggtactataattgggtttaactcctaactgcgacctacctttgttactttagttactttaatattttacacttcataatgtgagcacattagtaactattgaaattatacaggaaaagtgcttggcaaagtgcctcgtatatagtgcataattacagatttaattaagtatatatacatatatatatatattcaaccaaggaatataactcttagccatttttcttctttcttcccaatattctgcttttatgtttcatcctgcaggcacctcctcatatagagcaaggatgtcaggaaggctatctgtagtcaggcttaaaacggaagaatgtggcagtcgtacactttcaaagatatctgagacagacatacatttttcatgctctttttcagttcctgagcacaggactatcaaatttttttggtatcttttacggtagacagcccaatattatactttgaatacattctgaaggaaaactcactcaaatgttgctgttaaaaaaaaaaaaaacagcaaacagtttctttaacactttgtttggcaaccattctctgaatttgaggaaattgacctattattcttttctttgtattgtgtgtggtgctggtgtgggaatcaggttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactggtaggtaatagaagaaatcatacaatgaaatggtaccatttctttaagctagatttcttagagaagaaacaattgactcatatagtaaaggttttttcattttaattgagacagaagtagaaagagatgtattaatctaatttaaagaaaaataaagtctcaaggacaaggtatgaaaaaccatgtgatttgttttttctaaaatggcatatctagtggaaagaaaaatgaagtcaaaatattaagcttctccttaaaattaccagattgctggttatgtttgtgaatatttctgttaatctcttttttttcagctgtgtcttttgtaaagctgatgaattgttcacagagtatgaatcaaagctattttccaacacgtaagttctctatttgattattacccatcaagaaaatgaaacattttgcaagactcagttatgtgatataagactatgttttcccccacagtaacctttattatattgtttctttaattaaattgattagtacacctttggtatttgattgtttaatatgcccagttttacctatccagaagttatcccctaaatgttcatagtgtagtaatatataattaattgagatgcagttttgtggagtggtaaaatcccagactctagaatccagtggatttgaattatacagattttgctagcattttactgctattcaaggtagaactcataatg

SEQ ID NO: 123321 - DNA, 1030 bp, Homo sapiens
atgggatgtaaataaatgagttttaaaaaagaaactttgatctcatggcagatctacaaaagaggtagcttagtaaatatacaaacttttgcactttctccacatttctgtgtattttttaagggggtaaataaagtcaaatttttggtggtagttctcccaaagaagtttcctctacaaaaagtgtcgcctctttttgaaaagaatgacatcgaaaagagtgatattataaattattttactataaattgttaatagcttattatgcagattcttccagggatttttgctgttgttaaacattaaagagctaaaatcaaaagagtaggtatgtttgaaatgtattgaacctgtaagtggaggctttatttgagtcaacaggataaaaaatgagattatataaataagcacagcctttttgcactggttgttttgggggcggaggtgccctggtaaactattttaattaacaaaaattttatctattcatgagtagagactgatgttttgatgtatgtagacactagaatagctaaatcaaactaaatcaattacctctttatttttattgcatgcatgtgtgtgtgtgtgtgtgtgtgtgtgtgtagtgagaacatttaaaatctactttcttagggcttcagcatatgaattttggggaaacaaaattcagttcctaacacctgtgttactgtgtattctcaaggattatttttaaactgcagtaactaaggaattttaataactaaattagccaaattttagaaaggtgtctttgctttgcctatcatttgaaatattactgttctttttttcccctctttgcttattctaactaaaaaaaaaaattaaataagaaattggcaaacaaatattcggtgtttctgaaattttgttacttggacaagtaaattttgttaacttccatatataaggaatttttagcgtgacttttatgttctctacagtatacttggacttttatgtttaaatgcagttaagtagctttaaatgtataaaatgacccatt

SEQ ID NO: 123322 - DNA, 2028 bp, Homo sapiens
taaatttcaaaggattcatgcttacagagtgtgttctatgcccacagtggtagataccaataacagaaggaaaactggaaagtccgcaaatgctgtgaattaaataacacacttctaaacctttgggttaaaaaataaaagggaaagtaggagatactttgaagtgaataaaaatgaaatatcaaaatttgtgggatgcagcaaatcagttattaaaaagaaattcatagcattaaacatgtactagaaaagaaaaaagtttcatatcggagacttcagctgctaccttaagaaatttaaaaaaaaagagcaaatgaagtacaaagaaatcagttgcccaaagaaatgtgtgctttttgtagaatataaatcttcttacattaagcctctttgagtagcccgtctgtagttgttagctctttagcataatagaaccagaaatggaaagtgtctcttattgtgctagatacttgggtagagttataaggattctcagaagctgagcagaaatagctctagacaagaactgaatagggtgggcctacttacatgctgcagttggaaccctgtgaaatggtatatattgttcaagatttccgaacttcagtgtctttgtcaataaaatattacaggtgctttacttacctcaactattgttcttaatacaaaatgtagaagcacattgaaaacgttataaaaacagagatgaagaatgatgttattggttatggtaatatgaaggttacctcagattcttaccactttcaacctgctcacaatgtaaattctgttatcaatatctaatagaaaagggcctattattatatattcgtgttaaattgttcacatatagtacacgtaactttgtgtgcaaatcttccctctagggcattccctagaaagtcctcaatttagctagcagtgtattgttgattattaagagaaatccgccaccagaaagtccattaatagaggatatgttccttctgaattgtaattttcaacttaattgtaatagatttgctgcttttagtttttattaacttcatagtaatgtgttaaacaatattcattttttaaagtaacattacatatataacttacataaattagattcttctaatgtgaagatcagacagtgaaggtctgacttttaaaagaaatctaaaattaatttcaaactctaaaaagatttgcttatattatatgtaaataaatacgtatgatacattaatacatattctgagattctccttgactggtattaaacacattttattattccaattttgaacattgtgttttctgcagatgattttcggagaaaattagcttgacaatatcaaatccaccagttttcttagaaatgttagcgccatcaagtggctgagaatgggtatttccaaatttgacttaaacctttataacattgaatatgggtttttttttaatcttcctcagaaagcatgtctttttaaaaataaacatgcaaaaccaggtattataacgaatagataaaattcagctgctttacattatagtttaatcactataccttctttaaaaggtatggtaattatgaagagaaaattgttaattgaattattctctacaaatggtagtataaatactgatagaattcataatgtcctttgaaaagctttaatcaagactcttaactaaaaaaagagaactcactgtgaagataattgaatgttaatgcctacgttataaagtaactttattattgtgaaaataatcttctcccttatttaaagggaatagaaattggctgactacagttctttgataatgtgtgttttagaaagctttgtattagctaactaatagaactagatataaagcaatggtataagagctattgttgcaaaatttattttaaattaggtgttttgcacaacactgaatatacataatgccactgaactacacacttaaaaagggctgagatggtaaattttatgtatattttaccaaaatcaagatatgtatgtaaacttatatatg

SEQ ID NO: 123323 - DNA, 1005 bp, Homo sapiens
aaattgactgtgcccagtaaagagataaacaagaagtcccatgctctaaagctaacaaatacaaggcatgctgaatcagaaaagaaaaatagttctattttgtgggattactataatttatttatttgagtcatttttctacatattgttgctatgaatatcactgtgtaagtaaatcttatctatatttttattactctcttaggcttcttttctaggagaattattagataaagggtatgagaaatattgcatcagagaatattcttcatgtcatctgtgtgcttagaaattcttttttccaatccagcaaatcttgcatctattggtttcagagcatggtatttcttatatatgtcttaccaagtacattcagttgagtggttttttggtttaacttctgataacagtttcagatttttgaattaagtataagctgtatgtaatgaatggttgcataaatctaacattattttagcacctagcccaaaacctagggcagaatagatgctcaataagtataaatggaattggaattgaatttcagatttaagagcctatacagcctgtattttaattcatggaaagttctatgtgctgtgtaatgtctgtagaaaagcttctgcaaactagtaatgaagtaatagagttatcctcaatgtattttattttttcttttcagatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaagtcagtacaataagtttttattgataaaggtactataagagaaaagaaacaattgggatggaaagataaatttttagatgatatctttttttttttttctgctccttttcacagatccaaataccaccacaaaccgaagaaatacactggctccacttt

SEQ ID NO: 123324 - DNA, 1494 bp, Homo sapiens
tttaccttctccgctacagaattggtctttccactgtgatgctgtcatgttcacatttattacagtttgttgcacatcagttatgtaattcatcttccacactaaaacatgtctttctccaaacaggtatgggatctgtctcatagcatgaatgctcctaagaaaatagagaggacttagtaagggtataaatgagtgaatatttcattgcctttagtgagcctttttgcaataactgcctgtattgattatttcctaggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagtgagagtttctgcaaaatcttttgagggctggggaagaagggtgaaaaggaattaggggaccttgagtagtttaatagtttaagcatagttaacctgtagtactgatattggtcaaaagtttgttattaaacactacttgtgcttttctcttgtgctttgaactacataaccctttgaaattagttctgtactctgtgactcattgctctatatgaaatatatatttttcagtaagatgtctgtttatatatgatgcagatcaaagtaaactgtgtttaggaacttctgtaagcatttctgctaactgggagctcatcgtgtagcctctgatagctttgaaccaaagttgactttgacagtcttttaaatcagaggccaaatggtaacagaaaatactactttagaggacagaattttgattcagcctttgaatgtcatatgtctttattctgttgtctttggccagtctgtaacctgaactgaatgtatgaatcatgtctgttagtatatctggaggatagagtgatgcagggcatggatcagttattcagggggctttttcattttgtacgtatttgaactacccctctgttttaggggactgcgtggcagcctcccactaatgagaaccactgtactggaagatggtccattgaatatgacattcaacattgagtgtgataactgttaaataaaagtaggtacatctcaccagaagtgtagcttttaatgggctgtttttcatgagtatgcctgacttctgtgttctttctgtggttttctggatttcatttttatttcatttttccctctcatcaggctgcagaaatggcccagcgtttgagtgggattaatcgatggtgtatcagtggcactccagtacagagaggattagagggtaatgtatggtttcctcacatattgcatgcatttgaaaagcttcattttttagagagaaaagtattgttatgcttaaccttt

SEQ ID NO: 123325 - DNA, 1286 bp, Homo sapiens
tttctgcattttgttagaaaactgcttctgttgggccagtaatttcaatttgcttttaggaaaatagttataatatttgcaatcataaataaagattaatgacaacaagtcaaaatgtggagctaccagctcggccaccaagaaaaagacaaaaaatttattttctggagtagggagtctatattatccttgggtagcactgaagacagcagtgaactgtgcttttggtaatcctgctaccaccaaaactagaagatttccctcagttaatgccattgattacatgttgtgtcttaactcccctgttcgacctcagccctgatatgccttggaggaagctgtccctattaactacctgcctatcatactcccactatgttgtacaaccctcttaggtattcccatagcatcattttactttttactgttctcacttttccagtagacccctttgaaaccgggggccaaatattgttcatatttgtgtccctagcatctaacacaactactggcacagaattggcatttaataagtaattgtaagagaggacatatgtagaaaagggaaggaaagaaggaatcaatttgctaattgcagtaaccagtggattatcttttactttctttggatgctatattttagtacttggtgtttttgtagttgccctgatttgtatatttatgtactcgaaaagtactagtcttgtattgatttaggtagactaaatcatagtaggtaaataacaaaatatcagtagcttcctttatctttctaatttttcatctctccaaatctgacacttgtagagccttccttttgttttgagatgaagtgagggtccttacagagggcagattggaagccacttatcaggagtgattctcctcagggaaaagggtagcaaagactggctgctacataattatatgaagtacttacataaagtcaggagtttaatttcagaaatgcaactagttgcaatcaattaattaaatatttttttcataggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacat

SEQ ID NO: 123326 - DNA, 1826 bp, Homo sapiens
atgttatctttcagtagggtcaagtttgcagaattagcctttcagatttgagtagaaaatttaaaaaaaaaatgttttttttgtagacaaatgacttggaatatattgacttaactatcagtaacttctttctgagatttcctactcattactattttaattccaagttattttcatattattataaattcaatgggttaattttatatttaaatatacctttaaaagttaatttcagaggttccacacataacatttaggtaatttaagataatatgcacaattttttaagtgatagctagctgtaaactcagaaataaaactgtgtatgtatctacagctatttggccctttctcttgcaatttttttagaactgttttgcatttccataaagaaggaaagttaatttcaataagcaattcagaatactgaaagcaaaacactgtgtaactactgactgttgtttgtatcagggaaaagtggtgaattattttattccgtcacattattttggaggaaaactgaaaaagacagaaatccagaatatcgaatttgaaccaaaagaaaaagttcaatgccctcgtaagtaagacatctcttaaaggaaataccttcttatagtgatctttgctagagttcttgcaatccttagagatatcttgtaattgttataaacaattgtttttacagttatatatgcttttgataaatgaattcaattacaagtcataatatcttaacaaaagtaaagatgtattattttgtttgacttggcccaggtagttcttgctcagtctgttatatttaaatctctttagcttacagtttaaaccaggctttatttatcttttaggaaatgaatgtttcgcatactaatggtagcgtatacttaaataattgtgagagttttcttttataattttgaatgattgttttatagtattaacaattcaatatgagtaattcttcctttgattatttttattacagtaatttgtttcttaatatgctgagatacatttttattacatattttttcaaaatggcactctgctgtaataaatctttgatttatttctttcttaactcagtcctcatgcagattaagattaaccaagttttactttcttttcattttaattattttgactgatttagcatatccttttacatttagctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggtaacagagcttaagttcagctctatattaagtacacgtatgtgataccttactgagtacattgacagatcccaccttgaaactgaaactcttacgatctgaagataaaaaaataggaaaagtacttatatctgtaacttctactttctactttgtggatataaactccgtgagagtaactttactttggctatcattaaacctagagaataatgcttggcacgtaacaaatactcagatatttattgagtgaattaaaaaactagttggctaagcgtattatagagtataaagcatcttctgtattatttatttttattatttttttaagacacagggcatctattgccctggctagaatgcagtggtcatagctagctgcagccttgaa

SEQ ID NO: 123327 - DNA, 1020 bp, Homo sapiens
ttggaataatagacataaggtgcttagttatcaagactaaaagagattattatttaaagtaaaaatgttatcttgtttattatggggtcagttttattttttcttagtaatcattaaacatcatgaatgaatagtagttattgccctttgtatttttttttattcatagattcataaaggtcatagaaagaaggcagacgtgttctcttttaactaccactcatttctgcagagttacttgtcagctcaggcagtttttttggttatcacagttctaatgtttgtaatctaaggtttgaattgttttgccctaaaatatagtttcaataaacttagactttatgcattgcttccagttctctttaggaaaagtaattaggaacattgtaatttgtattcacattcctatgatgtgatttatcttgtttttttcctcagcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgaggtaggagggtatagtagggcttgcaaaagcaggggacatatgttctcgaaaagcatcgtatgttgaacatttgcttggcacttaagtcaacactttctgttcactctgtgggtaatgatttatattagtggttagttaacttcaagtgggcagagagaatggggtgtttgtgacccagaaggtttatttttgaagtaatgttggccaactaggaagagaatttgtgatcacttactgaactttcttctagttggcagagaaactcctttacaaaagtactgttgactcctcaaatgttttgtcactaataaagtctccatattactactaaatatttttaagagctatttaaaaatgttatacaaatctcatatatataaatcttagaaccaaataattagaactttgttaaagaacaagtagcttagtaa

SEQ ID NO: 123328 - DNA, 1031 bp, Homo sapiens
tgttcctatataaacttcaaacagtattcacattgagttcctcaaatgtttataaaacatccacaatagacaatacacgtgtcagctacgtgtcagcttctctgaggggctacaaaaatgaaaaactttgcctttgttaccctggggaaaggaccagtggacataaatgtttgcagtaccagatagattacaatgtaataatactgtatccacagaggagaacataattccagccagggaaaacaaaagaaaatgccatggaaaaagtatcagttaaactttcttgaagaatggatgagtagatttttgattaatgaagaattaaagatagggcctttcagtgacaaaacacactgagcaaggccccagagttgggcaagttcattgtatgctcttagaataagaattgcttatagttagaaaaaacctatcagtttttgagtacatttgctgtgtgatgtacagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactggtaagaataagatgtttaaagaaagtccaattgattagagagattacatcagagacaattagggcagggtgaaattgatcattaaaataaacatcctgaaaatataagatagaatgggtgccataaaattattttctaagaaattctttaaaattgaaatctagaaaaatgaatttgtgagtttcttcattcataaaagtttgtactggtttttcttgccaaaaggaaatcaatcctgcctcaattggaatttttaaaaaccaagaaattttttttacattcctttcaaacaaagaattgctctttagaatctggtccagtgggaatcttactgaccatctgcaaga

SEQ ID NO: 123329 - DNA, 1017 bp, Homo sapiens
attgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggtactcagttttttgtggtgtcttttttgaggctcttctacattggcagtccaattttaaattaacttgtgagagaagtctgaaaagccagcaataagcctttcattgttaagtttcaaagtacactttaagcttttaataactattcaaagtatgttacaactaatcattttcaggctacactttttcaagatcttccatctctactttcagtgacttgttttggtcctcatcatcagttcctcttactgcagcagtcatttaaccatttatctgtttgctattttgccttttcaaatgcttcgattttgtctctggaattgtatgattgaatgcaaatgaaattctacccattactgcctacagaattaagtataatctttctaatctggcacacaagttcctcccttgacaagcccttgagccttaccctttattactctgctttttattttgtcccagaaactccaaattgatttattttctccatataccacactgactttctgcgtctttgcttttgttcttatagttccttctgcttgagttgttcccttccccttccctggtaattcctggttattctttaatatttagtatagcatttaattcacccagggagatcgtttcttaaatctattggtagtattatgtgccctctcctcagaatctctggtagatttttttttttggccttggcggcttgtcacatacttaacattttagatcattcccctctgctaaactatgaagcctttcatctttacagcctagtaaagtacctggtacctaaattttca

SEQ ID NO: 123330 - DNA, 1003 bp, Homo sapiens
ctttgactttgaataaattggcatagtattcttaccaagcaaattaactaatcacaatcaagttaatcattgtgcaaaagaatcatttcttcttgtctctatgaaagctttatttaagatgcttctcagaattatgctcactataataataattgtaataatgattgtgatgctgatgatgtacctgcgtctgataatacctgtttaggacttactatatataagcactgttctaagaactttgcacataactcatttaattgtcacaacaatgtgataagataggtactaatattattcccctttcaatgtacggagtacagtaacttgtcaaaaagtgctgcagtgccagtgctgggatttgaagttagggactgcaacatcagaatctgtgctgttaattagtaagtttgtggggtaatggaaaaacaaaacaaaacatgagataagagttctagatttaccatgattgttttgtttaagagatattggcattaatcttagtttccttttaacttgctctctctttcagagatttatttcacggtttagagtcaccttctttgggaaaatcagctaaagtatctcccatgagaaaattattttacatttctagttattctttatttctttgcattcttttatttcatgcttagttttaaatatttcctatgataattcattaacggataactcatttaacctcttttccagctcatttctttatcttaacatgggactttacaatgtcattctctttgcacaccaggctttatctatagaactatatttatgtagaagtcaacttggaatgagtgctatttctctaaaattctaagttataattattaaaattctaatagttaactgatggatctgttctaattcttaaatttttttttatctgaagaaagtaaaactgagaataatttatgtgtatgagcacaaaaaatagctaccatttattgagggtttggtaggtactaggctattaatatatgtt

SEQ ID NO: 123331 - DNA, 1048 bp, Homo sapiens
attatttatttgtcattgcacaaattatctaagttagctgtgtctcagtttccgcatcattaaaacacgtataaataattataaactcatgaaatggttgaaagataagaaaataaacaattagaacagggcatagaatattgtaggtgctcaataaatgttagctatcattattgtatcactggttcagggttcagatcacataggatcttggaggccataggacaatggtgtcaattttatttaaattaaaccataaagccattgaagtgttttatgcaggcagtgatctaatatgatttagaattttacagaatagttttctttttcctgctatgtatagattagagtatagggaagtgggtaaagagtagatgcaggatagttagtaggattttacagtaaactaggtcaggggggtttgactagggtgaaagcactggggagggccaacagaacttaacagcttacacttgagcttgtggtttagggaaataaggaattctgaatgtttgacatgaagaactggaaaaatcatgatgccctttatagagatagggaagggccccataggattcataaagctgccaaaggggtctacggaacaaaaatgttaagagccctgctttaaaatcctttgtccatgaatccactcttccacatttctttagagtttttcttttatccttcctgtcttcttgataactcactttctcccaatgtacacacttgatctgatgatacataaaacaatctgtgaagatgatttaggtcaagctggtttaccatacagccgaagtgagaacacaatgaatttagcactagcttgttgaatatgtcccagagctttcaaagcccagctgttcaagttcagtaaatgactctcatgaaaagtgattggtagttatgttcatttttatttctcctaccctttccttccagctgctaaagcctaatttttactgtaggtcaaaataattttaatttctttcattctcaaagtcaagttaaaagcagatagaatagccatctcggtttagcctgattg

SEQ ID NO: 123332 - DNA, 1031 bp, Homo sapiens
aattagttttttttttccttactataaaaatgaaggtgcagtattaaatgatttcttcaaggaagaattttatgatttcaagtagctatgtattctagaggagtaatacaaaagaaatgaaaatgtgatccttccttcaaaaagtttccagttctaaccaaaggactggaactaaataagcagttgaaatttgagaattatttggggctctactgacattacacaaagtcaggttacatgtaaatttgttgcatttgatgaacatttctatacattggtagataagtattcagaatgacagggaggaaggagtgggaaaattattctaggcaaggaaaacagtatgggcaaaagcatggaaaagggaattatgcgagtttggaggaatactaatgaggctagttggaataattgagttagcaggagaaataaggaggctgttgagggtctgcaattttaacctgaggtatctgcatgatattcagttaggaatcatagttatgtaataggagatgctgacaggaagaaagcatgattttttagcatgattagtggagtagtggtataggtgaaaagaatggaccaagtgaacttcacagaaaattattaatccatataggtagtaaagtgaatccaaaacaggggtggcagaatgggaattggagaagggcttgacttgtttgtataaaatcttagggagtaactaaagatgataaggttttgcaagtaaagtaatgaggcaattacaagcgaagtgaaaaacttggcaaagaagtggcagagaaatgttgagtttgaaattatgttatctttaacttttattgtattatcattttgggagagtagcctagacttcttattttagtgtgagaatttgatatactttcactgttttgttttggttttttttggctggtccttggtgatttccagaattttgttactgaatttatatttaaggtcattagtagctgtttggcattgtccatttattttctgtcagtgtttctcaaagtggtagctttttgggc

SEQ ID NO: 123333 - DNA, 1150 bp, Homo sapiens
ttttcatttgaaataattaaaagtaaaataattagtttagaatttagccagtgtgttttgtttgtttgtttattttgagtcggggtcttactctgttaccctggcatgcagtggcaggattatagctcacttcagcctccaccttctaggctcaagcaatcctcctaccttggcctaccaagtatttgcgaccacaagtgtgtgccaccactattttgttttatttttggcggagacagagtttcaccatattgtccaggctggtcttgaactcctgagttcaacctcccaaaacgctgagattacaggcatgagccaccacgccagattttatccattcttctccctccccatcatttttgttcatagctactttcctcctcctccatccttttttgttcatggaagagttccggtcatttggaattgtagttgtgcaggagaaacaaggagcttgaaatactcagctcatatctcaactgttagctcctttagctcctcattcaagaggacattgcataaaaggaagaataagtgctgtatcagctgtaagttgtgattcttagcatggactaccgcagcaggaggaataggcacatttatttcagaacaaccagaaatggaatctgcttggaaacagtttatttcgcagtggatttcttgtggaaggaaacaaatgtgatagaaaccatggaattgaaaagaatatgttaactattggagattcaagtccgtgctttgtaagcctttctgctttaagtaagatgagtttttatctctgttggatattctttgttttctgtttggttttcagtatgattcatttgaaattacaacctaactttgccatcctaaaggaaaaagtaaaggcattttggaagaattgccttattattaggagattcttgttccaataatcttcagacttaccttgtataagtcaactaaaatctctgtgcttcagtttcctttcttgtaaaatgaggaaattgggatgtgttatttccaagaatccttccaacttttggaccttagaatttctttttctgtggggggatttaggaattctttggactgtgttcctgtagagggatcttctggttgattgctctgagttcctgttaaagagaatgaagtgttagactccata

SEQ ID NO: 123334 - DNA, 1027 bp, Homo sapiens
atagggaactacttgctctgaaatttgtgtcctttctatgttagtatctcaagattatatgtaggcattatcaattctttaaaacttaattttaaattttttgttatggagtaataacttacgagtttttcttctactgcatagggcagttttggtggtaggaccccttggggctagctgcagctgtataataatactgccttatttacaggaaaagggaatgaaataagtaactttgagaaaaaatcatttctctgagccttagatatatcgcctgtaaaacatgaataataactacctttcagaattactgtgatgattaggtgcaattatgtatttaaggcacagtgcctaaccatttagtagctactcagtaagtggttcttattgtttattaagaaattatttttatcatgttagctagaagttaaggaactatgttatatcaatttaaaagtacatttttttgtttagagtagtgtcatacatagcccaagagtaaaacgtctcttgacctctgtgtaactgactccctgaatttatagacatttttcattctctttggagaaaacattgattgacgcccatggcaatttgaagtttcaacaccagtaaactacttcttagaaggctcaaattagtagacctgttgcttattctttacttaccaagaatcagtttttctgtattcccaatctgtttatgtctattgtattagatattcttatcaggtagatcaccttaatattctataaaatgatgaagtacaaatgccaaaagagacatttttaaacaaacatctaagatgaatgcgtttgaaagacttcatgaaggtcagtcacttaaaatttccctcctgatttggtgtgcatacctataaatgactggaaaagaaatagactgtatatgaatgctgcactcgtattggttgacattatctttaaagttccttttaagaagttaaactggaaatcttatacctggatagtcatagctatgttttactcaagaaaaacaactctgattt

SEQ ID NO: 123335 - DNA, 1443 bp, Homo sapiens
aaaaactgattcagaagcttcaaaggatatacaataaaagcaagattccttcttttttagatccatcttactttcttcagcaaccacataaatttcttttgtgtccttctggaaggatttacagtgtatgtataaaagaaaaaatctctgtatagctcccctgcttttttttgcataaaagggaagctattacatattcttcctgtaacttgtatttacttaacatatcccatagattgtctcatatcagcacatttaaatcttcctgaatcattttcataactacataatattctgttctatataagtgccataatttattcagccattcctcatcagtggacacataatcattttcagtctgctgttcattttactctgttgtgatgttatgttacatatgtctttgtctacatatacaagtatatccataagataaatttgtagaagtaggttagcttggtcatagaaatctcttctaatatgacttgtgaatttggggctttgattggaaaaactttttcaccccaatttgattaatcatcatcccctatatgtttttgtggtactcttttttttttttttctgagacctggtcttgctctgtcgcccaggctggagtgcagtggcatgatctgggctcactgcaacctctgccccccaggttcaagtgattctcatgcctcagcctcctgagtatctgggactatagcatgcaccacaacacctggctaatttttgtatttttagtagagacggggtttcgccatgttggccaggctggtctcgaactcctgacctcaagtgatctgcccgcctcagcctcccaaagagctgggattacaggcatgagccaccaagcctggcctttgtagtactcttaaagttttattttttatacttaatctttgatttatatggaacttattttggcacgaaatatgagtaaggatatagtcccttccctcaatagttttgagagacatatattgtttatcttgtatacatgtgtagttgtatatatgtatgtatataatatttatgtagttagcattaaaagcacaatcttttttaatatatattttgaggaaatttttaaaattttgaatcttataggaataccaaaatggaagtacttgattcttttattttaatttctaaggaaaagttgatttgttttctcaagtggctacttttttccagtcaagttttagtttttaatgtctaaaattttggttaaaacctgttgacaataaaggtggaagaagagaatgtgagaacagtatagttataacaactgtaataacagtagaggtaagaagtgtgaacttaaagtagaggaaggaaacctgtgagctctagggttttatcttagattgtcttacttgattctcatgacatttcatggaattagtgagaaacgtggtttgggagaaacgaaac

SEQ ID NO: 123336 - DNA, 1158 bp, Homo sapiens
actcagctcagggatttgtctgctgtataatttttatcacagggacaaatttgccgatagtagtagctacagcatctcaatcttctgtagcctgaaaggaattggtagcaacagtatgtcatagtagaatactaggggtgtgtactttacttacctgtcctctgttacagattgaattgttttcccagaaaagataatcttaaagtcctaacccctggtacctatgaatgtgaccttagttagaaatggagtcttggcagatgtagtcaagttaatatgagattattaaggtggagactaatctggtgtccacataagaagagttgaagatacacagacacagaaactcagacaataccatgtgatgaaggaggtagaaactgagtgatgcagctataagccaaggaatgcaaaggatagctgccgataccagcaactaggggagaggcatgcaacagattctcccctagagccatcagagagggcagcgccctgctgacaccttcatctcagacttctggcctccagaactgtgagagaatcaattcctgttgttttaagccacccatgctgtggtgatttgttttggcagctctaggaaacacatatcacctttgttcctcttccttgatattggtgagccttgttaatatgtgccattaggtttatacatgcaaaagagatgttctttgctcccatagaaactgagaatttgataagtaagacagataagttgcagtatcagaatatgttccatttagcttaataccttgttttttcctttaaagaagtttaaataggagcaagtcgtgggttgatcagcagctacaactctcttctagtcttttttcatcaccatgagttagtatagtatgaccagtattctcaatcatgttaagtttttgcataagtttataactaatgatatgtgaagctttttaagactgaaaactgaattatatgtggacttttttaggacctaatgttattgtttaatatttttacctcttgatttatataatgctttattgtttgtaaaaccttttcacataaataattattctcaggggttaagaaaatttcccttaatgaaattttatagaatattttcccctgtaagtacattaaacaccagaaaagctgaatcttgatattaaa

SEQ ID NO: 123337 - DNA, 1082 bp, Homo sapiens
ttttttgagtatatttttctcttgcagggttacattttgccatctgcctttccagagtaagtggctctatgtgggcactgaacgaggtaatatacatattgtcaatgtggagtccttcacactctcaggctacgtcattatgtggaataaagccattgaactgtgagtttgaacaaatattttgtatctgaaagcatcagttctatatataataataccgttacatcatagccaatcagtaaatctgtatggaattaaatatgtgacagatgttcttaatattaagtacagatttattagttttttatgagtagtattttgacatggcaatttgtaaatttaaattatgcatatgtatatagagatatatgcacattacatatgtatatatttacatttgtgtacactgtaacactagtttaaggaaacagtcattcctactaatgaaaatcatctaattttttctgttctcttatcttctaattatttttctttcaaatgatggtcatgacccacaaatgagttgccaccaatgtttggaaaacactgatttaaactactacttgatatgttttaataatcatcaaatataatgtttgctaaagttaatatattatcaaattaattttgtttgattttacttaattttgataaatttttactttttgataaattttataaataatgattgttttcatttactaatattagtaacaaaaactaggttaaactatagggccctaaggatctttagtgctaactcttcactctgtcttaaattttttgtatcttatctctttctacaagttttttcttacatttctgggacataaaaatcaaagtttaaggatatcagcaagacccttttgaatgtttctttttgattttaagcaaatagtgttgtattgttgcattccatggtatttacctctttttgagataaggataattctgtgacgtatctcttaagtcatgtgttagtatagctgtaatagtgtattaatcctggtttttcttcttgtagcaagaatattatcatatatcagtcctttggtagggtgggttttcatggtctgttcttt

SEQ ID NO: 123338 - DNA, 1035 bp, Homo sapiens
aaattagaaatttcccttactttacaaattataaagcagagacttggtgacattatgtgttccatagatacagagctagactttggcggatctgagatttgaagaccaatttctttaatttcaacccaggagtactctctgttatgctaagctttctttctagatacagactggttatatacgttgtagagaaatgtattcatattccacatacacactaatgctttttcaaagagaaaaattagacgggaattagtcattagtatgtaagctaattaacatctctatgggttataaaagattctagtaggaataagcattgaagaatttccaattttaattaagtactctatctttagttttctatttttaaatatttattattctcttgcttttgtaaagaaaggaattgaaaagctggaagattatgggcataaaactctaacctgttgtcacatatttctaatatccttagaatactagagctggctagagaggttaaagtttaaccctcttaagttattaaggtctggatagataaaattatttccttaaagttatatggctattaagtggcagatttaatactagaactcaggttacttaggtcctaagcagtgcagtgctgtttacagtgtatatcaacccttacattttattctttttcttctctttccttattctcaaatgctgtatcacatgtccaagatatttgaaaagactgggaaaagagagaggaaacaaataccatttttttccaaaaggtgtatgtatctcagattgcctaggaaagaagagataaggttagaaaaattgactgtattctgtactaaagtaggaaaacttattttgttagttttgatagttagtccctccagctgcccctgtactctgaaatcttctaaatttgtcctattaaaattactggttctgcccaaattttgtttatatccccagattacccaaacagatatagactaatcatttttctaattattaaacaaatatttattgtgtgtctactatgtattagga

SEQ ID NO: 123339 - DNA, 1895 bp, Homo sapiens
aatgtaaataaataattttaaatctcttacccaaaccactcttctcctataatttgattagcctggaattattccatttaatattatttatctgttaacaaaagtaagtccaaaattgtagtattaaaattaccactgatagtaaaacactagatgaatagtaaaatataacatgacagctgtcctttagacctttgagcatatgacaagtgattcataaggcaattacattgttttgagttactttaataatttttcttctgttttggttttttgtagactaacctcatgtataataaaactttataacaactaacctcatgtataataaaactttataaattcattttatcttgagacttaatattttaagggacagttctttttggaagtagcgtttggtgtcagatagaggtaaactgccctgtcagtatgttttataaaatggatggaactttgaagcagttcagactttaaagacacacataggagattcagccagagtcctgtcacctgtaattgcttactagaatctacgaaggagcccagtaattatacttctctttacctatctggattcttttttttttttttttttttttttttttaaagagacagggtctcgctctgttgcccatgctggagtacagtggtgtgatcacagctcactgcagccacgacctcctgggctcaatcagtcctcccaactcagcctcccatgtagctgggactacaagcgcacaccaccttgcccagctaattttgtagttttttatagagatgggttttcggcatgttacccagggtggtctcaaacttggaggcaatctgcctgcctcggcctcccaaagtgctgggattacagatgttagccactgtgtctggcccccatctgtattcttaacacattaagaaataaaataatttcagatggtgactaaaaatatcaccttaattattgttaaaggtaaagatgccaactagcacaagagccaggtaggtttcctggtactgactgacctgtatacagagatagccttatcctcccagtcgtggcagtattaagaacactgcctttgcagcagcagaaaagaaaatgcatcccctgggcagacttgctcccaaatgaacacaggttgaggggaaaatgagagggctacattaattatttccatatttaccggctacatagggactctaccattcctgggatagagttagaaagagggtagagagaagcccaggagttccactgacactcaagaaaatacaacagatgtggagaagcagtcctgctaatttgagtgtgtgtgtgtgtgtgtgtgtgtgtgtgtgtgtgtgtgtgtacacatgcttgatttttgtttttggcagccatggggggtggtttggctggtcacataaatgcaaattcttactaactttaatagataatgttatatattgttacatcaagttatacatttaaattacaacattacttaaaattttaagtattgatttttaaaactagaaatataaacaaatcatagtaaaaaatatcataaagtaatggctctattgatacagttatggttattttgatcctttttctggattttagagaaaacccaagaacaagaatgcatgggaagattgtaaacatagggattgcatgataactatttccttttcttcagccattatcttaaaattaatttgttagtaataataattctctagtattaccttactaaaggaccaatttttggagacagagtcatgagagagataactagtcttttagtagaatattgtacaagctagtgaaagacataaagtacaagttttggacatttttgtctaaaatctatatattagtgatttttttaaaaatcacaaacaacttatacctc

SEQ ID NO: 123340 - DNA, 1032 bp, Homo sapiens
aggcgtgagccactgcacccagccatttttaaacctgcttttctaacttacatttttttctaacttgatttgtttttctcttcttaatccttggactgccgcttctcctcagctttctccccagccctccctgccttctttcctttctccctcttcttcctcctcacctcttattttctccttttccttcacccctgctgtcctcccccactttatatgtagagtttgcatatgagttatttttgttaattacatacttagtccctccaactaggttaaatgcttctagaaaacaggattctgatttttatatatttaagtatctagtatcgtttcatataaaaagttatttataatcatataggccaatagttgaaaatggtttaaagataccatgttttcttttattttagagttaaaaactcaccacttaaacagtctccaggttatcaaacagaactagttattcagttggtttgggtgggtggagaaccaccacaacaaataaccagcctggcagtcaattcttcctatggactgtaagtataagttacgtttttttctaagtctcttcatagtattccatatgtcattttgtttttaaaaatagaaaggatggtctttgttatatcgtcacctaaaatggcattctacaattttgatttcagacgaaattgactgtttatttggaacataatttcattctgaataacttactttgggtatgcatgcagtatttcctgatgtaaagttaaatgcctcatggaccaataaattatttgtgatgaagttttaaagtcagtatatcctctcctaaatatactcccagaaataattttcttattaataattactataatggaaatctaacaatatgaacccagaaaactgttataaaactgatttttgtaaatgttgaagtgtagttgtgtaatttttctttctacttccaattaacttgtataaattgtaaaagcatgacaataattaatattcatttatactgtagtatactgttttatcaattcatgc

SEQ ID NO: 123341 - DNA, 1070 bp, Homo sapiens
acattggttacatgcaaattttatgccattttgtattgaggacttgaacatccgcagattttagtatctgtgggggtcctggaaccaagcttctgaagaaaccaagggacaactgtacatcaaactaacactggctacagtctgagatagtcttctttcatatcttttatttgctgccacacaatgtaagagcacaaactttcttcttttaaatatttattttccacgaccataaagaaaacataggaaataagaaaaagaaccaataggaagtttcaaaggaatctattacagacctcactaggcttacagttgtattttgtttggccctttctgtgtatttttagaattttaattagttaccaagactatataaatccatacttagagctccaacttaaaaatctgattatgtggccgtgtccgtgtttctccatggcagcttcatctggaactgagttgaagcttttcctcattagatgtgccatacaatcttaagtaaccatgatgcttacatgtcctcttttacttagttatatagctctctatacatgtcagttctccattcctggcttaaaagatcttaaaagaataaatttcctttattcatagttgattggtttatagttcctgactcataattgagaaggtatttagaacaccccaaagggcctccaagatgtatgctttctactttttattcttgacttgaatgattaccaaaacttaccccaaagtataatctcctactttcctaatagaagggaatgtctcccacccatgaagagctcaaaatgcccccaaggtagaaaaatagatgttgcgttgtgagatgtgagagatttatatctctgatcaagtttcaactcctatgccaaatatttttataaataatgcagttgattgatttagtgatattaaataatgtctgcagaagatctaaacagttccgtgagtaggcatatgtaacctgtatttcagttcctatagttgtcttttgtttcaaagaattttctgaaagacccaccatgcttctttcttcagccttatagactgtagtacattttttt

SEQ ID NO: 123342 - DNA, 1048 bp, Homo sapiens
tatataaacaaatattttatcaaagattaaatgcatacctataattacatctatcatcttagatctgtaaaaaccaggttttcttccaggaccattagtttgatgaagattttttttaaaactactaattctcaggctgggcatggtggctcacacctgtaatcccagcactttgggaggcctaggtgggtggatcactggaagtcaggagttccagaccaacctggccaacatggtgaaaccccatccctactaaaaatacaaaaaaactagccaggcatggtggggcgcacctgtagtcccagctacttgggaggccgaggcaggagaatcgcttgaacccaggatgcgcaggttgcggtgagccaaaattgcaccactgcactccagcctgggcgacagagggaaactccgtcataaaaaacaaacaaaaaatatgactaattctcattcaagaacttcctatctaatgaaaaaaactaatatgtgcctcaaaatgggaaacttttcttagaagctgaattcagtactcatgttcttaggaaatgttactttgaaagctttctcagtgactgttggaaatgtgacatcatgtcttttaccaaagtaatagaaaagcagatactggtgatacatacacatcctgttcatccatcgatgtgacacctgacttctgaggcttggacatgtaactccttgcccagctagtccaaactcttgatgtgtttttgtttatttataatgtttagacaatttgcaggggtttttataacgtcaatcaccaggcaaatttataacatattgtttactttgtattttatcatagattatatttttatttgttttaactgatgagtgctgtattagtttgaggtattttaatataaaatgtttctatctcaaacccaatgtgcatggtatcagtaccacagtctgttaatttattgggttcttttaaatggacagtagttaaatgtgtactataaataaaagacaaaactgcacttacataaatgtatgggttgatttgttttttgtttttgttttg

SEQ ID NO: 123343 - DNA, 1005 bp, Homo sapiens
acatcagaaacaattgtaagaatgggaaatattgagaagggtattttgttttactccctcacattttagtgtaatattttattatatctaagactgcaaaagcttttatgtttgccttttacaattgcattttcctgatactaactagtcgattatttcttaaagttaaaatgtacctatgcattttctgactttcttgttctttaaacttcatatttaaatttattcattaaactaataaaacatatggaggaattggtcacataattaatacctaataaggtttaacattggtagaattaagtttgaatgaataatatgaagcaggagctgttttctgtctcctaggactgtttatttctgaatttggaatttagaattgtaatatcttttagttcttactttccttctaactacataaaataatgttctgactttctcatcttccccaaaatcggtaaatgcatttgtcaatatgttaaggatataagccagggtgaacaatttggacatggaacatgtgatatattacacttaaatatattaaataccatgggagatgggttttaataagattcagcccaaataaattagtattcctttttatcctgggccagactttcaaaaagtggatacatctagccctttgaaataaacgtgatatttgtagataagtatatatttaaatctaagtatatgaatataaaaagtagccgggcgaggtagcaggcgcctgtagtcccagctactcgggaggctgaggcaggagaatggcgtgaaccccagggggcggagcctgcagtgagccgagatcgcgccactgcactccagcctgggcgacagcgagactacgtctcaaaaaaaaaagaaaaaaagaaaaagtaaataaaggttaaaaaccctgtaaattctcaaaacagagaaactcaaacatggttcagcattttcaaatatattttgctctttggtccatgtgaaaaggaaagtaatagagaagttcatatg

SEQ ID NO: 123344 - DNA, 1202 bp, Homo sapiens
agatcacatttataataaaagatatgttataaattaaagaaatactatgagaaattagaagtttttaaggaaaaaattacccaaaaaatcttaaagaaatgttaggtaagattatatgataatattgggagtcacagccaaaataaaattaaatatttcttacctccataaatttaggtagacatttgaacatatctacaaatataagtattatcttcactattttaaagatcccttattgtacattttaaagatttctatgatatgtagtagaatgaatatatagttttaaactgtcagtctaactctaaaataacaagttttaccagcaaatttatagtacaagatcttggttctgctagagaaaccttattcagttaatactatcaagaattccagattttttcgaagaaacagttaaacactatttatagttttttttaatatattttctaacatctaatataccaagattttgccaaattgttgtagagttaatatttatatataccagggtctaccatgaaagatattgcactacttattactatactgtaatagtataagaactgttatttacttatacatggcctcttcttgtggtcactaacatgataacttgttttgaaagttaccagattttttatttgtacatttttcttgttacagctcagtatttatgactgaccatctacctattccttccgttgtcttcatttgtgtaggttcttcatcaccacacaattcagatgatgaacaaaaaatgaataattttatagaaaagggtatagtatcttgattttaaagtattttcttttatgtttaatttatttagtttactttgactagattttgacattttatatcaaaatattgttttcagtgaagaccaaaagcagaaagttttccaagatggtagccaatgatataggtaggaaatagaaatttctattttgtttctaatccttgctatatgcagtgctaacccaacaccagaattatccagtgcattgcatttttgtgtaaatttgttgttcctatgctaaaaaaataatctcttgggctgtgtctcttctaaactcattggggcaataattattaaaaatcagttcaattgggttgcagttctttctctgacttacagtgtgaatttctctgttaattttatttttgctttactttaaaataaagcagggttcaat

SEQ ID NO: 123345 - DNA, 1050 bp, Homo sapiens
taaatgtactgactaccttcccattttttcttgttttaaatagaatatgtaacatgtaatacttgagcttgactatttgaaagactacattagaaaatttatcagtgttgataatgttattggaaggatagttctttgatgacattcttgctttatttttatcttattggtgagttttactttttgtcactccagtttctgtagttatatattttggggaaagcatgttatgttaacttcattcagcttttcaaaattttggtagtacagttatgcataattatttttaaacctcaggaagcattgttatatcctttggctttgtttgaacctttcagtgtgtttttttaaatcacaagatttgggtatacagaaggaaagttagtgtcacgttttttttcttctttcaaagggagactgccccattttagactgtaaagtttttttgcatttgaaaaactaacacattagtttatctccctacattagtatttagttttgttataagaattagcataaaatatgctattgaaaaacataaaatgtcaatgaaacattggaaaaaaactcatagatcttctgaggacctccctgtcaagactggtattttgtgcatgaagctgtggtgtcaaaagtattaggacttcttgagcattctgaactcaccgtatcatccgatctggtacctgctatgaagtatcctgaacctcatgaacttaccacctcttcttcctcaatatacaagcatttatagcttcaacttataggtagttatacagtggctgggaaaacataagaattagtacctccagggttgcactagtaaaagagccaccttgtgtggaaggtgagtaaatagcttggccctgaaagtttgcccctgagttttacctgttcttcgagagtaactgctgctggtgtcagtttgtgtgtgtgggtgtgtgtgggtgtgttgtgggtgggtggtacaggatggcagtcacaatttaatggttaacccaagcatgggaaatcaaccaccctaccttttttttttaactgcctgacagt

SEQ ID NO: 123346 - DNA, 1003 bp, Homo sapiens
attgtatagatactacttatcagtctaggtatattgcacctatgatatgtgatgaaaatctctggatttttcaatgtgtaatgttgccttttggaggactgttttagagatacaatattttctaattttaagggtattggatttcaagcacaagaacaaccatgtatgtgacatcaactaactgcagatgttatttggccatttcagttttgtattgcattttcttttttaactgaaattttttacgttggtgaaaatggggtgacttttataaatttaacccattcttgtttgctaaaggatactaattaagttaatgaagctgagaagtgaaaatttgatgtcccttccaacccccattccttcccagtctgcctaatgcctctttcctaacactggatttgtcatttttttagatgtggaagtcatgtatgactggatttctctttgtttacatggcgcccttatggactagcagggtctgtgctttaaatatctcctaacagtccaaaatttaacctaatatattcattcctgtattaacaaatgctttttgaaaatttcacataggaagcacttttcttttacgcatgcactaccactaacataatagatatagttgaacaacgcctaactttaaatcactttctagattaagacaataactgattttgaggatggaaagtggattccagtaagtttatacattcattctttttccaagattacagaaaaatgactgtggtttgcatcttatgtaaataccgtagttttagattatgcatgatcttattttgtttttcactaaaatgtaaatagaagagttaacttatatcaaggagtggttgagtcagatattgtataatgtaatcaaatacttaaatttgattagatataagtttggcctataagctagaaattaaaaagtaatgaacccagccaggcacggtgggtcactcctgtaatcccagcacttcgggaggccgaagcgagtggatcactt

SEQ ID NO: 123347 - DNA, 1048 bp, Homo sapiens
ccttaccagtaacataaacagtagattaacacatattttgtatgttagatgtgttatatactgtattcatgtaataaagtaggctagagaaaagaatgttattaagaaaatcataaggaagagaaaacgtatttactattccttaagtggaagtggatcatcccaaaggtggtttttccatagagtagactgaagagaaagagaaagagggaggggttggtcttgctgtctcaggggtagcagaggtggaggaaaatccatgtgtaagtggacttgtgtagttcaaacccatgttgttcaaggatcaactaaaatgaagtgaatattaaatatgacgtaggttttgtcttcttgcagattaactatttgaccaaatttatattaaaaaacaacacaaataacttcttttataacttgagcaatctcacaacatttttaaccatttcagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtatgtattgctgctgcacttagagttacattacaggtgtgatttactatgatagaagcctttgtttttcattcttgaattgatctaagaattccaaaatgtaaagtaaatggggacagtgatggccttatttatttatttttttaattattatactttaagttttagggtacatgtgcacaatgtgcaggttagttacatatgtatacatatgacatgctgatgctctgcacccactaactcgtcatctagcattaggtatatctcccaatgctatccctcccccctccccccaccccacaacagttcctagagtgtgatgttccccttcccgtgtccatgtgttctcattgttcagtt

SEQ ID NO: 123348 - DNA, 1052 bp, Homo sapiens
ttggtatgtattctttatttagcaaagttgtaatgcacagatttgacaaatttaaagattttttcccctagaatataatgtaactttataataagactagagatgtacctactgcatttgatacccaaaatgtatcattttttaataccttcacttttatatgaaaatttactttaagtaatagtcatgtaataatacacagtaattattattgtcctcattccttctttagttttaaagcatttaataattaaacacaggaataccttttaaagtattaaaatttagtaaaaatatttcatctgcaaaacagaatttgcatttaccaaactcaagcattataccttgcagtttgtattgtttcactgttttaatttttcaacacaaataaaaacttcaagtggtcacataagaataaaagaactaaagtatctcaaattttgtttgctcatttttatatatcatggtgttattgtttatttcaaattgactgtttaactcaagaatatgtagtctcatggggaagatggggcagctttacaaacttactcttgaaaaggactctttagtcaagtatgtgggttgggggcctctgaattaacttccatgtagaatacaatgcttattaaaggacacgtaagatgctaatttgaagcttatacaaaccatgaaaacttaacatgcagcaattagcatcgaggccaacaaaagactttttcaaggtgaagtgtttaacactgacattgtttaaaattgtcagcaggacattttcataataaaaagttttgtttttaaggactcccttattcttacaactgaagtgacccttccctctgcctggtccttgaaacgtgatcactttaagagaagtttatttcttctgtacagtggtgccaatgactgtctcacagagctgtagtatcaattaaatgagataatacttatgaagttgctttgtaaaattctaagagaactttatagtttttttttttttttttggagatagagtctcgctctgttgcccaggctggagtgcagaggcaccatcttgg

SEQ ID NO: 123349 - DNA, 1035 bp, Homo sapiens
aggcacctgtaatctcagctactcaggaggctgaggcaggagaattgcttgaacctgggaggtggaggttgcagtgagctaagatcatgccattgcaccccagcctgagtgacaagagcaaaactccacctcagaaaaagaaaatcataaagaatagaaaatacatttattactcattaagtaaaaatagatcatcataaggttctttattctgtcatcttcatgttgagtggctgaagggaggaagaaacatttaaaacatagaacaggccagaaatggtgactgaatagatgcaggggatgatcaagatgaggttaagttttctggtttaattaattgtgcagttggtgaaaccattcaccaagatttggagcttgaaagaggggggtttgaagggggtggctgatgaagcaatcaggtttggatgggttgagtccgagtttcaggtgccagtgggacattcaagtggaaatttccagaagtcatttggagaggtttgatgctctagggagcaacttaggctggatagatgattataagtggtagatagtgagggaaaatatggaagaggatgagttggccacagtagggtgtgtattaagaagcagcacaaacactttgagagtattagttccagacattgtgagttgctaaaagcagccttcattagggcttcttgatgccctggcaagatgtcactctgaacagatagaatatcagcacccttcagaattcaccttccaagaggaaatttaggcaacttgagaggcatcgctcactgaataactcacaccctcttctgaaaatgtagcctttgagcttatctcagtaaaagataatgcctctacaatttaggtaacagagtgttgatgttcactcaaacccgttcttctgttggaccactacaagagattaagtaaattgatcaaggttacgtgacagaatttgaacccaggtctgtaggtcttgacttcaacccatgatcagttaggttgatcctgttagtggggagacttccctctaaggccagctgt

SEQ ID NO: 123350 - DNA, 1028 bp, Homo sapiens
ccacatatgtctactcatgatatgtgatgcctcctaatcataaggtcctctgtgctaagtatcattgtctgtgccctacagctggtagtgtatagtaaataaacacacacttccagtttaaaacattctggagccaaaaagttggaaataggcttcacctatgtaagtgaaacctgcaagatttgcaagattctgcaaaaattcttccagagcctttactatgctaatatgtatcaaaaacctccattagggaagtaaaatatattgcttcccaaacttatttcacctaacttatttcttttcttctgggcatctgttgaggccagtgttccatgaatcatattctttcttactttagagtgaactgatgagaatcagtggcaggtatgtcaagacttattcacacagagtgttgggtttcaccatatatgatagacacagactgtgatgtgtgtgtgtgtgtatgtgtgtaggtacatgtaggtatataagtgtgtgtatatgtatgtacatgtaggtatataagtgtgtgtgtgtgtgtgtgtgtgtgtgtgtgtgtgtgtgtgtgtgtcatagaaagagggagagagatagagagggcaaagaaaaggggaaaaaaaggaaagatgaattggccccggatcaggccacctgattgtttgaacctaggatttatataacagctgcatagatgtaacacatttgcaggctttgcctctttattccaatagtaatttagcagctttgcaattctaagtattgacatgtaatacattttgtgtgaattaatgaatgcatgaatgaatgcctcaaaggtccccgttgttgtgatgctttcctgacattttctgaaatggctttgaataagggtttttcttggggagccatggatgccaactgaggacgattattatgaatatttgcaaagctgagccttcaatgtccacttcaggggtattttaaggcaaaaggaaaaagaaaactctctttcattttgttttgctgacacctaatatgttttgagtaaa

SEQ ID NO: 123351 - DNA, 1095 bp, Homo sapiens
ccacctcaacatctgcatatatgattaaaacaatattattgccatatcaatggaaatataaaacatgaaataaattctcctataatcttaccaccctgacataaatgctaccttcacagcctctgttcatatgtactctgtaacattatattaacttttagaaaactttttctgatcaacagcaatttatcccatagggagatatcttcaaaattgaggaggaggacattcttagttgaatatgaaaaaagaagagcactctaaaatctatggcacatcatggggaggaaataaattagattgcaacagcttctgaaagggacacacattttccttatcgctagtgtggctcttggaaggtctttcatttgccagccaactctatatggattaggtcctctgatctttacatcctcaccctcaaaggaaagaagcaggtgatgatataagcatatagggcatcagtgatattttatatttttctttaaatgccacctcttcccaggtccgtagcagggagagatatcatttaaagttgacaccgcagttcctctggccactgaatcatgaccttctgacctgggagctagcctgaatctataggatttatcaagaagaccttaatattgcagaatggcagtcctcaccaatcatttgttcaccatctctcttttcttgttctatcctcattattagaagagtcattattttaagccattcagttgcctcaggaactgtaaagtaaccctagtgataattctccatggcacttagaaccacatagtgttcccctgatcatttggcctaacttactcagaaaatgaaatttacaaatttttttgattcccaaggttttgcgctacaaaggctgttgccatctgttttcttgtctaagaattgtaatcaaactggaaaaccaccaggatgtattttatttattgacaggctaacctcctgcatatttataagatgtaggttacgaatgtgtgcaaactgaccaaaaatgtgatataaactgttttatatggtgggaagtgctcacattttttttagaattctaaaactggagagactcttagttattctattgcccaa

SEQ ID NO: 123352 - DNA, 1049 bp, Homo sapiens
aaaactccgtctcaaaaataaataaataaataaataaacaaactaattttaaagtacagaggtgcctggaatcaaacacattctcatctcctttaccttacccattgttgaactgggagaagaatagttgccatcatctctttctttctctctgtgtgtgtgtgtgtatatatatatatatatatatatactcctgaggtcaggagttcgaatatatacacacacacatatatatatacacacacacagtatataaatacatacacacagaaatacataaacacagaaattatatatatatatacacagtgtgtatatatatatttctccgtgtgtgtgtgtgtgtgtatatatatacacacacatctaatgtaccctatatatatatgatttctgcgtgtgtgtgtgtgtgtgtatgtgtgcataatttctgcagcatggagatattttatatacgtttgagaataaagcagcatgaagtaacaaaaacagcagagatttaaaatttccagctctaactctttaacacaagtatcatggcaaatcctagaaaatcagaagagtggttttggattccaaagatcccttctaatgttaaaatggtaggcaattacttaccttctctacctctcacttagtctctattaaccaaggtcataatattactagttttttttttttttttttttttttttttttgagacggagtcttgctctgtcgcccaggctggagtgcagtggcgggatctcggctcactccaagctccacctcccaggttcacgccattctcctgctgcctcccgagtagctgggactacaggcgcccgccaccacgcccggctaattttttgtatttttagtagagacggggtttcaccatgttagccaggatggtctcgatctcctgatctcatgatctgcctgcctcggcctcccaaagtgctgggattacaggcgtgagccgccacgcccggcctattactagcttcttaagggtcttgtaaatgatgaaatttttgattaaataagaaataacatgaaaattatt

SEQ ID NO: 123353 - DNA, 1906 bp, Homo sapiens
ttttaacctgctcagggttgaataccttggggaagtaatagatttgctttggtggagctgtagttaggcaggtagactggaatcagatgggcgaggtttattacagtcagacatcttaatccatacataaaagacaactttagtttaaagacttggaatggccagatgtgcagattatcagaaaagtctctagatttgctttgagatcttatattttttgagtgggaggagatggagtgaaagttcttctttgggaatgataaaccgtgtacagtttttagcacagtgattaaactcttgggcttcaaagtaagttatactaggtcaaatgccagctctccaattgactgtttacatgatcttggccaagtcattcaacctctctgatcctcagtttcatcacctgaaaattgaagaaaagaagacttgcttcttggggtttctgagatttagctgggttgatgtgtgtatcaagtactcagcagactgtatagcatatagtagaggctcaataagtgtagctgtctttcaggttttatttgtttcctgcaaagtctcctgtctcttccttctggacatcctaaaagcccagttactccattttcaggtgaccattggtatttatgattcttactatacagagaaccagcgagcgttggttaaagatttctatctgctcttgtcactctccagtattgaaaaatgtatataaatatgcatgcaatgtatatttacatactatatatagcacatgtatataatatacctaaatctaatatatattttagatttaaaaggttttgtttttgcattttctgaagtatacagatgaatatgatccttcactgaagttccagaaaacctaatggacattttaaagttgtgataaactttttcttttcttttttttttttttttttgagacgaagtcttgctccgtcgcccaggctggggtgcagtggcacgagctcagctcactgcaacctccgcctcctgagttcaagcaattttcctgcctcagcctcctgagtagctgggattacaggcgcgcaacaccacacccggctgatttttgtatttttagtagagacggggtttcaccatgttagccaggctggtctcgaactcctgaccttgtgatctgcccacctcggcctcccaaagtgctgggattacaggcgtgagccaccgcgcccgatagactgtttttaagttatcctgttatttcttgtctagatccagttctaagttttcagtcactgaggaaattggtttgataatatcccattgtatcccttactctagggcgttgggctgggggcggggaggattgggggcctgtttaaatgaaacttgggctgagggttcttttggggaagagggttggccagtggcattttctgcagatttgctttcccttccctgacagattccagcactgttgggtcagttgtagtggagtgttctttggctgagttaaaagatggggtggggcttcagaagctcaaacctgctattgaaagggcagatgcaggagcaaagaaaatatgtacttcagctaatcattcaggatcaggctgggaagaacgtaaagcctgtcccagacaggttgtgtttgctcatgttttcctcttgtttatctggggtaaacaggcatggagattgttccttagtaaaattcagaggaagacatggcttactgctcctttgtagatgtcttgcagggagacaccaggctaaaagggagggaaagctgtcatccaagtgtttatacaaactgagtcttcggggaaatacatcaagacacaaaattaacagttgactttattctcactgaaacaagagacaccatttccttccttttttatttaaaatataagattttgcaatcatctatcaatctaga

SEQ ID NO: 123354 - DNA, 1026 bp, Homo sapiens
cacagagataacctatcttgtatctttcctgccatgtcaagtcatgtaatacagacatctccatcctggagactgggtatccaggcattatggtaactctgagactcagaagacaaacgcttgagaaagggctagtatttcctttctgcgatagtagtttttttttttttttttttttttctgaaaggctcttctatggctttcaagatgattggtgaaaatggaaatatatttgtatttatgtttgtttttcaagatgattggtgaaaacggaaatatatttgtatttatgtttgctcttcagactaatgttctctgtgttcacagagatacattgcagttctccttgggtgtctgatgcaagttccattcatggttgattttgatgtttcattcactatttgctagattccttttgcagcaagtagtgagtgaggaagtttccatgtgtccacccatcactctgcctggttgtggcttccttctttctcctagcatgaggtagtaagaaagaaaataaaagcattataagaatcacatgatttttaagtaaagagccattgaggagcagaataaaaaatcttgggatatgccctgagccctagttactcaccgctttttttttttttttttttaactgcccttaatctagtaggacctagtttcctttaaaatgtatcctaagcacccttgactttgttgactttaataataattttgtattggtcttgctgtcagccaacaattgtttttaacctagagctaaaacatgtttatgtgtgtgtgtgctttaaaaatttagtgtttcaacattaaattatttgtagaggaaaggaatactctagttcaagaatatgtatctttgctataggagtttgtctttgtctgttttcataggattttaaggacctcctttgtgaaataaaccattaacaactttgtagcattccttgtttggaaatgcccagtcttttaaaaaaaaagttttgaaagagaagagtaacaaccttaatctgtgagttaaaa

SEQ ID NO: 123355 - DNA, 1886 bp, Homo sapiens
ttttcttgctgatttgtttgagttccttgtagattctggatattagttctttgttgggtgtatagtttgcgaaaattttctcccactctgtgggttgtctgtttactctgctgattatttcttttgctgtgcacatatgctgattggatttatgccctcagagctactagaaacttcctgttgttggcatcctttggccatgtaaataatgtagggttcctggtttccttttaaacacacccacattttattcaataaccataattcaacaattgctggctgactttggcttctgcagattttagacttccaaactcatctgttttacctgtaaaacaggtaaaatactgagcttatatatctttgcacactgccccacagggtggaccagacccagatggatttggcctctgctctttgagcagagtttgatggtaaagccagaaagtctcccacagtctgggttttcccagtttccacccaggctccctggatcctggtgtcttggatgccagtgtgggtcagtgtggcaaacacctaaggctttgcatttgcaggtccatcaattccaaggtggtggagagaagcacagactcctactcctcattgtaaccagcttgagacaggctccagaacagcacccatgactgtccactttgttctttattgtagaaaatagaaaggcctacttccacgacatcgggaaagtcagcctcctgttgtcacctaaaagattttcggccaggcacagtggctcacacctgtgatcccagcattttgggagactgaggtagatggatcacctgaggtcaggcgttcgagaccaacctgaccaatatgatgaaaccccgtctctactaaaaatacaaaaattagcccggtgtggtggcatgtgcctgtaatcccagctactcgggagggtgcgacaggagaatcgcttgaacctgggaggcggaggttgcagtgagctgagattgcaccgcagcactccagactgggcaacaagagcaaaactccgtctcaaaaaaaaaaaaaaaaaaaaaaaaattcaagctgcagagcagttaggttttatcttaggtttggctttaaaaaaaaaatcaagatttgaagacacataaacctgttatttgtacacctgcagacagacttgcagacaagtttgagtatgttctatttcaagtcttgatgtataaagaagataatccagggcgagagttgctcaaggactgtaggtcaccgatggctcccaaggatcagccagagaccaatgagcaagtgaaagcagattggtttgaatcttgcatttgctggttggctcaagagaagtaagcactgaattatgcaatgcagttggcagggaggattgaagcggctcggagtgttgttttggcagaaaaactacttagcaaaatgaatgaggggagggaatagtgacacactaccttctggggtcccaggagggtctgtttcaaaataatttttatggaggcagagagaagcacactgatattgtaccagtgccttggttgtgacagatagtcactgttgtacaactagggatatggccagactcttaactatcttttaaaactagaagtgattacctttattgttttgcgttaaatttaagtcacccctccttagatgcttggttggttctttggtttcctgtttcctaatgccatgtttttgttttttttttttttttttttgagacggagtctcccttcatcaccgaggctggagtgcagtggcgtgatctcggctcactgcaagctccgcctcccgggttcacgccattctcctgcctcagcctcccgagtagctgggactacaagcacccatcaccacacccggctaattttttgtatttttagtagaga

SEQ ID NO: 123356 - DNA, 1046 bp, Homo sapiens
gtgaggtgagggtgagggtgtggtcgtatgaggaaacggaggcttaggaatgctttccatctttgttttaaaatagtggaattgagcctgggtaacatagtgagaccccttctctacaaaaaataaaaaattagtcaggtgtggtggcgtgtgactgtagtcccagctacttggaaggatgaagcaggaggatcaccttagcccaggaggttgaggctgcagtgagccatgattgtgccactgcactccagcccgggaaacagagcaagaccttgcctcaaaaatacatacatacatacaagtagtggaattgagttaaagtttcctaaagaagataatacctctttgttttcctctttgaatctcaactgctacctatcccaactgccacccaggacagagctgggagagagggtgtggagagaaagttgtagtgcagcatagaagtcttattggtgcagggattcctgaagtggcttcttaggtctgggcagatatgctgatgtggggcagggaccctggccaagggttttgggcatgggctgcatggctgcaaaggaaccttggtggtgatatccataaacacagggctgccctgcctcaccccttggcctcaccctttgaattccctgtcctcaatcctttgaatgcaacatcagatgaatcacggtgttctggaggacgtggcggtggatagtgttagggacggagtgattgaggctcttctttattttttttatttatttatttttttgtagagacagggtttcaccatgttgcccagactggcctcaaactcctgggctccaatgatgcgcctgcctgggcctcccaacacttcttttttttttgagatggagtcttggtctgttgccaaggctggagtgcagtggcacgatcttcgctcactgcaacctgcacctcccagattcaagcaattctctgcctcagcctcctgagtagctgggattacaggcgcccgccaccacacccggctaattttctgtatttttagtagggacggggtttcaccatcttggccatgc

SEQ ID NO: 123357 - DNA, 1017 bp, Homo sapiens
ccaccacgcccggccgattgaggctcttcttaacctctgcttcagacccctcctggtaccacctcactccctggtctttgaggctgtgtaagatgtgcaggcatcttacaagatttggagagtcagaaatcactccttgctggattgctgagggttagcaatgaaagtaaaagaggatatggagaaaatggaaaccacttataggatattttattccctgtggattctataatggacattttaattaaactctaatgggacatacattctaaaaagttctgatccctgaataaattaatattaatgcccaccattcattcagagtaaatgcattgagagaaatgtcctcaccaagtaatataaaaatggagagttagaaaaataaaatttcccagctcatcggcagcccatcctgttggtaaaggactgctccctctggtccattactgcccattacttcctccagctccacgtcaatgactcatgccaaaacctccatcacttccctttggagattattacacagcccagcagacatcctattaagaaacttcttattagcagaggaaaaggaaagttttcacgttgagatcgagaaggaagatgattcatggtcacgaagggaaaggtcccctgaagtcttgagagatggctcaccactgctccactttcctttggggacacacacactcaccattagctgtgggaagtcgatggggtgtgtggagaggaccatactcaattaaaagaatgacagtggaatcagtaattttgaatcaagctcagcgatggattacaaaagcaagagtgtagactcctaactaatgtagggtggaagttgaaacgtgaaagttgcctgtcctgagcacgtttagagttcacaattcaatattcaagaagaacgtaaggctagcagttgctatagttgggacaggaaatgactcaagtccaaaaggaaggtttctgtagatacaaggtcaagatgagaataggttctgccacgggaaatgggaagaa

SEQ ID NO: 123358 - DNA, 2466 bp, Homo sapiens
aaaaatacaaaaattagccaggcatggtggtatgtgcctgtaatcccagctacttgagaggctgaggcaggagaatcacttgaacctgagaggcggaggttgcagtgagctgagatcgtgccactgcactccagcctgggcaccaaagtgagactctgtcacaaaaaaaaaaaagaaaggagaggaaaaagaaaattttcccttcaagtatttcactgtgtcaggtactttgtgatcaagctagctcccagctgtcatgcctcattatcatatgatttacaacccatgattgcttttttaaatcgtatggtctgttgacattgcaaaatcagtatttctcttctttgcacattctttagcacctactatttgtatcagtcatttgacatttacagtatttaggaagcctgatggccattttttgttttattggatcaaattcttttactatcttttttttttttttaactgagacatcttgcagggcacagagttctctgcaaagatattgttggttctcctggtagaggtgatgaggagggggtcatactgaagtacatctcattcttgcccacctcatgaccatatttccctttaagaattcaaatgatgcatcctccatgatcgatccttaagcacctttgatgtcttgctctcccttgctgaaatggctcacataatgggagctttaactgaaggagagatggagctaggaatataaagatcatttttgcctgggtgtagtggctcatccctataatcccagccctttgggaggctgaggtgggtggatcgttgagctcaggagttcgagaccagcttgcacaacatgatgaaaccccatgtctacaaaaaaaaaatacaaaaattagccgggcagggtagctcgtgcctgtaatcccagcactttgggaggccaaggcaggcagatcacctgaggtcaggagtttgagaccagcctggccaaagtggtgaaacctcatctctactaaaaacacaaaaattagccaggcgtggtggcgtgcgcctgtaatcccagctactcaggaggctgagacaggagaattgcttgaacctgggaggtggaggttgcggtgagccgaggtggcaccactgcactccagcctgggggatagagtgaaactctgtctcaaaaaagaaaagaaaaaaaaaaattagccaggcatggtagcgctgcctgtatttccaactacttggagggctgaggtgggaagattgcttgagcctgggacattgtggctgcagtgagctgtgttcgcgccactgcagtccagcctgggcaaaagagggagagcctgtctcaaaaacacaaaccaaaaaaaacccatagagatcatttttgagaagaagtttaagaaaggtagacactgtgctgaggaacttagttgctaagatatagacacaagaaaatattggatacttggaaggagacgagcagacaacagaacaagaagaacttcatttaaagtcttgtccggacttggtggggcgatggtgcatttctggtgtctgacttgcaatgtctggatcctgagtataagctcggcaagcatttaggtttgggcctgaattttgtcatttgtaaaactaaaagaaaatagggattccatttgttttgtttgtttgtttgtttgagatggagtattgttcttgttgcccaggctggagtgcaatggtgcgatctcagctcactgcaacctctgcctcccaggttcaagcgattctcctgcctcagcctcctgagtagctgggattacaggtacgggccaccaagcccgcgtaatttttgtatttttggcagagacggggtttcaccgtattggtcaggctggtctcaaactcctgacctcctgatcctgcccgtctgcctcccaaagtgctgggattacaggcataagccaaggattccatttggatacgcttctgcaagtaatttcccttccttctcatcatctttgggttctgatggattctgtaactagtgggtagcttttttttttttttttttaagactgagtcttgctctgttgcccaggctggagtgcaatggcgtgatctctgctcactgcaacctctgcctcccaggcgcctgccaccatacctggctaatttttgtatttttagtggaggcagggtttcaccacattggccaggctggtctcgaactcctgacctcaggtgatccaccttcctcggcctcccaaagtgcggggattacaggcgtgagccaccgcacctggccacagtgtatctttttgttattgtattaggttggtgcaaaagtaatcgcggtttataattatgcttccttaagctaaaaacttaggtgagaacacacctcagtccttttagcaatcctcagttgagtctgaccatgcacattcttacttacaagttttagttgtctgagccaccgcttagcttggtttttagttgcatggctgc

SEQ ID NO: 123359 - DNA, 1025 bp, Homo sapiens
aaaaaaaaaaaaaaaggaaagaaaaacccaacccaaaccagcaaaaacaaaaatccaaccacctcctcaaaaaaaattctcaaaatagataatttgttaataacaaatagcatttttctcttttgtaagtggaaggcagaggtgaggaaggatagaaggatagatcaagtgaaagtgacctttcgaatgtccctgtctacacaaagtattctgtggccttttaagtctatctgtacatcttttattaaaaaacaaattgtgatatatagacaaaacccaagacaactctaaaaaacaagtaggtaattaactatcactggagatttaaagatggttggcaagatttggaatcaggaggaaatttacacagaactggtgtgtggaaagttttgaaatactggtcccagcatctagtccttgagtcatccctatgttaacacactaggttgaaatatctcaatttcaggtttttccttttcttgtctcttaacagtgccatcttggttttctcctattaaattctctctttgctttggagtctcatgctttttcaaaaatatattctgacctggccaggtgcggtggctcacgcctgtaatcccagcactttgggaagccaaggtgggcagatcacgaggtcaggagatcgagaccatcctggctaacacagtgaaaccctgtgtctactaaaaatacaaaaaactagctgggcgtggtgacgggcgcctgtagtcccagctactcgggaggctgaggcaggagaatgaagtgaacccgggaggcggagcttgcagtgagccgagatcacaccactgtacttcagcctgggcaactgagtgagactctgtctcaaaaaaacaaaagacaaaacaaaaaaaccctacaaaaatatattctgacctaataagggtctcattttttcaaaaatatgtactgactttataaggtattctcaaatgaggactaatacatgttttttatgtaagaagtgaaacgctgtcatgaaaacacaattggtgaaggat

SEQ ID NO: 123360 - DNA, 1029 bp, Homo sapiens
tagttgagcatgatggtgtgcacctgtaatcgcagctgcctgggtggctgaggcaggagaattgcttgaacctgggagacggaggttgcactaagctgagatggtgctgttgtactctgcactccagcctgggtgacagagtgagactccgtctcaaaaacaacaacaaggacaacaacaaaaaacagttgaactgctgtgctctgagaatggaaacacacggtccatcctgacagaatcaactaggcgtcttgacagtacattgaattttttgcaggctttcttcccataatgtgtcaaacaattaaaataaaaatacttgtatccacatcccagagaagaaagtgaaattacccctttttatagggcaatcgagaagcataaacaagtttgggtaggtgataggcatgccttaactagttcatttccttttaagggattgtttcattgtaaatccaggaatatgaatgggaaggaggggagtaggaatgtccaagcaaacattgaccagtaaaactgttagccaagatgaactgataaaaatgttaattcttcaatgaaatgaattgctctttcaaaaaattatgtattagatgtcagtgaaaaagccagtggtgatgttaataaattctcaccttgtaagcaaactgagaaaatgggtattttcattctcacagtaactgggttaggagaatgatgtgaattcgttgcagcttttttagttctcttaggcagaaatgactgtcaagtttacattgtaaccctgtgtagaatgtgacacaaagcaaataatctccactctcactcttaacttccaagatattgttcttttcaaacttaaattttattgtgtgtatttgaggtttacagcattttttttgggggggggggagatggagtctcactcttgtcacccaggctggagtgcagtggtgcgatctcagctcactgcaacctccgtcttctgggttcaagcgatctcctgcctcagcctcctgagtacctgggattacaggtgcttgccaccat

SEQ ID NO: 123361 - DNA, 1033 bp, Homo sapiens
atctacattatttaaatttcctgcagactcatgttgcaagtatttttagtaaaattaaatatttttatggagtaggtctgtagctatctcaaggaataagctgaataaaaataatgcaaacactgtcagtcctgaaagagcatggctttttaaaaactgctttattgaggtatgcttgataagtgaaaagctgtgcattttgaatgtatacaattcgatgagtttgggaataagtatatgccataccatcaacatcataaacatatccatcattcccagagtttcctcccacccccatataacatagaaatgatgattattcttattatttcattttttaaagcctgaattttgagtgggtaaagataatcatcaggtagttggttggtttcattgattggaatgtaaaagattctttttgtgggatggcagacaagacccactcttaaaaacacacatatacattcttctattctgttgcctttcttggcatttaaatcatcaggactgatgaaagtggtaattatggggacttactgcacatctggaaagtaatttgggaagatgtaaaagcagctgtgccacccttttctaattattatctggagtgaggagtggctattatggcatgttgtagggtgtgaaatgctggctttctttggcctgagttgatttgaacagctgctcttttcctcaggagcaacaaatatatttttcaggtccccaagttattgggggagttttgagtgattgggaatgggatagagaatttcactcgtaggaaaaacagaactgaagtgaagagttggcttgttgttggttttatgatattgtgaaatacatatttggtcttaatcttgttttccggcaaactcctaaaacccttggaacctccaaagtgataagtgtatttttttgtatgttaatgagttgactgatggctggccactctaggtagcttcagaatggaagctggtcacaggaaagacccgggctggattagagggttgggacatttagccccacctcccaa

SEQ ID NO: 123362 - DNA, 1048 bp, Homo sapiens
attgggcattaggagcctcttcctcacacagtgcctttgctgaaggtgcttccctggtgtttcctctcttagccctgctaggcaggcagagagatggggattgaagactttggtgttggcaccagaccgtccgaggttggagagctggcctctgtgcttcttagtcctgggatttgtgggcagtcgctcaacttctttgagctcctgtttacccatcaatataagtgggaaaaaacaggcccctgtcagagggctgtcctgagggttaggagatcctgcatgtaaaacaacctggcacttgatgtttcccacttaaataccaacctttattactattaactctgcgtagagggaggtccgatggctgtgggcttttccagggtggactgacctgaccgcctttgtttgtccaccccttcaggacggttcactgggaaacatcgatgacctggcgcagcagtatgcagattattacaacacctgtttctccgacgtgtgcgagaggatggaggagctgcggaaacggcgggtttcccaggacctggaagtggtgagtgggggtcctgggaatatgcttctgtgagcagagctgctccaatttgggcttttccttggtctttatcccagtgctagctcttcctggggtatcaatctgtaggctgctgcactagtgtggggtagaatgttcaggtccctaaaagactggcccagttctgccgcagatatcaaactgagtgagtgttggctggagcaataggatcgaacctttgcactcattaaaagaacagatttggccgggcgctgtggctcacgcctgtaatcccagcactttgagaggcccaggcgggcggatcacgaggtcaggagatcaagaccatcctcgctaacacggtgaaaccccgtctctactaaaaatagaaaaaaaattagccgggcgtggtgatgggtgcctgtagtcccagctactcgggaggctgaggcaggagactggcgtgaacctgggtggcagagcttgcagtgagccaagatcacgccactgcactccagc

SEQ ID NO: 123363 - DNA, 1032 bp, Homo sapiens
tgttgaccgctgggccaaggtgaacttgttcttgctttgcctgtggcttcacgcagacatgcgcacatagtccagtctgtgtgggtttttgtttggtttcactgactgctcttttgttatttgctacagacagcaaagcatatgggaaacaggtttcctgttgtacatttgagcttcctgaatattcaagaaaatgatcaggaaagtgagactctgcccagctcagtctacaaggtcaccattgtttttaaggaacacaggtctgcccccagagcatagaaacacagaagacttatgtcgtccctgaattcttattcttatccccataggataagaatgagaactgtgccgcacactatcctgagttatcctgctgaagccccgttgtttctctaaatggcattagtttttgttctgtttccttttgtcttcacttacattatttgctagctttgggctacagctgatttgaagatggtgatcagtatctgtgggcattagatggtgagtctgaactccattctgctgtgggattcacacacttgatgtcaaatacactgaagcattatatcttaagccagatggtaatacagttctgtgctctggcctctctcagacaaagtcacatttgtaatcaaatgccctgttccaatttagtcagcattttttgcacatggcactatgggaacgtggacatcaacagatctcttggtgccagatttgatcttggcattctgtacctttggtaattaagaaggcttttcttttttattaaccctgcagtcagttcaggtgtttccaaccttacacttaggcactagacacctttgcagactgtttgtgcacttgcggaaaccaccgggttggctgtgttgtgcatgacagtctaagagtagagagagcttcagatttttcaaatgtgcatcaacaatttcagcttcttttttttttttttttttttttttttgagtttcactcttgtctgccaggctggggttcagtggcgtgatctcggctcactggaacctccac

SEQ ID NO: 123364 - DNA, 1006 bp, Homo sapiens
gatgaggtttcaccatgttggctaggctggtcttgaattcctgacctcaggtgagccacccgcgtcagccccccaaaatgctaggattacagaatttcagcttctttttctcttgctcctgaacatttagaaatggtttttgtttgcttgctttaataaaaagtagtacacctgagggcttaaacaccaaactagcatactacttcaatactagtacttgccaaaaaggaaaaagtctgagctttgttgtttccatttgcatacaacagacagcattcctaaatgttgaggaaattgacactaactggggagaagagttaggaactcaggtaaaagtggccactttgatggcggaacctagcaggtatccagggtttggccagggcttggccagggcttgggagggaaaggagcatccctgtttttggagtcaggaccattcagggggtgaacgaggcccaggccaggtgcctttttggagcctggaatattaaaaccaggatgccaaaattgtagtgtgatctcagtctttacatttaacaattatatacatttttaacatggaagattacagtataatttatttaggctaatcagaagctaattataggctatttaaaaatgttaatttgtagcacactagaggcagtatgatctgaagtgagacaaaatgtaaaggagtgcagtgaatgtttgcttatttccaggccctcagagtgggtttctgtagctggatctatgtcatttagcggtgatgtcaacagtctacatttgagactgtaggagatgactgagtggtccaagccaagtggcccacctattctgcagaaccctgtgtggggcctgaggcagtttggcatctggaatggaattaggcagacacctgcagggcccagcctggtagtcagctgaggcagggccctgagcctatgctggtgttgtcacacactacacctgacattgtcctcctgacgcacgcagtccatattttagactgatctctcac

SEQ ID NO: 123365 - DNA, 2051 bp, Homo sapiens
gagagaactgagctctgggctgggcctggtggctcatgcctgtaatcccagcactttgggaggcagaggcaggtggatcctttgagcctaggagtttgagaccagcctgggtaacatggcaaaaccctgtctctacaaaaaaatacaaaaataaacagggcgtggtggcacacacctattgtcccagccactgggaagcctgaagtgggaggatcacttaaacccgggaagttgaggctgcagtgagccatgatagcgccactacactgcagcctgggcgacagagtgagactttgtctgggggaaaaagaaagagaattaagctctgagctgtggatcaccatgtgtatcagtgggaggtttctctcgctccctctcattagaagaccattgcccccattccagcagtatgtttgcatttgggattgtcttttctttcggtttggaagttttaagaattttaagttgaagaaaacaagatggtaaaatgttgagcaaatttgtttggtgttggccaggtgtggtggctcatgactgtaatcccagcactttgggaggccaaggctggtggatcgcttgagtttaggagtttgagactggcctgggcaacatggtgaaatcccacctctaccaaaaacacccagaaaacaaaaacgagctgggaatggtggcgcatgcctgtagtcacagctacttcggaggttaaggtgggaggatggcttgagcttaggaggcagaggttgcagtgagccgagattgcaccactgcaattcagcctgggcaacagaatgagaccctatctcaaaaaaaaaaaaaaaaattgatgcggtcacatcagttatcctgacttttcaactattcaatatcaggaaggacacacactagctcatggggtaactttggaaaatacatctcaatacaccccagagcacagctcatacctttcccttagtgtttcactgcacttctcaaaaaagaaaattaagttgttgcttttttttctcccttgacaggtcaatctgtgtattagaaatggagacttaatttaccaactctagaatggtattaagaatctaagttcaggagtaagccactgctcctgtctctggccattctgagacctgtgcataagtaatttatgtataaggcatagtttgagagactggagcaattatttagaatatgaagacgttctaaatttgtgctacagcaatgtcatccatctcatgggccccagcagaagctgatgaaacttaatcaaaaataaatcaagagcaagtccaaaccaaattggaagcacatcatgaatattcgtgaacatctggatgtgtgtgtgggggggtgtatgtttttttttagtgtgtgcaacagcagagacatgatttcttaacaaagatgccaaaaggaagacagattttcatctgtgatttcaaagggtgtctttgtttgtatgtgtgtgtcctttctccttagggtgtgggtttcttttctccgagatattcctttgatctctttcatctttcgggatctgtttgggtattttatctgaattcttcattggagtcagtcattttgattcatgaagattaaacatttccttctaaaggagaatttcaacttaaggaaagttttactatttaatatttttgatgaatcttttcaatgctagcgatgtgataattatcaattaagctattctgcatcattgatcatcagtttcacttcacatgtctaaacctcagggtacggtactttatctgccttgctacctaaagtactgccaaaaactaaagaggaaaaaacaaagtatgggaaggcggtaataacaaccatgctgataattatcacaaaaatgactttttgtttgtttgtttttttgtttaagagtcttgctctgtcacccaggctggagtgaagtggtgcgatctcagctcactgcaacctctgcctcccgggttaagtgattctcctgcctcagcctcccaagtagctaggattacaggcgtgtaccaccatgccggactttttttgtatttttagtagagacaggg

SEQ ID NO: 123366 - DNA, 1037 bp, Homo sapiens
aaaaagtccggcatggtggtacacgcctgtaatcctagctacttgggaggctgaggcaggagaatcacttaacccgggaggcagaggttgcagtgagctgagatcgcaccacttcactccagcctgggtgacagagcaagactcttaaacaaaaaaacaaacaaacaaaaagtcatttttgtgataattatcagcatggttgttattaccgccttcccatactttgttttttcctctttagtttttggcagtactttaggtagcaaggcagataaagtaccgtaccctgaggtttagacatgtgaagtgaaactgatgatcaatgatgcagaatagcttaattgataattatcacatcgctagcattgaaaagattcatcaaaaatattaaatagtaaaactttccttaagttgaaattctcctttagaaggaaatgtttaatcttcatgaatcaaaatgactgactccaatgaagaattcagataaaatacccaaacagatcccgaaagatgaaagagatcaaaggaatatctcggagaaaagaaacccacaccctaaggagaaaggacacacacatacaaacaaagacaccctttgaaatcacagatgaaaatctgtcttccttttggcatctttgttaagaaatcatgtctctgctgttgcacacactaaaaaaaaacatacacccccccacacacacatccagatgttcacgaatattcatgatgtgcttccaatttggtttggacttgctcttgatttatttttgattaagtttcatcagcttctgctggggcccatgagatggatgacattgctgtagcacaaatttagaacgtcttcatattctaaataattgctccagtctctcaaactatgccttatacataaattacttatgcacaggtctcagaatggccagagacaggagcagtggcttactcctgaacttagattcttaataccattctagagttggtaaattaagtctccatttctaatacacagattgacctgtcaagggagaaaaaaaagc

SEQ ID NO: 123367 - DNA, 1068 bp, Homo sapiens
tagactgtgatgagctagcttggttccactccgcttccaacactgcattattattttttcctctctgctattctgcagctccttgcgactacacaatacactcagctgtgttaaacaaaaacacaaaaagttgctgctgtcttggacagttccctatcagatgaacagaaaggccagcaaccatagcctgggctggggctgggggtggggtgttggagggggactggggactgggatgagggcgaggctggggtggggcacgggctgggagaggggaacggtggggctggggcaggaggctgggcttggggggcaggtggtgggggtggggctggggttgggatgagggtacgatagggctgggatggaactgggacaggagtgagggtgtgggaggccggtggtgctgggctgggggtggggcaggtggtgggggttggggcggagcagggatgggctgggctgggggtgggtagtaagtcagtttagaaaggactgaagtgccaagcacatttttttttctattgtaccggtttttatgtagtttatcctcagtggatcctggacgtttatatttgtatacccattttaagacaacagcctatcccttagaaccatatttaaaaaataggtttacataagcaaactttacagcatgaaagacttttgtcttatcaaatacactttcattgggagcctttcttcctctaattagaagtctgaacttgttaacatattttatgtttttattagccagcaggttcattctgtaataaaggcatttcttttccagaattatactttcaaaactttcttgcttaaaagatttttctcattaaatatttatgcttatttttaaaacccaagagtgtaataagaaagcctcactttatgagtctaggaatgcaaatatctccagaatgcacagctattgtcattcattcaccccacaaaaatttatttgtcacctactatattcaggggattgctctggccatagagatacagtaatggacaacatactcactatagaaaggtgaaacagcattcaaagtactatggaatttt

SEQ ID NO: 123368 - DNA, 2303 bp, Homo sapiens
tctaaactgacttactacccacccccagcccagcccatccctgctccgccccaacccccaccacctgccccacccccagcccagcaccaccggcctcccacaccctcactcctgtcccagttccatcccagccctatcgtaccctcatcccaaccccagccccacccccaccacctgccccccaagcccagcctcctgccccagccccaccgttcccctctcccagcccgtgccccaccccagcctcgccctcatcccagtccccagtccccctccaacaccccacccccagccccagcccaggctatggttgctggcctttctgttcatctgatagggaactgtccaagacagcagcaactttttgtgtttttgtttaacacagctgagtgtattgtgtagtcgcaaggagctgcagaatagcagagaggaaaaaataataatgcagtgttggaagcggagtggaaccaagctagctcatcacagtctaggaagagatagttgattctgctcacagggcggcttgactgaaagcttgcagaacttactgctcaaaccggggatactcctgccttctgcctcttgcctctgcttccctcttccttttcctcttcctactccacaccctggacatggggtgattctgtgcctttcttaggcctgtctcctagctgtgcccacctaagcatccccttctgcttgtgatcacctctgtgtgcatgtatgtatgtgccagtgagaatattagcaagtaatggttgccaggagaagtggaaaagagagagaaggaggagcaggaagaaaggagaatagaaagctcccctccaactcttgtcccttcttccttcccgccttgactagggggttttggttgaaaggcacagaggaaaacagaaagttctgccctgttcccactgcattctactccaggctcaggttagcagggctgagaatgaagataccaaggaactaccctggcagtctgctccttctccctttccatctgttcctctgcacagccccacctcactcctgtgagccttcttccttgctacctctggcctttgttccctcctcatattgcttggctctccatccacctagagcccatcctcacttctgggtcctcactgcctctaccgcccagatgaaaatggccactagtaatgactctaggctgaggccgtatgcactcactctttccctctgtggagtggattcatcttagaaaccccagctggacccctgactccattttcccatagaaacttgttatgcctggtggataagttctgtacttctgtatcccagcacatcatgagaaaagctgcacttactggtttgacctgggaatgtgtcttcttttgctaactttaaagtgcaacttgttacttaggaaaaaaaatcagaaatcgacagtgtaatctttggactccagttcttgtgctggaagtggcctccatggtaaaagaaaacttagagacattttctgcaggcagagatgtgccctgtgcctatgccacaccgatttcagaatggggcagggtagggcagggctgtagaacaggtcagatgggcattcttctcattgctgggtgccagtcacctgccctgaccccaggagatgacaattttgaacacaagccagcattttagtgagatttgaatttattcagcaatctgcttgtttttgtttgtgcttgtttgttctggctggtcataggaatctcaaagaatacctctgaaggacttcatttgggggcccagtgtgaacattgctgatacgagtaaaatctatttctgagctgcaagagataaaaaaaaaagaagtcgtagataaaagcagttggaatatgtttaatgttattttaatctgttgcattatgtgaaatagtgttacagtttgcatacagattcctacttgccagtattcaaacttagaacagtgtcctctccatcagcacacagcagaaaaggcagccaacatatgcctatcaccttctacaacagcttgtgggggatcatggagcatagatgcagaatgctgggcttggggatccaggtaagcaagacagggtctggccccaagagacaggtgaagcaaggtgccaagtccagggatgacagtgaaggcagggaggagcagagagaatcaggctttccaagggaggagcagagagaatcaggtgctccaagggaggagcagagagaatcaagctctccaagggaggagcagagagaatcaggctctccaagggaggagcagagagaatcaggctctccaagggaggaacagagaggat

SEQ ID NO: 123369 - DNA, 1495 bp, Homo sapiens
tcagatatgatttgcaaatattttcttcacttctgtgggttgcctttcactcttgatcgtgtcctttgatgcacaaacgttttcataattctgatggagttcagtttattcttttgttgcctgtgcttttggtgtcatatccactgaaatcattgccaaatccagtgttgtgagcctttctcactatgttgtcttgtaagagttttacacttttacgtcttacgtttaggcctctgatccactttgagttaatatttgcatatggtgtaaggtgtccccttattttcattatcttgcagtttacacatagtcgcataaattgaagtgatttgctttggagaaaaaggcagcccctgcctccctcccaccaccttttttgcccgctacacttgtcactcggctacattcacctgctatgcttgtcactccaccctgctctaatgccgctttctctgcaggctcttcttggttccccaagctaagtggctcttgcccttgtgtacctgcattgcagttttatgatacttctcatgtcgtgtctgtgctttcctaccatgcattattattcacgtgcttgtctcatctcttctgccaaattctaagcatctggatggctgggtttaagttgcatctctgtgtccttcagaccatatgccatagtgccttgtgcctcacggtgacttgtattttgcagaagcttaacagatattaactggatatccaattataaagagtcataaatagatggtattttatgattaacaatattaaatgtagaagtttattcagttcctgcgtaaatcaactctcaaattcagttttgttttcttgaaagtgtctgaaatactctgaaagctgccatccatattgctaaggcaagagaggagaggctgtcttctaccagtaccacctcagggctatgtaagaaatttcttaccttagtgacttcaagattgtcattaaaaactgcaatccatattttaagtcagacaacagaaagagattttcttgtgtttttaataaatgtgaacggctggaagcagccacaaagtatgtatcaagtgaccaattctgggcgtggtggctcacgcctgtaatcccagcattctgggaggcctaggtgggcggatcatgaggtcaggagttcgagaccagtctggccaacatggtgaaaccccatctgtactaaaaatacaaatattagctgagcgtggtggcacgtgtctgtaatcccagctactcggaaggctgagtcaggcaaatcgcttgaactggggaggcagaggcgaggctgcagtgagccgagattgcaccactgcactccagcctgggcaacagagcaagactccatctcaaacaaacaaacaacaaaaaaggagaataactttcaccccagactataagggaacatgctcttatcttgacacaaatttgatttcttcttaaaatagaaggtgtgagggtacctgtgcaagagggacattgaactaggtag

SEQ ID NO: 123370 - DNA, 3692 bp, Homo sapiens
ccagaacaaggccttgcaaagaagaaatgaaaacacacttgggtacaggctagagagtaggggaggagggcagagactcaggaagctaaaggaagcctgttatcagccctggagcactgactgggagggccagtagatcttagggtagcagttaagagtgtgtatccctggtcgggcgcggtggctcatgcctgtattcccagcgctttgggagggtgaagcgggcggatcacaaggtcaagagattgagaccatcctggccaacatggtgaaaccccgtggctactaaaaatacaaaaaatagctgggtgtggtggcatgcacctgtagtcccagctactcgagaggctgagacaggagaatcgcttgaacctaggaggcagaggttgcagtgagccaagattgtgccactgcactccagcctggcaatagagcgggactctgtcaaaataaataaataaataaataaataaaagagcatgtatcccatagtcaaatcagatagactccacagagcctgccaccttcagacatggtcttgggcaagatgacttaatctctccatgcctcagtttcctcattggttttttttaaaaaaaactggaaataggcaaagttcctaccttataagtttttttcagattacacgtaacgaaaaagtgcttagaatggtgtatggcacccagttagcattagataaatgttggcaatgatgggaatgaagcaaagaagaagatgaagatggtgataatcacgttgatgataactttgatgatgatgatggttatgatgaaccagaaagcgctacagaagcacctgaagctccaggattggccctggcacatgtactcaatttataggtggagatgttgtgattgacaaaaggtggggaagtgggatgcaatctgaaaacaaacccagtggtcctagtgggcacttggtgaatacttggggcttatgaggtatatagatgtttggtagctccaaaggtgtttgacattgttctttctatagttaattttgacaacatctaggtgtaaataaccaaatcagccatcatttcaattttttgtttaccacttgcatatagttatttaagagggaattttcaagaaaatagttaatttacttttatgtatttccttaccacgccactcagcttttccctggctgcctactcgggataaacaaggacaaatggcagtctacgtgatccctgacaaaacccttgacacatgtggtagaagttatatatagcacttaacatggtttgtgtccttccgtgaacatgtttctgtcattgttttgcttcactgttgaacatactgtctttctcctgctttgtcagtcaaattatacaatgttagtaaccagcaactaaaaacacagtaggactttaaatgacttccatagtaaggcactgggctttatgtgtgatggtgtctccgcttccagtcttctctactctttcctttttgaattcacgatacagatatttattagatacttactctgaaccaggcacttcgctaggtcttgagatgttaatggtgagcaaccgatagcctgtgcccagggtacactgaagtctgagtacagatagcgtggtgcagtattccgatggaagcacctgatccagtcttaggggatcagggaaggcccaggaggaggcagcatctttaatttctctaaagttctgtgaatacaccttaatctccagaccccaaatcataacccttcttccaccctcagatcataactttgaaagccctctgcagtttccatgcagccagtcctttccccaagattgaatcttccttgaaacttactcccctcccatctcctgtccattctggcattgtcacgtggcatattgctcccaactttataatatttttggtgaaatttgagaggttttcttgttgctctgtgaataatttatggcaaaaacagacaaatcctctccatttccaaagatcattttctgtttcaggtaataagcatttacatgtgaaggccatttgtctggtgattaaaatttggaatattcaaagagagtcttcatagcaactttcaaaacgtataggtagaatatttaaaatctgtactgggatgggatgctaatggtttctcattctagcttggagttttggggcaaaggtgagcaccctttttggattctctttatgttttatagaatgaatgaaaaattcaagtgttagtgctttgaatttgcatacgttgttttagggcatgacagagaaaatgtggatgactttgaggttgatgccgtatccctatagggattatggctctttaaaaaacagatctgatggtactcatgtaagactcttgattgtctctattctttaaataacaatcatatctctaggttcacgtcatcctttttagatgaccatgtagtattggggatgccgtccgccctcctgtcctgtttctcagccacatcaatcattgtgttcagactcgctgcttttatctgctctgctacagaccatccgttttctgcccttggagagcaggtcctaataggtttcctgtttgtactcttctgagtttttgcttgttggcttttcctgagaaaaagacatgctatgtgctagggggaaattggcttagtttgtgtacatggagattttctatgtagtaatatgcataaccttatatgaaataactgttttgtaattaacaccctggtggtatttagctgattgaggccagttaagagacaacaagaaaatactttaattcttccttttcatgctacaggaaaggagagttcaacaaggtgttttaagaaaaagggaaagtaaagcaaaatttctgtgagaaaaattctgcattattgatgtttcaaaaatccttattaatataatacagtaaaaaagaagtgtgtgcgtattgaataatgtacctttaaatgacaagtgccctgcaaagatctatgtgtagaaaagaagtttgttatatatgattttaaaaagttaacatagatcttctatgtcatggaccttctatatcccagttgtggtatagaatcttgatagtgtgcgtgtgtgtatgtaaattttagatcaaatctgactctgggtctgtagaaggaataacattaagaaaaaccgattttaagcagaaacatttttgttctgctttcgactgtaaaatttgtatatatacattgtagaaaattcagaaggcttaaaaaaaataaggatgatacttaagtcctctattcacacttgcaactcagatataaccacatgcttttgtctgacatacatatctgttctgtaagtattgagtatctattaagtgccaggcactctgctgggtcctgaagatacaccagtgaagaaaacacacaaaatttccttccccagggagtttacatgccactgtttatatatgtataccatataccaaaatatacaatgacttcaagctgtatgctgaagtcatatggtgggcttgttcatactccttagccttcactaaggaatacctttcccttatgaattattgttccctatttttttaatcgttatgtaccctttgtctttgtctttgagtataccataatttgtgtcccccagtttgaactatttaggcaatttccaattttttgttatgatagaaataagtggctgggcacagtggctcacacctgtaat

SEQ ID NO: 123371 - DNA, 1036 bp, Homo sapiens
cctgttcttatcttatacttcccagtatttagggagaaaaagttaccagtttggaaagtaatcttattgtgcttttaaactatattgctctcgttatttataagagcacacatatttttctatccttatttgtctgacccatctcttaaagtcatttgctcatttttctatttaaagtaatgtctttcttgtttatttatcagcactttttatatagtgagccatttagtccattatcataatgtggcacattttcttccagatggagaatatgcatttttgtccaacttctctaccaggtaaatgacgaggagggaaaggagaaggccctcctcttggtatagaggaagggttggcttttcaaccagaatctctctacctaggcacagcagcaatgactcagtcactgtgatggcagtgcccacaagcaccaatgcccaagaatcccatttgttttgcagacagggctgcttttatagtgccaatctatgctttctgcctgagctgccagaaccatgcggggtccaagcaggcatgtgagcatggagatgaactctgttctggataaacagtactccaccttgtcccctcctcccatattagtagtcagtgatccgtgtgaatttaattggtttccagaaagtgagtgttacgtgtatacgtcagtgtgccactttagagttgtagaaagaaaaagttgggccttgtggctgtggatgaatgaacatgaccctgacaaacagctgctgttctgaacagcgagataaatttatgtttaaaccacagtaaactatgcaaccaggtaataattttgagcaatgaagtatgtttgctgtagtaaccattacagacacagataaatcacagtaatttcaacgtggcacttttgccattcaataaatgggtattttaaatttcatttgcttttgaactaagtttcataatttatagagtaagtcattcaaagattaatgctcagaagggaggaaaatcactatacaagaacagaaacatgtcatttatgtatattacattg

SEQ ID NO: 123372 - DNA, 1358 bp, Homo sapiens
ccccagaagtggaaagaaagtaagtctttctccctctgcccaggaccaccttccaagaaggtgtcttttaggtccatgctgacggaaatcaaacaggcgatcatgtgcgtatgtactatggagttatgcgatgtcattttccttaacatgttgcatgcatgtgtgtgtatctaggtggctaagagtgtgttttgtaatgcagttggtgatgtctgaggattttgtgaagagttactgattttacacttattgtgaataaaccctaaataaatctccggaaatagaaagggaaaggataggtgcattaaccaagatggattttcatcttttacattaatttttaatgtaggataaaagttatcaagaagcaagatacaaatataaaatatactatattccagaataaaccaatgattaaaaacccgtcttctgcacctcattttggtaggtgaccttaaaacaacagtgaatgtgtgtgttaaaaaatggcaaatgatccctagcgtttcctgttaaaggtaatatttttgcttccttgacccaacttggaccctgtaatttctgctctcatggaagctaattttatgtttcttgttatattttcagtatttcttttaggcaacataaataagacaaaaacaagagaatcttttttctaaaaccttttctttttctgctttattgcatcatcattgtactagaatgttctatttgtgatcttccatggtaaaaaattttaaagaaagtccacatctctaaacagacgcttcctttggcacggagccacttgtacgttcatgccaagggaggcacagaagtggtttaggcatcaagtatttctggaatgcaaagcacacgttggggagagcgtgtgtgtgctttagagcacagctttgcctaatccatccacgtgtgtgtgctgctggcacaggcggttctgggaggagggctgctttgccagaaagctataattctaaacttaagaggctttgtgggttttgttctggtctgaggaacgttgtgggtgatgtaccatagcaaaccaaggccactgcccactcaggttgagaagataactgtgcacaccccatcagctttttttgttttgcttgccttgcctcctcccaggaacctagtaatatggaggctgaaatagacaaaaaaggctcaagttgacattgactttgaacttggaggtattgtggtggggtagaagcatcgagtgaacgggctgtagcttttcctgccctagtttattatgtgccatgattcaggctgagagctcaggtgttccctcagaatctctgaatccttcaggaaacgagaaatgtttgctcttcctcctaagaggaagtgac

SEQ ID NO: 123373 - DNA, 1043 bp, Homo sapiens
ttgcctctgtaattttaagtggttcaaacttaatgtgtttctaaacaatttgaaagtttaaaaacattttgtcctttatttctctgttaatggcttttgaaaactatgctatcctttgcttttaacttaaaaacactttcttttgaaaacttttatggctgggtgcagtggctcaggcctgtaattccagcactttgggaggctgaggtgggaggatcacttgaggcaaggagtttgagatcagcctgggcaacatagtaagaccctgtctgatccagcaccagccccccgcccccagcccccccaaaattagccaggtgtggtggtgcccacctgtagtcccagctactcgtgaggctgaggcaggtgggtcccctgagcccaggaagttaaggctgcagtgagttgtgatcatgcttgggtgaaagaacaagaccccatctcaaaagaaaaaaatattaaaataaatttaaagttacagtaaagtttcaaggattgagaattgtgcagtgaatgttcatgtaatcttcacgtgggccaccagttgttgacatttgcacactcctgagctttctctctctctctctcacacaccccctgccccccacatacaccaccattaattattattactgctggcctgtttgagaataaatggtagacatcatgattgtcacccctaaatgcttaagcaaatatttcctaaggacaatgacattctgttacagaataatatagtataatgaccaaatacaggaaacttaataactttttctaatacatagtttctattcaagtttttctttttcttttcttttcttttttatttatttatttatttttgagagggagtatcgctctgtcgcccaggctggagtgcagtggcgtcatctcggctcactgcaacctccacctcttgggttcaagctattctcctgccttagcctcttgagtagctgagattacaggcacccgccaccatacccggctactattttttgtattttagtagggacagggtttcaccatgttgggcagactgt

SEQ ID NO: 123374 - DNA, 1058 bp, Homo sapiens
gtgacctggcgaaccagttggctgtgtctggttggtgtctgcaaaagtctctgccaaccaaaatatcattctgcgtcagagtggtgttctgtgggcagaagttttctctgctttttattccaaaaacaagagaacttagaaaacacatgtgggcaagacctgcaggggcccacccttagaagcagaaatgcaaagaaggaggcagcgtggaagctgagcactgctcctgcgactcctgcctcgcagatccagtctcccagcttgtctcagggaccccctgtgtgcacgcctctgtcctccttgcccagctgaaacctattctaagggaggtatctggccttaattatgtttcaaatgtctgtttctaaaaaataacatcacttctgtcagtagtatttagcatttaacagggtttaaagtctcaagtcacaggaagttagctctgaccagaagagggggagggagagagacaagcagtgagatttccgacatacctggcatctcagcatctattgtggatgcccctgccaagtggggctgctgacctctagatgtgcttgacctgcatatacaagaggtgggttgataggtaggtgataggtaagtaggtgtgtggaaagaaagaacagaccctccctaccccattatgagtttggtggggtccccattcatccttattttcttacactatctggtctctccatatgctttcactggaagtttaataaagaaggccaagggagatttcatttgagcctcttctctttatatctatctacatcgcttattgatgagactatctgttactggaagggggtcctgatctagaccccaagagagggttcttggacctcatgcaagaaagaattcagggcaagtccatagagtaaactgaaagcaagtttatcagagaagtaaagaaaccaaagaatagctactccataggcagagcagtggcatgggctgctcgactgaatagacttacagttgatttttgattatatgctaaacaaggggtgaattatttatgagttttctggggaaagggcaggcagttc

SEQ ID NO: 123375 - DNA, 1083 bp, Homo sapiens
tgcaagctccgcctcccaggtccacgccattctcctgcctcagcctccccagtagctgggactacaggtgcccgccatcatgcccagctaattttttgtatttttagtagagacggggtttcaccgtgttagccaggatggtcttgatctcctgacctcatgatccgcccgccttggcctcctaaagtgctgggatgacaggcgtgagccaccgtgcctggccagggttcttttcttaaggaaagagggtgaatagacattgcgtaggagactagcagtattttctatgaaaagtttaacttttatttgtatgcatgtaaacaaaggaatctgaaaattacctagatgtctgacaagctgtgtgtcaagattctttagtgtcattacattcaaggaagccaactgtagggagggccacctggctattttgtaatatgtttatggaggaaatcttcatggggtggtttatatagactaaaaattgaaaaggcatagacaggtaataataggtgatgcttattgagttcttattatgtgccaggaactgagctaagcacttaacattgactcacttaatacaaaaatcctacgagatgacaaatggtatgattcccatctacaaatgcaaaactaaaggacagaggtaagttgcccagggccacacacttactaagaagcagtacacagatttgatcccagttaagaacccataaccctaaccacagagctgtaattccaaagtccttagaatgcattgcttatgcaaatacagaggctagtggcaaatcgtgttcgttagcatcaaataaacagcagcaggtaaaacctacacttcagggctcccttgaaaataggagcaaattctaccctcatccagatataagctaggtcccagttatttatctgtagaggcaggaaggtccaaaataaatctcaaaacttcacctaagccaatatttataacttcttttctactaagtctttcactggagttgaacattcactgatttagtttcactttttttcattatctgtggctacacttgaactattttatggtgaaaaagtccaaaaatatatagc

SEQ ID NO: 123376 - DNA, 1348 bp, Homo sapiens
gtctccccagactgacggtgtgaataaaaagtgctttcggcttgtaaatatcaacattataaagacacctctaaataaacatttgacatagtagcttccataaattgccaaatctttttctaagggttgccccccttttcttaccggattctatttcatagtctggttcaagtctccctagattttcctcttctaaaatagaaacaactgctgagcacggtgagatgcgcctgtagtcctagctactcgggaggctgaggcaggaagattgcttgagctcaggagtttgggactagcctgggcaacacagcaagacccagtctcttaaaagaaagaaaggaagaaagaaacaacagacgacataataccttcagatgaaggtacaataccaagaaactcatacgtaatattgtgatttagaaaatcatgctgtggaattatcagtccgcctttggaagtagaccagattcagtgaaaagggctgatgaggtctgtgagtttgctaggaaatccaggtcaagccacgtcccctggtgctgacatgaatgcatcctgtctccacatcctgtttgtggcggggctgtggtgtagggtggagacacccatgttttcccccagggagcatgtgtgtgtgccctgcgcctggggcctgtgtgtatgggagtgaggatgtcacacagaggcatgcccttcagagtgggtcacagggcgcttctgccccacggaggtggatgtgtccttctgtgcccagcatcttctcggtccccatgagctgttagagcatccctaagataaccaaaggcaactggagccatcattatttgttttttcaggcacactagggtgggaagcataggcaaaatggcaaacttaattttcagaaaataaatggactggcccaagagccaggtgttgttatgatattaggtactcttctgccttaatcagtagaggctgagggcatgagggccaggtcactggccaggaggctcgtccatctgtgacttgtcctctttgccacttcatcttctgggcttcagctccctcgtgggcatggtgaggagtgtgagtcaggtggtctccagggtccttctagctcaggccatcttttgttttctgctccagtctaaagcatgccctgcaccgatcaatttagcttggactctgcatatcccactatgttgtagctggcctaggctctggagctggacagaatctgagcgtgagtttacgctccgctagttgtgggactgggaacaagttattcgaattctttacgcctcaggtttctattcaataaagcatgcacaaaaacagctcttttcaagggtggtgctgtgaaatgccc

SEQ ID NO: 123377 - DNA, 1062 bp, Homo sapiens
gcataagaagaaacagaatattaggccaaggatggggtgatggtgggaggctatcagtaaataaatatcattcctatacttgcaggaagatgtggagactcaacacctacagcttagtgcgtgctccctgcatgtcttattaattctcctaccaaatctataatgcagatggtattctacagttaaggaaaccaaggtttagaaaggtcagtgacttagcaagatcacagaccttgggtaaggcagagctggattctgaatccagctctgtttatctgcaaggggcagactgcttctcatccacccaactacaggtacaatcaaagactggggtgctcggagagaccagtgatgggccaggcagctcaggaagtttaatttgataagcatttatccagcagtaagccctggaaagatgagtaagataggtagggtagctgtcctcttacaatctgaagacatggaaagatgcttataatgcaatgcgaaaaccatcaggacaggggaactgcagaaggaggtatggtgaaccccgcttgggggataggcatggtgctgagggccctgtattttggcatcagtcagggttctatttgagaagtagaatgttaagatagaataaggacttggttatatgcttttgacctcatgcatcacagcccgtgctggctgcacaggccaggtgaggctgttccttctgtgtcaggtggtacagcctgaagtcagcagggcaggcagttcagcaaaaacaatgcctgcaaagtgaagagagcaaggacaaagtccaccctgccagggtgggctgacacccatgccatcagtcaccgtctccaagcgaggcttcagcttcgcgggtgcagagggcctgcaggagttgttgacgtccttcctcaggagctccacacatcacaggcccaggactgaggagctgaggaggagacccagcaggaatgtgagcgctgtgggcccagctgctgccccatgccagcccctgacccagaggaccaacaataacagctatagcagggccccatgcccacactgacggtgaagcacggaaaa

SEQ ID NO: 123378 - DNA, 1055 bp, Homo sapiens
catgcctgtaatccaaggactttgggaggcagaggctggtggattgcttgagcccaggagttcgagaccagcctgggcaacatggcgaaatcctgtctctacaaaaacaaacaaaaattagctggacatggtggtgcgcgcctgtagtcccagctatttgggggctgaggaggtgggaggatcacctgagcctggggaggttgtggctgcagtgagctataatcacatcacttcattccagcctggccaacagagtgagacccagagtgtctcataacaataataataataataataataataatataatgtaaacaaaggtactttctttttagtaggctgcttaagctcataagaaatttttgctcatttttataataactagtttttgtggtgaaaacaatgtgctacagccctgttttattttattttgcttttgataataatttagtaattccttaagacaaaaaaaaaaaaaacctaagtaaaatttaaaattcacagtgaggccataaaatgaaggcatttgtttttactggttagatcaaaaccagaataaaaagcagaatttcaaggccccctcccccgccccttttttttacaccttaatttttatgcctactgaagaatcatcaaaagtcagaatttgacctgaagccgcagactccaggggcagcattacaaacttaaattgcactttcagtaccggtaattagagacaatgtggttttggctttcggctcacagtattgcaccaggtactgtgaatactgtgatcagtaagactagtgaaccccttgactccatgaagctcaagttttagtgggaaaaacattggtttgggtgtcggaagagctgagtttaatctccagctctgtgacttacagtgactaattgcgtgaccttggacaagtcacttatataaagactctaggccagaatctcttcatacatacagcaaggctagtttttttgagtgtttttgtgagactgaaatacgatgagatttatgaatctactttggtaagccagaccaatgctttgtggaagttagt

SEQ ID NO: 123379 - DNA, 1019 bp, Homo sapiens
ggctgaggcatgggggctcacacctgtaatcccagcacttagggaggccaaggtgggagaattgcttgaggccaggacaagaccagcctgggctacataatgagatgtctgtacaaaaaacaaaaaatcaaaagattagtcgggcatgatggcatgcgactcgagtcccagctacgtggaaggccaaagcaggaagattgctcgactccaagaggtagaggctgcagtgagccatgattgtgccactgtattctagcctgggtgatagagcaagaacctgtctcaaaaaaaaaaaaagtatacacacacacacacacacacacacacacacacacacacaccctctagcatatgtcacggggatattctgaacattagttattaactttgaaggaattgagaaggcatttataacttcacagtgctggaataggtgctgttactgtcaatagtgttgttagtatcaaagctggcattcatggagcaattttatctcaacttcttatgcagttcagacccatgaagccacaaatgaagaaaaatatggcccagatggaaaagagaagacccactgaggggtttttggaaacctcagaggatgactgaatcccatcccagatctgattctccctccttcaagcccacatcgctcctgcacttggatagtcctggccttagtgaggccgtggcccagacacaaccagaccatgggcctcccctgtggagagatggcatttggctgcttttcagatgtgaaactctttaagtttctgccagtgacccacatcattaactttcggtacaagtcaccagttggtgaatgaaaggacacaaatctctttcactgcacctttgtagggatttttagagtcaacaggagtgggatctgtccttggcctggaaagccttttggccattcccgaggtgccagagaaccagccccttacaagttaagaaatggaagtatatttgaagaaggactgaggatgacttggttcataggtagggtggttgaaaaa

SEQ ID NO: 123380 - DNA, 1149 bp, Homo sapiens
tttgcaaaaatattttcttctcatttgtattgctaatggaaggacacaaagaacccacagctgaaggagccttggaatgcttgtatgatccagttgggtgtgtaaattagatctttactccacctatagcgaggatctctctctcactttcctccaaaacccatccactgggtactctatctcaaaggctctgatcatcttgaaggatttgtttctatggtgacacccacgtgttctgcaagcctgtttctcaatcagaggtgcttattggcttcttaaaaagcagcatatttttgccaccctttgcttcatcagtaacgttcaacatacatagtgtcctgagcaacattcttctctagcccgagacagcagatgttccgcattgacgttctgtttcgccattcttgttttcactcctgttgttctttgtcctcaatctccaggagaagacgttggttatgttgccagtgaaataacgatgagcgatgaggagcggattcagctaatgatgatggtcaaagaaaagatgatcacaattgaggaagcacttgctagggtaagcatgcagatacctggtttatatttgtgaggacttgactttctgaagtgtaaaaatgtttgcggccaacaaggggtataggaatcaggtacccatgttgtcagataaaatatttattctgtttacttgatacaaacattctactttgtgaggtgaaacttctatggtcaatgaaaacgtgaatgaatgaatggcaaatatttttgatctgtggaccacattaatgaggaaaatggccttctgaatgcagctgcaaaattcacaagccttttgaaaagaatgtaatcagtagtaaaagatcaattattaaataaaaatcaaatgtactaaaaacattgtaaacatcaggattttttgtttttttgagatagggtctcactatgttgcccagactgtagtgcagtggtgcaatcacaactcacagcagcctcaacctcctgggtccaagtaatcctcccatgtcagcctcctgagtagctgggaccacaggtgtgtgacaccacacctacctagtttttaaattttttacagagacagggtctcttcatgttgcccaggctggtctcaaacccgtgggctcaagtgatcct

SEQ ID NO: 123381 - DNA, 1027 bp, Homo sapiens
tatgagaagtatggacctgtatgtagtttttctgtggtgagcaagacatttactcctggagagagatgagactgcactactttttttttttttttttttttgagacggagttttgccctttcagccaggctggagtgaagtagcatgatcttggctcactgcagcctccacctcctgggttcaagcgattctcctgcctcagcctcccaagtagctgggattataggcgcctgccaccacgcccggctaatttttgtatttttagtagagatggggttttaccatgttggccagtgtggtctcaaactcctgacctcatgtgatccacctgccttggtctcccaaagtgctaggattataggcctgagccactgcgtccagccgactgcaccactttttaatagtaaaaccaaagatgcagaagatgtctacagtcatctcaggacacctgcgtttgggaagggagttgaatgtgacatgcctaatccagcgttcttggggcaagagaaaatgttaaaaagtagccttaaagtagcccactttagacagcaagtttctataactgaaaaagaaaggaatactttcaagctggggagaaagcagagaaaaaaattgtgtgaagctctttctgagctcataatttgatagctagccatggtttacatggaaaggaaatcagaagtcaactcagtaagaggtggcacagctgtgcgcagatgtgagtggcggcttcaagcctttggcctggctgcggccacgttggctgcctctgcgtggttgcagaagcagctacaaagctcattgagagcacaactattgtctgtaaggcaacccagaaacacagaaaccagaagaaaaaatccaaggcattctccaaactttactggatactacagacaagggtgagcacctgttggcagatgaggaagtcacagggctgcttattagactgttctcagggcagcatacatcctcaactactggtgcctaaatgagctgctttgtagccagagatgaaacacttcat

SEQ ID NO: 123382 - DNA, 1222 bp, Homo sapiens
ataagggacagtcttcaccattttagtctttgtatttcttttcgaaacttccgactcgcacctgggtctgcaaagaggtgtctgttcatatagattgcttattttctctacctgacagagactcatctacagtcaaaatagtgttatcatgctggggttttgttttttttttttttaattgcagtaaagtatacataagatgacatttaccatatcagctattttaaagtgttcagtgatactggtactgttaatgatattgatcattaagtacattcacattgctgtgcaaccagcatcataatttacttccagaagttcttcatcatttcaaaccgaaactctgttccaattaaacaataactctccctacgcccccgcctcacccacctccacacacaccctgcccctggcagccaccgttctactttctgcccctgtgaatttgacacctctcaatagctcatgtaagtggaattatacaatatttgtctttgtgtgtctggtttatttcactagcataattctttcagggttcatccacgctgcagcatgtatcagaacttcatccctttttatggataaataatattccactctatgtgtataccacattttgtttatccattcatctgttaatggacacttaggttgcttccagcttttagccattatgaacaatgctgctctgaacactggtgtacaagtatctctgagtctctgctttcagttcttttgcacatacctagcacatacctaggggtagaatttctggatcatgtagtaattctgtatttacctttttgaggaaccgccatatgttttctcacagtagctgtatcgttttaccttcctgccaacaatgtacaaaagttccaaattcttgcctttctcatcaacacttgttgttttacttttttgataataattatcctaatggtgtgaaatggtatctcgtgattttgatttgcatttccctcaagcatctttcacatgttcattggccatttgtgtatcatctttgtagaaatgtctgagtcttttgcctggtcttcagttatgttgttttgctgctgttgttagcttgcaggggttctttctattttctggatattaatcccttatcagatatgtgatttgtaaatatttcctcccactctgtgggatgccttttacctctcttgatagtgtccttgatgcacacacttttaaattttgaaat

SEQ ID NO: 123383 - DNA, 1037 bp, Homo sapiens
ctatctctgtcattttgctagtacaatgctgttttgattaccatagctttatagtaagttttgaaattaggaagtatgacacctccgattttgttctagttttttaaggttgttttggctatttaaaggttccttgagattccacattaatcttagtttgagtttttctatttttgaaaaatatatcgttgggatattgatagggattgcattgaatctttagattgacttgggtaatatcattttaactatacgaaatcttccagtcaatgaacatagggtatctttccatttatttatgtcttcattaatttctttcagcagtgttttgcagttttcagtatataagtcttgcttccttaattaagtttatttctaagtattttattctttttgatgttattgtaagtgacaatgctttttaaatttttttcaaattgttcattgctagtgtataaaaatgcagtggattttcatgcattgatattctatcctgtcactttgctgaatttattagctatataggctgtgtgtgtgtgtgtgtgtgtgtgtgtgtgtgtgtgtatagtgttagggttttctatatataagatcatgtcttcaggaggctgaggtgggaggattgcttgagcccagaaggccaaggctgcagtaagctgtgattgtaccactgcactccatcctgtctttaaaaaaaaaaaaaaaaaaaacaagaaaacaagatcatgtcttctgcaaaaaataataataataataataataatttaactttttcctttccatcttacgtaccttgtattattcacactgtttcaatatgaccaaaacagtgcttcttattctacaagttccatagggatgataggaatgaaggctccagaatttcatataggcttttttttttgataagagtattgctctgtcacccaggctggagtacagtggcgcgatctcagctcactgcaacctccacctcccaggttccagtgattctcctgcctcagcctcccgagtagttaggactcaaggtgtgcact

SEQ ID NO: 123384 - DNA, 1025 bp, Homo sapiens
ctgcatttttatgaagagttggccagaaaccccatccaaaatattcattctcattattttagattttcctctgtggcagagcagttaatttcagaattcagccaccacgggttataggcgctttgaatattttttgtgcaagagccggagcttttctgttttctatcgattcctttctagaatacagagatgtgaatagcccactggctcgaatcaggaatgcccaggccatgaaagttttagggatcacaaggcctttgtcaccagacctcaatgcctatattgatgcctgtcatgccttaggatttcatttgcattgatttcataggcttccccaccccaatcgctgaaattagataatcgcgtgttgcctcacaataaatccatatgcacattcctagtttccaagagtgtaaagtactaaagatagttaccaggggaagtgaaaaatagatttccctttgccagagaagaatctgttttgtgctgttttccattaataataaacttctgttgggagtgctaaaagttttaaaagagatttttggttgagagcttagctcgatttcttattaaatgtctgcacatttatttattatttttcattttaatttagtttggtaagtttattttttcctttgcctcctgcagggaggggtgattgtaagagttctcaagctttgtgccctaagattcagtttattttctagttaagaagacatttaaagaaattatgatctctgttttaccgggttttctagttttttgctaatgtaagttgtaaatcatggtttttctgtttttagaaagctggtgggtaagagttagtgatctatacctggtacttgaatattaacaaaaatgtttgctgtgaaagatctttccaaatgaaaggtcatttgatggcaatcttatttaaaattttttaagaatatatataatgtatgaagaaaaatgaaagcaacaaccatgacaacaaagcacaagatgggctagagtcatctttaccgttcagtagatttttc

SEQ ID NO: 123385 - DNA, 1058 bp, Homo sapiens
taaagcaagtcatcgtttcataactgatcacttttgcttttggggagttttagagttgggaaatatttgtgcaaagaatgttatacaggaggctgaggcaggagagtcgcttgaacccgggaggtagaggttgcagtgagccgagatcacgccactgctctccagcctggcgacagaacaagactccgtctcaaaaaaacaaaaaacaaaaacaaaaacaaaaaaagaatgttataactgtgggcttgtggccttataacaccaccttacctccatgtgtgcactcttcatagccttccattcaaccatatgtacatttttgtcactaatttggtttgaggtagagagagccatgtggttgaactgtgtccaaaactttgggccacagacacagaatgccgtggagctattttcaatgtttccttgattgaggacttccaaggtctcaactaaaatatccccagattataagatcttttagttggcaccttttaaatctttttgggactttctaaaattgtaaaccataaacatgtgcctctccagtggccaggttttacttagagttttcaatgtcctttcaccagcctcaataacagacattgtcttcaagccagaggatttagtttcgaagttttggaaggaaaggtagtcacagccctagtcgaaatagaacattctgaaagataatttgctaataacaattctggtatgtgccgaaagccagggcaccggcagaagttccttttaagtggttcttgtggcaaatggcttaatttccattatgacacaagaaaaggttaacagtgtaatccctttttatagaatatggcggaagaacagtgcacacactcataaggtggcctgagcagttgtgatttcactgctttttggagcagagtggcagcatccttctacttgtataaccactgtcgtcttttatagaatctgctattgtgagctcaactcaaaattttaaaggttgactattcttgctgtgtttattttgaattttattttattttattttttactagagtaacttttagacactaggt

SEQ ID NO: 123386 - DNA, 1032 bp, Homo sapiens
ttcattttatttcgctgggtaggagattataggaggaagtattactctgtattttaataaaaccatgattctgaaactaaaatgatagtaaaataagaatatattaaagttcttactaaaagagtaaaagtaataattcctttaatctacagcttagggtgagactaaaggaaaaatcagtccattggaaaaatatacatagtgagaggttttgagaaatgcccgttttgttccgtctggttataagctgcccaggagccattgcttaggtggcttcttgtcacttcttctcttctgccctcccattcccagtcttttctctgggacaggggccaaagttttcaggcatgtatttgttgagtccctaagatcaccatgtttccacaaagttacacaagaaggaagctgttgcctctactaggccctggaaaccaggccttcaccctgcgtgggcaagagaggagactggttaagctcagacttgagtcagacctggggctcagatccaaatctcccacctattagctctgtatctgtggccaggcacttcatctctttgttatttgatgtgaagatcttctgcccttcccgtcaactgtcattcttaaaatacttgagttcccataaaagtgctatttttgtacatgccattaacatggtagtaatggcttatattcatgtatcagcagataggctagaattgtcagaacaaacttaatgtaaaagtgcatacttggttacacttttaccaaacacataatcaatttattttctatttcagaaggcattattgtgtaagtgggtttaagggtgggtctggtatgattttagtaagcatgtttggacttagtactgtctgtgaagtgtaagtagttattgtactgaaataatctagggccctacagtgctgatgacgtcgtctcatggagtgtgtgggtgtgtgttccatacctgttatgtcggaaggcactctcatggcaggcccatttggctctttgactttgggaactaaccaggcacatctttatcatt

SEQ ID NO: 123387 - DNA, 2037 bp, Homo sapiens
gtaaatcggaaaacttgggtaatatgagaaaattaggtcaagtaatatgaagcatttctctctctcagtattttgacttctagggtatagattctattctttacttatttttatttataaattggttctgtaataggttgtttccttatttctgcaaactttaaatttatataatttatgttttttatcttgtctttgaggtctcatttaattgaattcacgttcttattaaattattttatagagagaagcaactattaggaatttcttcctgttccttgagttgagatgatgaagtgatgagagcaaagattggctttttgtttttatctatgcttcttcttttccccctctctttgccgtagtttgtttgtatagttgtcatgtccttggtcctgtttgggtggctctgatcacgttctccatttgtgctgatattgagggttatgttttgacctgtttgccatgctatctgacaatagattttttttttttttctcctttcaagatacagttgagggcttcattttgtggtccatttatgtttgttgttgctacaacctggccatgatatatggtgaaatgtggtcttcattgggatagctggactctgccttttctctcctgaaactgtgttgaatgtgccgtatcgtaattgatgccacctggttcatagctggggtaattggtagaacatagccattctgcctttcattcattttttgaattttagagactgtatttcaatcaagaacaacctcacttgactttccatcgtttcactcattgctcttctgtagccatttccactgctgttaggtcagaaaaagataaagaggtcacacagtttccttccagatttggagtcacatgaaaggattctgtggattcctgccagcctggcttttgtagaagttgtgggccttttccagtgggcctcagaaatttgtttcttaccttagtcatggagtttagtacattagattatgtagctttctctctttggttgctcttggcgcaatatttttgctagtttttagtgttttattgtttgtttgtttgtttgttttttcttcttggggggcttttgctcattttgttagtcgttgtgagaagaatattctgtggttcagtgttcagcagagttcatgacctgattgttttgccaattggatgaccacaaagaacctttctagctctaaataattcctctctgaaggtatttagtctagatttcttcaatttggaacttgaagtaaatttgcttatttattctgcaaacagaaggagattaacgttaaggttgtagatcgtcagtctaggaggtaacattggaccctcctgcctccagcttcgacagatgaccactgacctggtggcataagtttggcttggaggaatggtcttggtggtcccaccttccctccattgccatttggctccatcagttctctgtatttctacattgccatttgcctagacaaggttgtttggcagccctgtcggagaagtcatcgtgcctgatacatgagtcattcagcctaagatgccataaaagtaatgtgactttgcaaacaccacccaatcccttaggagacttacggcttctgggatgaacactttcatcagctccagaaactagcgccttaaatgcgtatgtaattgccctacttggcagtcctgttctgaatcatcctttttccatggcatgtgagaattggatgcccttgggaatgagtgggtttggtgttttgctttagtcttcagtgtgtctgatcccatagatttgctctggataacactaccccactctgaacagagggacctgtagagctgtagattaccttcccaacactttgtttcctaactcacctatttaatatgaaacaatacgtttctctgacctatggtcagggtgacaaagccccaggcagaaatgtcttccaaagatttacagagtgaaggagaagccagtcctctcgcctctacttaccactctctccccccacccattcaggaggaaaggcattctctgct

SEQ ID NO: 123388 - DNA, 1120 bp, Homo sapiens
tctaggctgacttctaggttaattttctattacacacacacacacacacacacacacacacacacacacacacacacacaccttggatgacctggattttatattgcatttttcttcgtataaattgtgccgcatctatcttgtctagcgtccaaaaaatgatcatggaaaagaaggacttggttgccatggtttgtgatttgtcagtgacaaacacctccaaatcttgatttttctagaaaaataaaaatagcattaattcaaaggtacaaagaagtataattcaaaggtataattcaaaggtgtgtttctcaaaaataaatggaacatgtgaaaacaattaaataagtacctggaatatgttactttttgccacagtgaatctgggcagaggaaagtaggattttatgaggaaggcattgcctttaaatctactgtccttgtttaactattttgatttctccttggaaagttcactctagtacatataatgatttgtgtctttgtggactaaaatttttgtattagttttttctataccccatttctcttactgcccactgtcccatgcatacacacacccacaccaccaccaccaaccagcaaactaggtatgaggtatacacatcagtaattttcatcctgtaacacagcttcttgtattttgattacaaacaatctgtacctatttcattttcatttgatttcaacatttatttatttatttatttatttatttttttgagacagagtctcgctctgtcgcccaggctggagtgcagtggcacgatcccggctccctgcaagctccgcctcctgggttcacgccattcttctgcctcagcctcctgagtagctgggactacaggcacccgccaccacgcccagctaattttttgtatttttagtagagacggggtttcaccgtgttagccgggatggtctcaatcacctgacctcgtgatcctcccacctcggcctcccaaagtgctgatttcaacatttttaaatgtgaggattagagacatattctaggtttgtcccgttgatagttatagagactttctataacataatgttgattcttcttctattagaattgcttggcttttgagctaca

SEQ ID NO: 123389 - DNA, 1009 bp, Homo sapiens
cttgcccttgagggcaaggatgtgtgtttccgtgcctaggacctaattctacgccgatttagatcttaagatggtatgtggcactttgtaaacctcttgggcaaatttttgttggttcccaagttcagcaacagagctgccgaggttcagactggcagcaaggccggctacatccagccacacgggcaaagctcggagcaattacctgattaactttttcctttgtttctttgccagtcaagagaacaatcggatgatgagactgaggagtcggtgaagtttaagaggttacacaagctggtaaactccactcgcagagtcagaaagaaactaattagggtggaagaaatgaaaaaacccagcactgaaggtaaaaaaaaaaaaaaaaaaaaaaaaaaaaggcagactccaccctggttattccaaaagaaatcatttggggtcagtttctcagcagaaaagggatacgatttcaagtggaaaatgcattgagctctggctgaatctggcaggactatgcctgccagcagagtgatgctcagatgcgatgatgtgatggaatgaagggtcctggtgtcaggcgtttggggtgcttagtcatttcaatttaaaagatgggaaatggaaattttctcgaggtgtagtatagctttatgtatgagcttataccattttatataaactttctaactttttcacatgagcctccaatcccagaaaggactatggttcttgctcagtgaatttagttcaaatttcatgtacatacattttgaagaaatgcctaacaatcaaggcacctaatatccctttaaatttctcagggttgatttgttcttcctgtagagagtctcaagtctcaattcaaatgggggctttaaggacctaggattctaagagaatcttttaagagttgtattgctggggttagccaggtgaaacagtaatgtcaaaagacatcagcttggatttattgaaatggatagttagcctttgacatataattatg

SEQ ID NO: 123390 - DNA, 1066 bp, Homo sapiens
aattttaacatgtaggttttaaaattatttttgtagaggcatttttgttatatagaaataaaatcaagccatgtaaagaaatgaatttccccttatttgcaaagataagggtttttcgtttttattgctgcttttaatttgtgtttggtattattcgtgggtttaaatcccttagaataataccgaagctaagtgggtaactgtgagagaatggggattcgaatggaaaacaaaaacatggggagagaaatcagctttgtggccaatttcttgggttgttttcagttccggggtttcattagggtatctttttgcgtggtaattctgtttacatttggatgcaatgctgattttacatttgggtgttttaatacctgcccgccagtcgtgaattccacagtattgaatgtaccctgtggcggcccttaccgaaatcacagacagggtcagttggtactgttgggggaaccatatggaattgccaacattcaactttaagggcacatttggtaacaaatctcatgaacactcggccaaaatcaagcctcagatataacaaatagatgggtggggttcatccataactgagataacatgggcaaagtatctagtcctgggcctgttccccagtgggcccttcacacatgatagtggtgtgttaaagcagcctttccactagaataacatgactaaaaatacagacattgtaatttgcacatttatttcagaataaatcaatccaactatctttgagaggcatcaatggaaaaggaaaaatatagcaaaagggataactctaacgtaaaaagtaataaccatatggaattctggctctgaactttaatttatctgggcacaaatcaggcttcacagatggaagatggatttagtgaactcaaatcctaaggtacactctggcatctgatgagtcagggtgctgagttgccgttggccaatctcacccatcttctcaggagaggccccaggtgtgtgtgtgtagctcaaggcgcctgctttgggctgccctccaattccctgctaaactggaacttcctccaacccctgc

SEQ ID NO: 123391 - DNA, 1049 bp, Homo sapiens
cttgggagaggctatcttggcccctgtccatcttgcagagcaggaaggattcatacgccagtaggcgccccctcccccctcccccctcccccgcccttggacttacaaagggttgatcctttgacttcctgcgtgcctgtgctaataccaagttgtctgcatgataatcatcatgtattgagggcacaccgtgtgccaggcactttccttaacactttagattttatattctctttaatgtcatcctcagaatagctaccagaagtaagcacttacaccatcctcatttcgaaaatgaggaacctgagactcaaagaggctaaaagtaattgactcctggccactcagccagccagcagaaggcccagcacgatgtccaggcagcctgctccctgacagcagcctgttctcactccgctgccacctgtctcccccaccagctctggagtcctcggaaagccaggagagagatcagttcttcattcattctcacccttgcaccctgggtttcaagtccttatcctgtcagggacaaccctggccaatctttaacctaggctacattggtgccctttatctgcccatttctgtgtctttgccacagaatgcacacctttccttccctcattgctcccactcagttctctccagtaatgaatcgccagttttgtagaaagcctttcagttcatacagcactttcacgtaactcttttatgaggataatgtttactgttatcatcacaacagccttgccaggggtattatggaaagataggtaggcattattacagatgaggaaacagaggctcagagccaggaagtaattgcccaaggtcatggagctgtgagtggcagagccgggctggatgcagagcatacccctgagttcctggcattaagtcagcccacagcctacctctctcctcctgccaaaatcaccttgcctttggtaagccggtctcagctgaataagatagatgatggaggccttcacgtgaagcaaatcacagcaaatgtgatggagtgagctcatcttgatggtcactct

SEQ ID NO: 123392 - DNA, 1040 bp, Homo sapiens
attttcaaggcatgacttactttgaacttcagaatatagatatttttccttctgaaattcccacctaacttttagtttgcacagtggcacatataaaatggtgcaaagtgaggaagtagatttcttggccctctgtcacctggcaccttgcttgatctgctcaggacagttggctgtgggcccttttaaagacctgaaagaatagagtgtccttcaatagtggttttcccagggggccttcccgttcatgaacaggatgttcttccccagacgatcagtgtaatttaaattcattcagtcgggttctgcttttgtgaaagtgaagacggattggtcaatgccattcttaaaacgaccttctctgttgtaaaagaatccttaggtccttcctagcccctgggttttccacatatttccacatgttgactttccttattttctgtcctttcatattcatgtaattcttgcagcacttttaatactactagtatgtagcaggaacttttcttctggctctttctgtatcatggcaacagtttttcaatggttgagtttttgttttaaaataacaattctctttctcactcattcagcctctggtttgctctgactcacagatattttgaaaaataaccagtcttagttttatgtatttattttttactttcagaagtgttctacccaattcatctgctcttgtatgttttgacatgaccttgatagaacagacgcacttcttctgttaattgatgactcacctctgtgagtttacatcatgtaatactgagaaatttcccaatctgagcaccttgaattgttgatgtgcctctcatgttatttactgtcagattaatactataactccatgagggccttgtctctagaagttatatttctgggatttgtgctagttagtgttgtaggccagtgattaattcttcattgacattgagtatggacatttgggcaagctcatctccaggcaccgcccccacctaacgtgctcctgtgtaatccctatcccaagtatcagtctgagg

SEQ ID NO: 123393 - DNA, 1110 bp, Homo sapiens
attctccttgtcatatttctttcattttatctaaaagtttcctttattcttcaacctcaagctctttgtctttcgaaaatgccatatttgcttgatgaagcctcagggaaatgataatgctttgtatccactggaagtggtcacttgtctcgtattttatttggtcattcaatttttgtttgagagaacagacatgcatgacattttgcaattttgtccatttttgaattcaaccccaaaacatgtgtttccaactgcatggccattccattgactagccctcctcatcccaagcatctatctaaagtgtttttataattttcagtacaggaagtgtgtgaactaaaaaaacttcatttaggcttcatttatttaggtcatcaacgtcaagggctggttcatgtattgatttattttttatgagtctctttacagtccattttctcttttgaaggaatgctgtttaaagaactacttgatcttatagaaaaagttagaaattaattcaagcaatctttattgttatattctttgtcactcctccactgtaaaaaagaatcaattccagatatcttagcctatcactgaaagaggttttagttggtagttaagaaaactggtccattctttcagtttttcattttagaaataaatgcatacaataggcatgtgaaaacttaaatgagattctaatttattgcagtcataatttccacataaattctttgtcacttatttcatatgtatcagaaataacttgggctccaacattgcagtagatgctgtggtttaaagcagggacgtgcaaaagccatacaatgatgaggcatctgggtgccataccatgtctgtgaagccctgagtcacgggaaaggaactagaataaaatcactgcttttgcaagaaggaggaaatgtacatggcattataagctggaaagagaaggttaatgttaaaaattagccttgagaggtggtcataacattgcttacccagttaggtgatttggtgaatatatttgtgtagaaaggtttttctctttctatagaatagatataggtccagttaagctgacgataagagaaatcagattgcccattgatatttaat

SEQ ID NO: 123394 - DNA, 1172 bp, Homo sapiens
cagcgtttttggctaggatggggaagcggtgagtgagtaattctcttggcctgattggacaactgtaaacataaccttctccccccctcttctcagcgatttaaagctaaacaaaatgaaagtctgtttgaaaagcttgctgttggtgtcagagccgtgggatttcaaacctgggttttcaggatgcctgagtacatggatcctctaacacatatcccttcattatctctactgaatgtagctgatgttaggggaagttctgtgctggagacagggaatctcacagcactggactcatggagggtttttcttttgttttttaggctttttaaaaaaaatggttggtttttgcatgttaaggggattctagacctctggggtaggcagagttccagtggcctgtgaaagggaaaaatgagtgaagtttccttacgacatgactcatgtgtttttttctcatcatttctcgttttctactttcatcctgtccacgtatttgtgattcagagatgtcctgcaaacggggactgctgggttggtgcactgccggctggcttaagcataactgaagtttttctgccctaccctcttttccacagagaacctgcagttttggaggatttgacttgacgaatcgctctctgcacgttggcagtaataattctgacccaatggtgagtaacatcagaggaaagcaaaaaatatggattcaggcgatgaggttgacaatagttcaccattgagtatctttgagaattgatactgggtaccgttttccttggtaatcctgagtcacgtttggaaaaaagctctatttcacttgccttacagactccactgttccacgtggaatgaatgatgaccactctcactgccatctccttccttgagtagcacagttcctttaatgcctttgcttccagttttcttcaagtaacaaatccagataagtctggcctctgtggtctgagtcattttgcacacggccttttcttcttgctagttgcaagcatgtaactactacacacacatagtgccatgaagtggagccctgtgatttggtccccaagagtatgtgctggcattttggaacaccagtcttattatgggcccagtacctggccccacatggcctatactaagcctaggattttgtggtctggggtgtcctg

SEQ ID NO: 123395 - DNA, 1023 bp, Homo sapiens
tgtacaaatagaaatataagaatctagccaattttttttttccaggaatacacttttttaaaagtgcatgtttcctatccaagtagattaaatatcctctgactacacttccaggtattctagtaatcatggattgtacttgatctacatttgaagtccagccttgctactgggcttttgcgtatgctgagtctctaaacctttaagtattttgtctgtgtggtagacagattttttttttcttggagattccaagaatatctattcgagaatgagaaatagtatttgagtgcttaataaatagtgacattggccacgactttaaaagtaagcgaggatgtaagtttaagaggaggagaatattggttatagaatcaaatataggtatagattgatttgattgatttcgttgaaggccaagtcgctgagaattacaaaacaacacctgtccactctgatgaacttcttcattttgttgaaacccatggcaggactcgggccttgatggaatgcctggctcccctccgccttcacagcccgaccccgaacacttggacaagcccaagctcaaggccgggggttctgtagaaagtcttcgcagttctctcagtgggcagagctccatgagtaagtcgagtttgtcattgtagattattttctttggagttaatatctgacatatactgagcactaggttcaggcaatttcaaggtgaataagaccaagtcctgcccttcaggtgctattagagaatcagaccaataaactctctggactcagagtcgtgtttgtttattagtagacatgcagcagcagcagcccaaaacaggaggtgatgaattttgatcggagacaatagggaaagcatctcagaggaaggatctagagagcagggggaataagccagggagacaagcacatgaagatgaccagcaaaataaagggagtggggaagggaggggaattttatatgtgactgataaattcgggccaatggtagttggagttggctgaatggtatga

SEQ ID NO: 123396 - DNA, 2226 bp, Homo sapiens
agtatcttggctacctcgatcactggtctcctctgtagtgaaaaacagaacaagaaccagccagccctcgaggcagagggagggtctcgtgttaatccctgggttagcatcacttcacccctctgacctcagcttccctctagaattcctgttgcacaccctccctctccccacctggctcctgctccacacacctggtttctgtgttttctccatctgaagaaagatttctgccttctgtgtgctcagaggtacctttatgggacagatggggttccacaaagtgtgtgcagccatgacagggccgggattgccactggttaggacaggtgggaagtgcctcctctaagaagtgggagccctctgaggagggaaggcgttcagagtgccgggcgggcagcctggctgagagcaccaggggtaccccaggcacccctggttctgcagggcaggagggtggaggggctgtgaccgggggcctgcgtggaattccgtacagtcagagacacctgtctggcctctgcggagctcacagtcacatcctatgcaggtcactcagaggggtgacttgtgggaccccgattctggcctttgtggcatcttcacttctgcatgacctgtgtatctgacagattcttgatttgtacgttcatggaatgtacctaatggaaagatctttgctccctgggccacagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagtcagtcgcttctgattcttgtcacacgctactacctcactgcctttttctctcctacactaagcaagtgagggcatttttagggtagggttggggctgatctgtgtggtccaataagggcagctcgttactatgatgagcattcattattctacagaaagagttagttagttaccagttttccaacactgcccttgacctcagctgtgggtgatagcgtaagccccgggtcaaaccttgctgctggaagagctgtaggcagaaactcctggcaccttgatcgcagctagctccacaggggccacaaggaaactctgcgcccacctctctcccaccatcactccaggcatctactagcatgagtctgcaatgagagattatgtttcctctttgcaaaactcttgatcctgaggacttaaaagctggattttaatagctctgtaagtggaggaggagtctcctctgttgtgggctctgtggaggtaaaggaattagctcttatcaagagtacaattatagtgcaagccagcagaatccatcacagcctgcaatgtacatcttcctaacccatgattaataaaacaccctgcttgcctactaagccagagggctgggatgtacaggatccattgcaaatgatacttactaatcttttgattagcctgaaggtgactatgggaacagtgtgtgggttgcaggctagttgttggcggtgttatcatgtgtctgggctggctgacacccttctgtcttccttctccctctcacaggagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaagtccctgtatgcacagaggtgttccctgtgaggtctgccacagcaggccccacgtatgctgccagtatgtgcttaggtccctggagtcacttattctgtcctgttctttctgttacaagagtatgacagtaagtccctgtacgcacagaggtgttccctgtgaggtctgccacagcaggccccacctacgctgccagtatgtgcttaggtccctggagtcacttattctgtcctgttctttcccatgccaaggtcaaacagcacaaaatcataaattcccagtgcagacatgggaacaaaagaaaacctcctgtgccgccgccacctttccgggcatgtttctaggtgatagttgaagaggattctgcaccaagtgtctgcaagaatggaattaca

SEQ ID NO: 123397 - DNA, 1048 bp, Homo sapiens
ttgattctgcactacagaggagaggcacctcacctctttttctcttctccctaatgaagacagcgattctagcccccttccttacgccaactgtggttttcaggtgacacaatggatcccctccttctccaaaataatttcaggtattctgctgtgtctgctgaggctggggtccccaaagatgcaggcacagcacatacttccatgctgcagtaggagcaggtcttctgtgttactcccacccagcactctggagtctgttttggccactgtggtgcactgaaccatgtcaccagggacagagtacaccgactcctctccctgggttgtaatggatagcacaaagccctcattttataagtatcatttttctaaataacatgctaggccagaacaaaggccactgcaaagccacaggctcttccacacagtgaggacaccgctctagaatgttccacttttaggtggtcagggggacagtatttgctcttgtgcttccaattagttaatttttcattagtcactttaaaagtagcactcttaatttgggattctaattgagggacttacgctgccacgatctctgctgtagttggggctgtaaaatgctttccccgtgagaaatgcaagcaggaagtggtggacagccggagagctgccagagccttctgcctccccgcatttttattttgatgacctgagaaaaggcatcacatttctggcttattgatttctttttttctttgtgtatgtggttggagtggggaagttggtgggggatgaaaagaaaggaaaataaagccattcatcattgcaactagctattttgtgtagaaaatgttttcttggtttctgttttatgtgaccaagcacttacttactctgcataataatgcaaagatgttctgcgtgtaacctcagtgtcccatgtaaggctccatgtgccctttctacaacatgccgggtgatgctgctagggtgttgaaggccctcgtggctttccacgtgatttacttggggcagattcactcaacagaagcgtccgatg

SEQ ID NO: 123398 - DNA, 1260 bp, Homo sapiens
ctttgtatgcctttatgtgcttatagcttagctcctacttacaagtgagaccgtgtggattttggttttctactcctgtgttacttcacttagaataatggcctccaggtccatccaaattgctgcaaagacattatttctttccttttcatggccaagtagtactccatggtgtataggtactgcattttctttatccactcagaatgaggacattcagttttcagtcatccatttatctataccagcaagcatgtatctgttactcagcttccaagttcgagggtttcctaagctttccccagcttttacttatatgcaggagacaaaaatgtgctggcacaagacaaaaggagaagcagaaaagaaaaaacaacctctaactcatcccaaacaacaaaaacaaaagaagatttgccactggcctgtcctgagttttggggtttgtgcctcgtcttgccagccttactcttgctgagctaatacaagagccctcagcacgtgttgctgagggctaagaatgctcctaaatgctaataaaatttatttcatttgacactttaatattagctcccaaatttggaaagttggcaacataactgtcttcaagcacaagtcttacagatctccgaaaaacatatgacctaatctcaccttgtgaatggggcgtttattctttctttgcttctccttgatggtgccatcactcagaagggtctgggagccccactgccaaaacaacactctacctttctcctttcctcatagccccaaggccagagtcagcttctgttcgcataactaacttaaaaggtgtcaacatattccaactgtgtgctctctccaaacttatcttcgtgcgatgaataccttattggaagaaaagttgtgatcacactagttcattttgatctcatctattttaagataaattgttctcttccaaaagctcagggcagtaactgaggataaagtcgagatctgttgactctgaaacctctgcttttcactcaccttgttgatttcatgccgtgttctctcctctaggtaacagcgaccagtcaggatcccaggagaagctgctcgttgacagccagggcctgagtggatgctcaccccgagactcaggatgctacgaaagcagtgagaacctggaaaacggtaatgtcagcatgagtcgctgggaacctgctttgacaagtactgatttcaaagcacagttttctgcaaaaggacgattctattcctgtcatgaactca

SEQ ID NO: 123399 - DNA, 1498 bp, Homo sapiens
ttagtatcaactaccagtcgtcagataagtagattatgtctggttgatagttcagttatcagtctggcagttgtaactaggactgttgctttgctgggacctaaaactttatcagtattttgtagattttctttggcaaagtactcacaaaagtttacctgtctgtgtccaggttggttgattgcttctaggataaacttactagaaggaggggcttcagggaaggtgggatttgagtattcacagatcactctgtaggggataccatttatagaacctgttgtgaaattcagtccagctctccttttccatcatgaccttgagaaattgtactcacccaacaaatctcatcaatatgcggtatgatgatcagcctctttccacgtcgattgcagtggggcacagacttaagccaagatttattttactgcttgacacagcgtatttctttcccatgtaacccaattaatttcagtcttcatgattcctttaataagactaagaattctttctaaaaataaaaatggaaccataataaccctctatcacccgatgtcataaatggtgattttatgtttttagtgtaattgaacaataggatgtgggtgttggagatttcaattatgttagcacaactttatgcatccgtttgattgatttgcttttaaaatgtgattgtaaaatattcccttgtctcacaggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccct

SEQ ID NO: 123400 - DNA, 1089 bp, Homo sapiens
aatccacgtgtccacaccttacttgacatgcatgtgttcagatattgacaccaccccatttcatctctccgtaggtaaaccgaggttaaaaataacctgcatgaagacctcttagagggattactaggagcaaataaaataaatgtggacaaaagaaccctattcagatgtgataattgtattatacagttatctgtatgggtaatgggaaaaagataatataaaatcccccattgtaccaaaaacatttagctgtataatgaaaaattatttctcattcaaaaaaaatgagatctaccaataccaagtgactccaaagacaaagcaatgctaacagatacagcagtactttactcctggaaatacaggtcctattaggatgcattcctgagagtcctttattataaaattctcatgacaatgaatgccttagaatcagatcctcctccacctctctgaccctccttgatatttcctgagtgaatgtctttaaatgaaaggtagtgagaaagaccatacagtaaatgctggcctagtgagctggtggtatcacttgtagcagataaagtgcaaacagttgaatatctgtaaagcagaagttagcccttctctcctgcagtttagaagactctcttcagtaacattagaggagttgtattttgcaaaatgatctgattgaggcgaaggcattgtcctgaaaaatgtggaataattgtgttctgccttaactatgcttcagaacattttcctagagctcatcagtactttaagataaagatgtaaaagtattccctctaaagcattcatcctgaccaataaagaaaatatattcatttcaaattcaaacttttgggttgggtgtggtggcttacgcctggaatcccaacactttgggaggccaaggcgagaagatcgcttgagcccaggagtttgaggctgcagtgagccatgatcacaccactgcactccagtctaagtgacagtgagaccctacgttatatgtggtgtatcttagggaaagaaaaacaaaatccttatgactcttgatgtcatattcctgttctccctggcagcatggccgctgtggga

SEQ ID NO: 123401 - DNA, 2060 bp, Homo sapiens
atactattattatccttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcacttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaag

SEQ ID NO: 123402 - DNA, 1136 bp, Homo sapiens
tcatccagagaggcatctaaaggtgcctctgctccagaacagtatttgatgcatataaaggacatagaaatggctgacacttgggtttaggtagtttccctggtgcgaacctcaaaaataccggcctgatatgtggtgaaatcttggtcaacctcaatgctaatgctggaactgcctcttgcacagagatgcttaactcaggggtccacaaacgtgaatagaagaattttatcatttttttccttccaactaacttctgactgcaatttagcattttcttcaattctgaatgtaagcaacaattgccagtattagcactgtctgtgacatcacccataaaaaccacagatattttttctttctttcttttctttctttctttctctttcttttcttttctttctttccttctttcttcctttccttctttctctctctctctttctttaattcttctttctttcctttctttttctttctttctttcaattcaaacaatcctacagcatttattgtcatcttgtaatgacataagggtaatccaaacaatgtgaataaatgttcatattggacaaaggacatctaaaaaacaaagtgtatccttctcaacaatttctcacttaattgatcatttctagttggagacactttgtagcagagtaatagtacctccttttagcatgatctgacccagctgtcttcttgactttgttttagaatgaatctcttctgcatcatctaatacaaggttcttacactcatcaaaaccaatgataaagcttcctgtccagattcacttgctcatagacccacacctgaatccagggtctattttgtaagtatctgaagatgaggttgatgggctgcaccataaccttctgcactttctggccctggctgtggtacaccatggtggaatcccacagaaagcacactgacccacacgctacctcagccagcaacttctggaataaaaaaccgaaaatgggctgggcatggtggctcacacctgtaatctcagcactatgggaggccgaggcaggcagatggcttgaggccaggagttcgagaccagcctggccaacatggcgaaaccccctctctactaaaatacaaaaaaatagctggttgtgatg

SEQ ID NO: 123403 - DNA, 1051 bp, Homo sapiens
gcagagctccgggtgtgaagcactgtgttaccatttattagctgggacagcttgaataattttattaacttctctgaacctctgatgttttgatgtatacaataggattaataattgctgttttacaggatacttctctaacccaaggcctgacatttaagttcaacaattgccaattttctcagcttgttctttgcttccctttaactccctcttcatttagcacacatacacatatgagtgtacacacacactcatatcagaacacagctgggggagtatacagattcactgataacctgacttccaattgaaagaagcaatcaaacctagaaatacacaattacttcactagtatttggcaagggctcttcaacacctgacaagttccggtaattcatccatcccactaattacatatatgtaccccttcctgcttcttctcttctgcttcctggagatagtctttaaatgacacattttttgcacagcctgatttcctctgttttgaatttatccacactactttttttgttcctgcattcacaaaataaaaatagctgtgtggagggagtatgctggcgcttactctctgggatagccagctgttctaggattgcactagtgatccataagatacatcctttcagaaataatcacaatgccaggcatacactgtgcctgctcccagaacttcccccattcatgacgaaactaccacgtccagtagtacgcccactttcttttctcagttcccacttccctctcattgacagtcagagcaagagcagtgaaccgcagaagcagatcttgtgtcttcacttgcttgtttcccaagctcagcctctctgtgttgccttgctctgttagcctccagtaggtgttgcggcaagtgagagccataccatctggcatggccaatcacccagttccttgagcagttgaaggcaaatgctgattttacattatttcgtagaaagttgtattttgtttggggaccttaaaaaccctgaccttgtcatccagcacagagcttcctgctttaacacaa

SEQ ID NO: 123404 - DNA, 1043 bp, Homo sapiens
tatttaaactatttagatatgagtcactttgaggaaaggttattatatgaaaatatcactgaaataatcagaaatttctttaaaaaatgctgttatgctataattcatttcataaagttctgcttacattcataaacttgagccgtttgtacagatcacttattatcctcatataataattttctgacacatccaatctgcgtggctgtgataaaaaatgatccaaaatgttgacctataacgtgtcttaagagctcttaaaaaaaagataaaatccttgaatgatgccaggcatctagaataaaattgtcaagagaaactcaactaattttgagatcaaattttaagatcaaatcttactcctttattacaaatgttcagtaacgatctcatcaacatgatgtctgtagcaaattatttttacttaagggctcagctctgacatttgaagtgaatggttgtgagtgccagtttagttcaggaaaatgctgtggttaagggctggcccattttcacatggaataatattattcaggtcttgttttgtggtatttatgttgtaaataatacatccagagtccatgtagctacctatgcctgcccgtgaatgatacctacttagcgttgtcttagatccagtggcaataacgtttaaatgctgaaggaaatatcttttggtttgctgagagttttaattagggttcactttgctgctaagacagcagcatttaagctactaggttcttggcacaatattgtttccatatttctttttctttccagaaggcttaattatttcttcacctgaattttaacaaccattttagctgaatgatctagaaactgtcctcctcaatgtgtgttctgagtcagcagcatcagcatcacctgtgaactgttagaaatgcagaatctcaggcccaccccaaccccactgaatttcttagaagctgcatccaatggaagcatctatatgaaccacacttttgagtagcaaggatctagagttcttgtgcagatctctctctctctctctctctctc

SEQ ID NO: 123405 - DNA, 1038 bp, Homo sapiens
gctgactactgaatctggactggaacctttttcaattcagtgcttttctgactccaccactctgactccctcaagtgcagtggttctcaacagaggtgactttgttctccaggtgacatttggcattgcctggggacttgagattattactggcatctagtgggtagaggccagcgttgttgctaaatgtcctgcaatgcacaggacagttcccgcaggaacaattatctggccccaaatgtcaggagtgctgaggttgagaaactctgctgaatgtatggatgagcattggtcaccaagatagaggagaagaattcaatattgctcttccattatattttcctaggatgtggactctatgttttagacaatcttccgtattaaaactatcatgtgaataaatgtatttttgttacatatgttttctggagtttacatgtattggtggacaacacataagaagtgcgtagggtcagagaaatgccactcgaggtcattatttccactcaattgctcactggggaaaaaacaaacatgagttctattctgtaatcagtactgctggcaacagtactgatcactaagcactgtgagaagcacatttcagtacaatactcttgttgtcctaagttctgtgaccacttttcctagattttctgtttttcttgggatggaaataataaatacttcctcttgcctcctctcagtctagagtaacaataagggggacatgtaaatccaggaatttcacaccaggatcctggaggttagctttcctgttttcttcttgccagtcttatgcattacatgggaactcatatctatcagcacaaaactcagtaaacgattgttgagcgagtaagtcaggaccaacgcgtcaatcacatgatgcaggatgctgtatctaagcttgcacacttactttaggaaactcaaatggaaaccccactctcaaatagtctaatctaattacctttggttctggaaagcagcatccaagaggaaagagattgtaaaatcctcagaggaagcggggaa

SEQ ID NO: 123406 - DNA, 1034 bp, Homo sapiens
acattgctaaggctcatagctgctgcttctctggagaactgcatccaaatccctatcccagactctgcttctagggaagctaacctaaggcatcatcacaatgcttccccccaaccccaaggaatcgtagttcttacaaagatgaattactttgaaagtttagatagaatataataaatcagcaaatcaagaataaaccatctgccatatttttgaaattatctttttgtcattttaatttttcacttgtgagaacacaatgtatatgtaagtttatttaaggctcaatggagcaagactttgatggatctgggcataaaagtatgggtaggaaagattatctgcagcaactcaattcaaaattaagggctaagggcttcagagatcactttaagtcacacattgatttcattttctctctctctcatgctgtttccctctatatggagaattttatatacactctcttggctcttaactacagccagatttgtaagtgacgagaattgagggccagggtgggaggaaatgctaatatattgtcccaggttttatgcttgggaagcatgaagaaattcaaagagaccaaggtgttctcaggagtaaacatatcccttcacccaaataggcaagaacaattttagaactgaaatcgtgaaaggggtcttagagctttgagcagaacggtagacccagaaggaggctattttggtccccttgctagcacagattttgattcaatatctctgagcttcattgttttgtaaggattaaacatgcctgttagattgtcttctacaaggctctgaataaatggtaattattttatattattgatgatggtgatggtatgaacatttttattattatcatcatttttattatcgttagagagtgtgtcttcctaataaatcctgtggcaggggctggagttctgattttagagtctgtggaataagatgatactgttgcaattgctgacttttcagattatagtattttctgccaaagaagcctggtactttgtagatcca

SEQ ID NO: 123407 - DNA, 1050 bp, Homo sapiens
ttgcctctgaggtatcattgtttatagcagtcctacgttttcagattatctcaacctgctggaagcttctctgtcttttgaatacctttgccattcatgtacatacccatcagtgagtctcagggttggaagacaccataaatgccacttcatccaaagccacagtttagtctccagttcacatgtactgccttgtggcatcattccagtggttgtcttaatcttttttttaaatattatattgttcagcccagtgtgtatacatatccatcctcaccccaattctgctgctggatataaattggcagctgcaacagtatcatgtacagaaagttggtatcaatttgagagggaaggagtgttctctgctggaggacagggaggagacagagccatcttatctgtttttcccacattttaaaatgcattgccaaagtcaattttaggatgcagttgggttaaattagtagctagaagataaaacccagtagccagaagcaagctgaacattaaaactttgggactctgaccacagtattgaacattatggctgaccatcatggggttaaaaggttaggaagagagtggaccagtagccatatatttttagcctgcttagaattatagttgcctttggaaatttttggtaaactcccatagatcaggattagaataaaggccataaatatggttcaaaaactgtactttcaacacttcattatatggtttgctattggctttagtggtagtgcattatctgaattgatgtaaatagtatttaagtttgtcttttcctatgagtaataagtattgtatgtagatatttccgtttctattacttaaatagatccccacagtagtttggtacatagttgccatgcacataattactgcatggctattattaggaaaattgtgtgggtaaaatccatcctgctatttggctctgtttgaaccttgatgcccatctgctaagcaatgtggggtcaaaataagtaccagggtagttctggccttggcctttttggatgtgggctcaactctcttttc

SEQ ID NO: 123408 - DNA, 1036 bp, Homo sapiens
tgaagaggaagttcattcagacagatgggggaccttaggattttatttgtaatttacagtatagtctgtggctgctgtcacactacaatgacagagttgagtgattgcaaaagagaccgcaaaacctaaaatatttactatctgaccctttacagaaagtttgccaaccacctgctaaaggatgaacatttacctgatgtgttacatttactccccttagaacaaataagaccttcaccaggagactttgatactttgctagtctgtcggaagtctgtctccaatagccacatatgataaaatgagctagaatggagcacgttcaaaacacaagattgaagtgaagtggcatacatcttgcagtcgacgatgtgtcttaggccactgaaataaatgatttcattttatttgccaaagtgtgacttggggtgaaggagacacctggcctggcctcgtgctagattggaccctcgatgtgtacacacgacttgttctaatatcacttttcattggaagtagacaggtgcaattaagtaacctagagaagggggtaaaacacaggtcttcattttcccattgagagagaactctgtccctaattcagttggtgggaaatggatttcttggctttgataattaagctggcaaagcaaatttggttccaacattttaatgagccagtgtgggtggccaacaaattgcaggttcagacgtaaatgtttcaaacctgggtggctggcttttaaccctggggcaaattctatgatggtaaggaaattttaggctggtagccaagttcaaagagtctttgccaaatattaagaaaaatgcctatttgaggcaattttaagttatttgaggacaggattatgttgttcattggatgtgattgagatgataaattaacatcatttgagtccactcaaattgtatacttgtgaacattcatacctgtgtttttgtgtctgaacttcatacacagaggattatcttgaaagagagggagacatgagaaaggagaaagtggtcttgctcc

SEQ ID NO: 123409 - DNA, 1056 bp, Homo sapiens
tttattttgatgctcaagttttcccagatttggccagtgggaatctcatcaacttgtgtcttgtgttctttctacatgtccccgtcatcctttgagcggttcccttactttataataaaacaagatgtttcagactcaccttttatgttccctgcactataatcagctatttctttaaggctgtctggttttttttagtagagaatagtgtttattaaccaagatctgggtgctgtgtttgcacattgctactggaaggttgctgcttctagggaacagagatagaaaaatatttgagtgtatacacgtgcacacacacgtctatatcaatttctagatgtctgtctatacttgaaaaatcttatgcttacattggtattccaatcctaatctaacactctaggtttgttctactctttcctctttccatatttataactccctctttgagaagaaactgacctatgttgttgtcaatatacttacatttttgctcaagcctctgtgtacacccaattctcacacttatgggctgcctcctttgctctgatccactggccctgaccccaaaaagacgtgataattcttaattggcaagatagatgaaactgaagtaaggagagaaagagactgaatgtatagaaagagaaatgagagagagagaatatagtattctgcatagtctgtaaaaccaagccccatgcattgtctcaaggcaggtttttgacttctacagcctcagtagccatgaggtatgaaatatctctgtcggggaatatgagtaatttgccatttcttcaatgatacaaacaaacctgatttcccttattttgggagggggtttgtgatctcaaatgtgaagcatagttaataaggataaaacgttacttttgcattgaaagcaaaaatcttagtggaagaacttgaaaaggcaaactatatatattatggatagtgcaaacatttctgtgtgtgtgtaaagaataaataagattttaattgtttttattaataaattaaataacctaaccagtaaaaagtgctaatagagctgat

SEQ ID NO: 123410 - DNA, 1056 bp, Homo sapiens
acattttcttaagtacagaatctggtcaatagagtttcctgggtcacttgaatcatggttacctgtggcatggtatgggggtgagaggtggggtgacacatcccctttctagacttgagagacaggcagtggacaccaaaagtgggagggatgtgggttggcagtctgactaatatgtcccctgatgataggccagcacattctgttatttcggttggaggctgaagttattttgctgggcaggctgtatttaaattgcttgtttggcttcagtagtggcaaagataggaacacaggtcctttgtgcatcccctttggaggagcacattgttaattaaacagtgggtgcctacttacccaaaaaagcattgaagttagatacaaaacatttttaagcctaggacttgagccatgtaggcacttaaagagaagtctaatccttggcatagctggcaaatactttatggcttattgtctgtactttcctgagtctcaagcacctcctggagttcacaagctatctgaaattgcccaggaagaagttctggtaatgcattatgggaccatccatctttccacggatctgctggtatacaaatctcaagagagcaagatattggcgtaacattgccatgagctcaacagaagctgactcagctgcctttatgcccaaaggaagagttctcagcctaatagatgcagaagagagtgaccagcttctccatgttttcccatggtggggggaggagaaggctctagaataatgtggcatctgggaaaagaggaaatacagggaaggttggcctcagtgtgaatttctacaagggggaaatacctccctcatttgaattatgagaagcagagttgtaggtaggggtgttgcaggaatagggttgaggagggggcagatagagctattaagaggtgtcacaaagagacactgagagctgctagtcctgcaagatatcatggaatgagtcaagattgggacctggaaatcagagacaagagcatgaatttgacagtggatagataaatgagttctgtctaagagca

SEQ ID NO: 123411 - DNA, 1023 bp, Homo sapiens
actctgggagctgtagactggaaccgttcctattcatccatcttggaacttccaacactttgcatctttcaatccaatcaagttgacgctcaatattaaccctcaccggaatgttatgtgttgaggcaataattaatagttatccttggttgtttcagaaaatgtcatgattaatagttatagtaaagggaggaattgtaacttgacaaaatagtttggtctagtgtccagtttacagggcattgagatggttttctggtttcccttgttttgccctcagtacacaatgctcagtattcagaaaggctgatgtctattttctccacaagtgctaataaaaatttttaaaatgtggtgtgcattatttatatagttgttttattcataaaagatttaaaatctaggtaagctaactcaaaatgcgactttgtactctgcgatttttaggcctagaagtggtcatgactgtgaacattatgttggcttggaacctttaaaagttcatttggtctgtactgcaggtggcatttggatgaaagcacaggtggtacatacagtacttcgatgactccatctgtttggtgtggcatgtttaagaatgacttctgttaaagggatttgactcgaaatgcaagccctctttcctggcgtgttggtcatttttgtgacattagtggtggaaaagaagctcaaaatggtctctggagtggagtaacagcagggcttacttttgaaattgtctttcaaatgcccttttgggcatggggtcaccgtgtttaaagcttttgaaagactccccacagaaatgaatcaagtgttgcattttcagtgtggtgtccaattttgtgatcagaggtactgtagaggaaagtcgggtgttttcttaaattcctttttctttttggaaaagtcatttacttattacgtttaatataaagaatgttttaaaaagagagagagagagagagaaaacacctggttgttagacaagctggctccatgccaaagtgaaatgaaacatac

SEQ ID NO: 123412 - DNA, 1060 bp, Homo sapiens
aagcttacatatgcatggcagaaggcgaagggagagcaggggtctcacaggactagacaggaatgggagcaagagagagagtgggggaagtgccacacacttttaaacaatcagatcccacaagaactcactaccacaaggacagcaccaagccaggagggatccacccccatgacgcaaacacctcccaccaggccccacctccaacaccgaggattatatctcaacatgagacttggaggggacatccaaactatatcaatatatttaattatcttaactctgtgacttactgtcctcaagttgtaaatggggccattaaacatcaagaaaattaagtgatatttccaaagtcactcggctagtagagggcaggtctgagatttgaacccaggtcatttgattctggagcctgcaggattgactctacaacccctgggccatgttctttgtcactactcagttctactgaatccattaagtgattcccctgaggctccttttcaccatccctcttgcataagcgtgattgtgtctgattgtggctatttaaaatacacagcaccctgatcattcatttcatagtcctttctcttgtcagcaattctaccaatttcttctttattcgttttgttgtttttgttgttgttgttctctattggattcacgtgggcatggcattgggctcctctgtgctgaccacgtttccttatctcctctccatcccagtcgtacagcctggaaagagggggtgcgtttcagggatgagaccagagggtatctttgcttcagattttccagagccttcttacttgcggatcctgtgggcccatgaagtgtgtgggggatcatgtatgagtgtggggggtcatatatgagttggggggggtcatgtatgagtgcggggatcatgtatgagtgtggggtttgtgtatgagtggggggttatgtattattgtgggggtcgtgtatgagtaggggggtcatgtttgagtggggggttgtgtatgagtgcggggattgtgtataagtgggggcatcatgtatgagtgtgggggtc

SEQ ID NO: 123413 - DNA, 1036 bp, Homo sapiens
aatctcatcttgaattgtagctcccataattcccaagtgttgtgggaggtagccagtgggagataatcatgggggtggtttcctccatactgttcttgtggtagtgaatccatctcacaagatctgatggttttatgaggggaaactgctttcactgattctcactctcttctcttgtctgctgccatgtgagatgtgcctttcaccttcagccatgatcgtgaggcctccttagccatgtggaactgtgactccgtcaaacctctttcttttgtaaattacccagtcttgggtatgtctttatcagcagtgtgaaaatggactaatacacaaaactaccacaagttcctaagaaagattacatttttttccccttttaataacttctttagatttagagacacattgacagaaagaggttccatgttctatagtaaagaaaccatgatgtccattccttgctttgagcttaaagatgaaaacccaaatatattataatgatagtaggtaaattacttatagaaggtattgggagtacaatgaccttcagttggcttggttaagcattggtgaccttggagaagatttctggatccaaaagtccccatttcccggagggcaggattgctggattttgtgtgtatacacagtctcctttggttagcatcacttttacttgcaagagtagatttcagagaaaaatgaatttcttgtttctgtctcccaaaacctcaaagcctatttttcaggatatagacatgcccatccacctggttttcctcttctctgtgaggacctgcaagaagcaaataaatctctggcacaaaattgtgttgtgtgcagggccgccctgcctagcatgcttccatgtggccacagctcctgaagccattgctgctgctaagagggtgcccctggttccacgctcctattcattgttctgtaaagaacatgcgatgtggtaaaaacccacattgtctgattttctttgaaaaacaaagaactggcgttctcaagaagtttataatactttctt

SEQ ID NO: 123414 - DNA, 1041 bp, Homo sapiens
aaaaagaacaaaatatttttacagcataacaaaaggctgttgatgataaacctgaatcatccatttattggaggtctgagaacttaaattagtctatcagttcatgtgaatctctttcttaaaccttagcaaaaaacatttcaatagtttactcttaatcatctaattatttactgttgattttgtggttgtatgaccattgaatgcttgaattatagctcaaagctatcattcattcaaaattaaggattacaaggatgtgttttcatatattgttttgtattatgctacatttcactttttattggaaataatatttatcttgtaattttctctttgagaataagtatattttggtaaaattcctcttcagttcactttgtgagaaattcaaatttaataggcagtaattgaacttttttaaaagagcactgatctttaatggtaatcattgtgatggctgctaaaggatgtaataggtagtttcatttgcctttggtcctgagcaatctgaacaacagaattccaaaagtcccattcatatagagagatgcccgtgcgcttcctaccgctcagatacggtcatggtttccttttaatggtggtaatggcaccaaaagtagatgtttgattttttaatattcttccacatatatgtataaaattaaaatttcccatcttactctaaaaagactctacttgtattccaattgcaggcacccaaaggtgctttgtgcaggcagtttttgtttagtttttgttttggcagtagagcctgtaggtcctcagggatgcagcggctctcaggatctacattattcatgcatcgttgtttaacgtccttctagcagcaaggatgtgtgctggcagaccacctccactttcacttagaaaattgccagctagtgctcctgccttctaagtgattactttgctttgctcgaagtatctatatgaagataaatcttttgctaggtagcaattcctcaagcactgtcccccccgccacagcaaaaatgatggcagatatggtgtgttcaa

SEQ ID NO: 123415 - DNA, 1004 bp, Homo sapiens
caatcgaattgattaatactaaaaatggaacaactgcaaactagaactaatttgagaaccctcctactttcatcctcagagtttgtctaataaggacttttggacgactgaatacatagcatgtaagaaagtgttagaaatggctacaagtctgatgtgactgcaacaatattactcataatgtttttgagcacaacaaaaacatacagggtacatccacatgcataacagatgttcacgggaagatgaggttaaacaggacttccacatccacgtgggtttctccacttaattttgatcataaaagccatagagaagttgaaaggcctcttagaagagtggacagaagccgccaagcacaagtgcagtagggctaccttgtgtatgcaaaaggaagacaagtcccacttggaaatatgccttcaggaaggtttagcctcgcaaacttgcactctcccattgtgcttacatttcatgtgtgtggcatgtggatttcatttctctttctgtcaaacatacaagtattccatggattcctatggacccaactgcagtttgaattttagaaactgtaacatttttggccgagcgcggtgcctcatgcctgtaatcccagcgctttcagaagccgaggcaggtgaatcacttgaggccaggagttcgagaccagcctggccaacagggtgaaatcctgtctgtaataaaaatacaaaaattagccaggcatgatgctgtgtgcctgtaatcctagctgttcaggaggctgaggaatgagaatcactggaggctgagaagcagaggtagcaatgaaccaagattgtgctcctgcactccagcctgggcaacagagcaagacctcgtctcaaaaaaaaggaaactgtaacattctgtggtaatgagatacccagtttatggctgctttttgcctattatttgtgtactgaccacagaagcttaaagggtactgtggcattaaaagtgaatctctttgttcctcatatgta

SEQ ID NO: 123416 - DNA, 1031 bp, Homo sapiens
gctgagactgtcctttgagcaaaagaaacctcaggcattgcctctatttctaaggcattgtttttcttaaataaataaaatgaagaagggctttggattgtctgctttttaagtgtttcagtaaatatctatgttttccaaatacgtgacggtaagaaagttacgctcttggtcttcaactagttcaaatttagcttccaattgtaggctgagccaggggcccaagataaggtgtatttatattcccttctcagctgccttagctgggtgacttggatttagcctctgtgaaccttgcttgtctcatctgtacaatgggaccatattacctactttgcctgcattacagggttgttgggagagtctattgagcattctacacagaagtgctttggaagctaaaactctccaaaacacatttcagtattgatgctcccacccccttggctccgttactggctccacatgacctaaaggggccatttttcctccagacctggagctcctctgctcagggagtccatagaggctgctgttttcctggggctcaggacatactgggtcctgaaccctcaggtctgcttctgctgtggtctcaaattgcctcactagattccttcccccgggaacctgtttctaaggaaactacttctctttgtgttcccaacagctggagatgtgttttgatcccagcccgctggcatacatttgtcttgtgtttatttacttggaaacctaagctcctgtaggccctgggttggaaagtcatatacacgcgcactctccctctccgaggagtaacgagaaaggcacgccagagccgaatgctccgccaggctgatgcaagccatccaggagcatggaggaccaggaagccccagcttcagagatacgctgcgaaatacatttgtcctgggtgtatctaaagcaggagtcacaggtgattttaggaccaaaggccacttctgggggttagcaagacctgagggtatccctgggagtttcaggcaaacagaaaacaagatgggtga

SEQ ID NO: 123417 - DNA, 1094 bp, Homo sapiens
ctccagcacatttccaattcatactctgctgtcaagggtacatcagaatggacatgtccatgtatttctggtatcaggattccgggagcgtggtccatcttgtgcatcattcaattcctccgcccttcacctgcacaccatgtcatcatacgtttttatctttgccaggctgagagatgagaaattatgtgtcagtaggataagttgcatttctctcgttatgagtgaagttgagcatcttctcacatgtttaagaggcatttgtattttcctttctcatcttatcattgcccattttgctaacattctgatctctagaaacttttcagaaaattacagaaatttgcccactatttttgatataaattgcaagtattgttttcctagttagtaatctcttttaactttctttgtgatgttttttacatgcagaattttatttctttgtggtcaaatttatcaacctttttctttttatggcttctgagttttgtgttatactcagaaggatcttattaactctgaaactataaaaaatattctccatggtgtcttctagagttttgttgttattcatgttaaattaaaatctttaatacttctgaaatttattctggtgtcaggtataacatatcaatgtagtttcttttttttccagatggctaacaaactatcccatttatacaataatttgtgttttcctcattaaagtatcacctttattatatgagaaattcttggttttagagggatctgttttttcttttggcttttattttgttccattaatgtgtatctttatatacagaacactattctatatatttatatatatacacactgttgtaacctattgtataattacataatacatagttttattatgtaatatgcaatagtataattatataatatagagtgactatttatatatacattttattatctggcagggtccagtctttcctctttactcagctttttccccaattgtcctaggtctttgtctttgttcatttttccttaggaactttaaaatcagcttgttcagggtcgggcgtggtggctcacgcctgtaatcccggcactttggg

SEQ ID NO: 123418 - DNA, 1024 bp, Homo sapiens
gaagctggctgagttccaaaagaaatccaagtcctgaatttctattacttctaacaaactgcattagcatgttaccaacacttataaactgacttaaaagaagactagggcattaaattaaaaagtaagccatgagactattaccaaaataaaaggaaagcaagagggatttgcctttgtccttgttcagagaaactgaaaacaaacttggattgcattaacagaagtatctgttctaccaactgcaaaagtgccaaaggagatcatataggtccccaactctgtcatgagtccttccaggtgaacagagaccttgttaaattaaggcaatcacattcagcctcccaagaagggagcctataaaactgagaagccaaagctaatccagtcctttcccattctaattaaagaggctgaagggcttgtctcacctaacactgtctcatcttcatgccacttcctcaaataaaggagtcagtgagaagttaccaattcacatggtaaataacaaactctcctgagttttttggataatcaaatgagttttcctttgttcattccatccctccccatttggaatttagatggaagaatgtctaagtcgatgaaaatccaactaaagaaacattggcctctttgtggaggaatctcacatttaagtacaaaaaaaattaagcgtttaggggaagaaagttcaaagacttttgcttcctttgttcttttaaatattttatttggagttcggcattacagtcaggacaacctacagtaagaaaaccaggctttcgtataaaagttactgaaaggtgctatacaccaacatacttttatatctaccatatttttatattctttatatctttcattttaaaatatttatttggtgtggcaggtttatggtagctttttatcgtcctctttttgcttggccatattttatataataaacaggaactggttttataatagaagtatttgaagacaaagaataagatttgatgccatgagatctttctttctttta

SEQ ID NO: 123419 - DNA, 1030 bp, Homo sapiens
tgcagagtaagatgagctataagaagtccaaagttccacagtggtatattttgcataataccgtttgtgtttccattaaattgtattgttgttttgactgacatagcacattacatgtttctgtatttttcttcctctctgttttctctgtgagttagccagagtcactatttaaaaaaaaaaaaaaaaaaactatcagaatcaccaggaatggtgtttttgaatataagattaagtaaaaaggaatgaaatgctgaaggtataataaagatggcataatcttaacaggtgagtggcaggtaaagtaactggtataaatgatttctaatcttagcaaagggtctatgaggcaagtattattgtcctcattttaccagatgaagaagttgagcttttgagaagtgaacatttgccaaagactccacaactcacaagaggtacagccaagatttgaactgaggtttgtctgataccaaccttggtggttttctctctctgccgttcatgaaaggtgaaaaagtttaaatgataaatgcagagtaaaagccttgtattaactcgtaagttttggtatctaagaaattacagccttttctagatcttgagattataaaactattcttaaaagttggttattgtcaggcgcagtggctcacgcctgtaatcccagcactttgggaggtcaaggaaggtggatcacctgaggtcaggagttcgagtttgccgctactaaaaatacaaaaaattagccgggcatggtggtggctgcctgtaatcccaactactcgggaggctgaggcagaaaaatcatttgaacccaggaggcagaggctgcagtgagccaaaattgcgtcattgcactccagcctgggcaacaagagcgaaactctgtctcaaaaaaaaaagagaaaaaaaaagttggtaccaggtacgtccatctgcagtttcatcgactgagattatgtagctgagagaaactgaggctcagagatggcacgatttagctgaggacacccagctaattaatctt

SEQ ID NO: 123420 - DNA, 1104 bp, Homo sapiens
acctccaaaaatatagtcaaaatgcagttcataaaactaggggaagtcaagtacagacatgtcccaggaaagcagaaccagaggagaagcagaccccgggcactcgcaggactatttgactcactggagaattcccttctgccagggcaggcttggctcactgctccaagcactgcagattcccaaggaacacccaggcccacagatgttcatgggtcacagaattgtgaactgaccacttgtgcattttggatttcaacttgtaaacatggggattccctttttacaaaaagaaaaaggagaggatgaaaaatcaccatgcaaaggaaagttgagagctaagtttttccttttggaatcttggcatgcgcatttagctatcttcaatctggctttcaccagacgctgtgtgctttgagcaggggtggagcagtctgccctgtgccgctctgccagaacattcagacttgacctgtcacaggcctcttattccagtcaggagcagacacggcccaggagatgggccctgccagacacagcaggctgcctttgaggtgcaaccagagaggcagtaaaaacctgggaggagagcatttgactgactaggctgggggctgcccaccagtcaagtccccgagttcaagtcccagctgttctgtttcactgggcatcagtgtaaatcatttgacctccatcggtctgaaatcgactcagctggaaaacattagaaagaaaataaaacatctactgaaaaccaagagctgcttctgggatgaaccatttcccacccttgacccctaaatgctaaaagactgagccacaacacttcctaagctgatgaaaggtttgttctcaccacagaacactgtatccccagcaagagggcatagaattacatatagtcattccaggttgcctgaagcccccgttccttcatgtctgcaagtggcattgcccagtatgctgtgagtcgatggacagcagcatttctgaaatgtgaattgagctcccaggagtaggcacatcctcctgggcatgagatagagcaaatgcagcaaggacctgtcctgaagaagcatcggtcccttcctcctggcctggttt

SEQ ID NO: 123421 - DNA, 3703 bp, Homo sapiens
ggcggcggcgctggcggcggccgtggtggcggaggcgacggtggagacggctgccctagtgggagaggcggcggcggcggcggccgaggaggaggagggggaagcggcggcggcaaagggtaagcggacagcgctgccgggcctcggcgggatccccaacctggctctcccctcatcgccccgcacccccctccgtctggaaggggctctgccgcctcgcgaggcccgtgcggggcgttcgcttctaacttgcactcttcctccctccgcctctttccttcccccagtggcgtggcggagagggaggccccccgagtcccccagtccggtgggggtggggagcatcgggccgggcctgggctccggggcgtccgtgcggggggggagggggagcttcattggaatcgagcgcctaggagagccccgggtgggggagggcgcaaggggctcgggagggcccctccctgcgtcggcgcccctgacccgcccccaggcatgtgtgaggtgggggcgggggaggaaaaatctccttttggggagccgaggtctagttaaagatgactcaggggcgggggttttggggacagacacggggcagttatgtgggggtcgggcgggagggagaacatcgttcctttgcggatcttggttttctgcagccgtctttgaagtggggggcaagccctactatgaatatgtggccccttaaatttcactggatgtttctggttttcggtcccatcaacctcaaaccctacgattgtggttgagtcagggaggctgcaagggtctcttggcggtgctgaacaggtgacaggtggatctttctgttgctgatgctgtgagatgttcaggcacagtcgtacaccaaagtgtcagagaccgtgtgagtttgtatttatgtgtttggccatgtttcattccatatatagtatatttgagatgttaggtttccattcttcaagtcagcttaattgttgtggataaattcttcaaatgtttctgataagagggttttccaggagagcggagggaatttgcagcctcacaggggtttctccgtagttcacgaaatttaggcccccagtgcaggctgttgagtacccttattcattggaaagttcttgaacgctaagatcgtattcagagcaactgtacggcaatataattttgcatccattttgtctgttttaggtaagtttgtaaagtgtctaattttggggtcagattgattcacattttagaaaaggaatttcgtttccgctttagcatactctaaaggttatgatgatcattatgcaattccagatttggccgggaattttagtgggcatggaatagaatatttgctttcagttttttcacttctgcttactacactgttcatacagtagcagagtattgacaccttttaaaaaatatctttacattctttgtaacaatgaaatcacgattttaaacttttgacggtttgaaactgtaaattttgaaaccatggcagtttgtaataaaggaagacttgcttttcttttgttgtaggctttggctgagcattttaattagaaacaatgggaagaattgttagatacatgagctataggctaaattagggtacagttagtttaaggattctgctgctttaaaaaaacatgtatggaacgaatatgatgtactatcaatgtgttaacaggaaatagaacaaaaattccagtgattcagaacttctgtttgggtttttcccccataggtctaatcagtttctaatagagggtgcttaagttttaaatctttcaagaatcaaactgaaagttgaatacgtcaattatagatgaataagttatcccctgaatatactccattatttcttttttcttttgtgtgcatcgagttacttttcctgagtttaaaagtattctcttaaggacactgatgaaatgctactattgaaccccctttagttaactatttcatagtagaacgtgtgctttagtgactcattaagaagtggataaaatggtcagaacctcatcaaatacatgttttttgaaaaataaattttaacttaatcccgtttgattgaaatcacacctatgcttggtcctctagtggaaaaaagcgcttgccttcagctaagggtattgctaagactgggaaacaatttttttttaattttgtttttgttttctttgttttttgttttgagacagtctcgctctgtcacccaggctggagtgcagtagtgcgatcttgactcattgcaacctctgcctcccgggttcaagggattctcccgcctcagccttcccagtagctgggattacaggcgcttgccaccacgcccggctaatttttgtacttttagtagagatggagtttcaccatgatggcctggctggtctcgaactcctgaccttaggtgatccacccgcctcagcctcccaaatgcctaatgaaatgaggtttttaaactccgcagttatgtaggcagatccccacttaggtcagtattgagaattgcttctttagtattaacaacttacacttggttaaatgtcttattacatttgtgtcttggcagaaatagaagtttattctacatccgtaattttcccagtaaggaaaatttcttttcccaaaatactgtttagagtgaaatgtacatatgtgtatctgtgaacctactgcattttgaaaaataagtataatgtaggctgttttactctatgagttacttgcaaaaaaagtccttgaggaatgtgtattttctaaaacagcatttttttttgagttatataaacagatcaagactaaaagtttattttttatcatacttcagaatttttgccttgttatagatattttgggggaaagttcctgataatctttataatatataaagttcataaattaaactgtaattgaaaaatccaaattataattccattatatctctctctggccaggttcccatgacccagagaacactagtagcacttttcctttgtttcacttatgtcatctttatttgatctaacattgggtctctctagaatggaaggattatgaggtaataacagaggcacatgtgaagattgggcaaaacagtaataaggaggaggagagacagaggataagatgctagcagagaattagatgaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagtaagtactcttaggagttatactttttatgttttctttagttaatcactaaacttgactgatcttgataaaactaaggaattagagattgctaagagggtactatctttttctaagtattccatctctcaaaacagcctatttactagtaagtggtacttaacctacattcattcagcctcctaggaaaagaaaaagatgccagaata

SEQ ID NO: 123422 - DNA, 1569 bp, Homo sapiens
tttcacttggatttttattgactcattttacagaatatgtttactttatttcctattccttagaaaaggagtgagcagagtgagaagtgtcagctgacaagtgatgtttcaggacatccaagtcagaattatcacaaagtaaaattgtgtatgttatatgaataaaagatgtctatgaaaattgattaaagttttggcacttaaaagtacatttgttcaaaatttaatttacatacacccccttacctttatgcttcataaatgaggctttgctgaatgtgactttttgatttgccttactcatgtgtaatgtaaaactttaataagaaattttatttcatttctaatcatgtattccagttcagaatatggtacccagggagtgatatcctgcataataaagagaaaggaactaatatttattgaatgcctactgtgtgccaagcttttcttcatttcagaaatatttattgagcacttattatgtgctagggactcttccagatgctggaggtgccgtattgaagaacagacaaaaatagctgttttcatatagtttacatttagtggtaaaagacttaataaatgagtacagtgtaatatgcctgggacaaaacagtactgtgcagaaaaataaaacggaaaagggagttagggaatgaacattgcttattgagcttttttaaaaactgtgtaatgggtattatccttgatttcaaaaagcaaaacctatcccatacataaaatttttcctttaagaatacacttcaaatttcagaacacaattgtatttatacttcaaagttacagagtttcaacagcgatttcctattgttagtatttcagaaagctgttttatggctggatagaaaatcggagtttttaatcctggttttgccacttagtagctttgccactagatttgggatcagttaaaattcgttagcttctctgagcttgttttcttctgtgtaaaatggatacgatatctttctttttctggtgaaggaacattgtgtcgtatgttgttgaataggttgatgagctggatctcagcattttaacaaggaaataacagtgtataaaattccaattcatgtaaatacttttaaaatatttagtacagtacctggcacatagtaactatagagtaaatgtttgctttttgtcatcattttgcttgttaattcaaagaatcttttatacaaattattaaggaaagtttttgcaaagataaaataactcaaattgtgaatgggatttttgagggaagagtggaataaccatgcaagttgcaatacttattttcatttttagactggaagatcacgaaacagcacctcaagtgcagaacatgtcttcctttcagtctttacttcacattattttcagtggttggcctgtagttaagagctcaagaaatactgtgtgttaaatgttgaatagttcttaatgatcatttttctgtaaattacagctctttttgtagtaaactcctgagtctgaaaggtgactgcactggaatctctacttttaattttaagcactgaataagatatcattatgcaa

SEQ ID NO: 123423 - DNA, 2712 bp, Homo sapiens
agctgggattacaggcgcccaccaccctgcctggctaatttttgtatttttagtaaagacagggtttcaccatgttggccaggctggtctcgaactcctgacctcaggtgatccacccatcctcagccttgcttttttaagcggtttttagcttttgctgttggaaaagtcaacatgtagagtgaagtattatgcacagaaatttgatttttgttttgatcaaatgccattatttagaaaacctaacattttcacatccttttggataggtcacttaatatcagtaataattaggtcagcaaattaattttgcttttttgtagtttgcaagagtttatcttatgttcagcaaagctaataattgcataaaaatttaagtgggagaaactggcctttaaatattaatattcagatctgtggtacaaagcctattatacagatatttgcttccacattcttgatatcctatggactattttgtcttttacacttttcttttatactagcatttcctgattgtaggtttctattagggttgtcatcattataaaatataggcaagatggtcgttttttaaaaatttaagacagattaaatgttccatttaattactgagcacaaattatgtcatagttgcctggttaattttattgatttattatttatttgtttagaaatgggggtttcgttatgttgcctaggctggtctcgatttctaggcccaagccatcctcttgcctcagcttcccaagtagctaggactacgtatggcatgccactgagcctggcaacttggttaatttttaaaaggcaattagtgacctgataaacatgagcgtctgctgttcagaagttaagcagctgtatgttgcagatgtatgtaggtgtcacagttaagtagttactagaattgtgagaaaatgtgctcaaggaaccatccaagggatccgtgtcaaataaaagttgctagaaatacagatattttataatttgcattgagagtgacttactgtttaccccatgattagcatgtacctgaattgtacttgactaaagtactgcttgccaactcttaggatgattttataggaaatggaaaaataagcacatggaaatggggatttcagaagaaaattcccacttccacatatggcgattctgcttttttgcatataaaagtgcattgacacgtgttgaatgccctttgagattgtctagctaaggtaattgtttggcctgcatgagacatactcattctcttcatgagatttttcccctcatgaacattgccatacatttaaaggatgacagagccattgctgtaattttgcaagtggaacaagaagtaagtgctcttgttgaaggtaattagttcattacctaattgaagttagttcattacctagttgaagtaattaggtagaagattgaagtggtcatcttaaccaaaccaagctatctatcagtatatcaacttttatagaatatcacatgatcgaaagaacagaaactccatagagcgtatttcatatgtcttctatgacatgcttgtgcagaatagctggctaacccaagaaatcttgccttactcattcttctattgtgtctcatctctacattctgtttgttttgtttgagagggagtctgctctgtccctcaggctggagtgcagtggtgcagtctcagctcagtgcaacctccacctcccaggttcaagcaattctcctgcctcagcctcccaagtagctgggactgttggtgcgtgccaccacgcctggctaattttttgtgtgtttagtagagacagggtttcaccgtgttagccaggatggtctcaatctcctgaccttgtgattggcccgccttgacctaccaaagtgctgggattacaggcacgagccaccgcacccggcctctacattctttattattcaaactaccttacttatccaatagttttgagttcctgctgtgtgcctgtactttgctaggtcaaaggggtggacagatatgtaagatacagttcttgtccttaagagacatatatacaaacacatgtgatatactgtgacaaatgctgtgacggggttaaacataaaatactttaggaatccataggaggtagtgtctcctatggataaggattaggcagtatctcctattcagtaagggatgaaaggatatgacagggaaatcttcctaggaaaggtgacacttaatctgagtgtatatcagataggcaaggaagagagttacaggctgcagataggtctttttagatagagagaaacaccatgcatgaaagatggaggtaggaaagtccacatgtacacagtaactgtgtgtagttctacagtgcattaggtaccagtggtgggttagctggaagtgaggtggaaaattagaaaaaagacagagcatcgagatacctgtatactccataaaggagatttaacttcatccttcaaatggatggaagacaagttcttaaattaacattctagaaagattctcttgttgtagtgcacaaaataccttagaaaagagccagacttgggaggaagaggcaggcatataagtatctatttgagagttgattaggacccaaattaaggcactgataatggggtaattaagaagaataggtaatgtgtttgagaaggaaataattgaatgtgacataaagcagtgaagatcacacatgccctggg

SEQ ID NO: 123424 - DNA, 1234 bp, Homo sapiens
ttctgatgtgcctgtgcatagagacagttatttacatttttttcttcccaatctgtatgctttttatttccttttcttcctctgctacttgcaatgctgtttcataatagtggtgggagctgacaagcttgtttctgatcttagtggaaaagcattcagtctttcaccagtaagtatatgttagctgtaggttttttgtagatgctgtttatcaagttgaggaagttccctttttatttgtagtttgttaagtgtttttatcatgagtaggtcttcaattttgtcaaatgcttttttctacatcaattgatatggtcatatggcttttattctttaagctggtagctagtggttacttacctttttaaatattcactctgctgtgtgtggagtagactttggagatagagcaaagatttaaacagggaaaatatattagaaattattgtcatacttagatgatggtggctgggaccaggacagtaataggaaagggtgagaacagatcagattttggatatgtttcaaactctgtgtgggaaggaattgctgatgaattggatctgaggcataaaagagaattcaaggatgacaagagatttttggcgcaagcaattggaagtatggagttgccattgactcagtttgggagcatggtaaagtagcaagtttagactgagcaatcaggagccttttttttggatgtgttaactttgaaatgccttttagacatataaccagtgatatcaactgggcaattcattcggtataatggaattcaagcaagagattcagactagaaatatgaatttgggagtatcagtggagttgatgtgaaagaagttatagtggtatttgtttaaaactatacctgtgactgctttctagttactgtaatttcagatttattagcaaaaagccagactcttctaacatgtgaaagagctttgtgaaaatttggattagttctgctgtgtatgtgacatgaaatgcaacagaaattttgtaattgggaggtgatttggggatggatatttaatatgtacttagtcatacttatttgataggtaaatggctgttaacagtggtcatctaatagtgtcttactaatttttagagctttgccctaaatctttataaaatgaagtaactacatgttgtggaaagggtttgacacttattaagtgcccgaatgactttctgtggcaacatttatcttacagataaaaacagc

SEQ ID NO: 123425 - DNA, 1051 bp, Homo sapiens
taaaaaactaactcggcaggtaaagtgcacctgtagtcctgcctactcaagaggctgagttgagaggatcacttgagcccaggagttcgaggctgcatatctatgattacatgacagcactccagcctggaaaatagagcaagaccttgtctcttaaaaaaaaaaaaaagaaaaccttaagagtagaacaagcagtcaaacaagaggtcatggtgttaggtgattgcccagataacacatacttgaacaaggacattgtggtggaaaagagaaatttttgtgaaagtaatcagtgaaactttgccattgattatatgtggagaggaaaagaattgagaactctgaggtttctagcttcagaagcatgtcatttataattaacagagaaatacattagtgagtaggaggcagtgagttgagttttggacaaggtgactttaggttgccagcatggtattgtcaggctattagtttacttgttccagtcccacccctcccttccgcctccctccttccctcactcgctcactgaattccattgctattagtctaagaacttccctttaggaaaagtaattttttttagtcacagtcagcagtagagcttgaaatttgtggagaccaattccccatttcctacccacattctcattatcctcttttggtccgtttccccagggaaaaaggtgaagattatttagaataatatctactaccatcattactaccaccccaccccacctcacctccaggaaattggtagaaaagtttatatatagatatgtatgtatgtatgtattatatatataaaaaatatatgtgtgtatatataacatatatataatatttacatacatatatttgagacagggtattactctgtcacccaggctggagggcagtggtacaatcatagctcactgcagccttaacttcctgggctcagccttaacctcccaccttagcctcccaagtacctgggactacagacaccagccaccatgcctggctaatactttttttctaactttttgtagaggcagggttttgc

SEQ ID NO: 123426 - DNA, 2658 bp, Homo sapiens
gtaacgtcaagctagtacaataaagaaggaaccttggacatgaggttagacagctacagatacatttctggttttaactctgctgcttattggagtttcgatgagtaaatattacttaatatgtttttttaaaagagtaaaagcaagttcattataatttgtaaataacgttgtatacctggaaaagccaagagaatcaactgaaatattactataagtaatgagatttcagtatgatgactagttaaaaaatttaaaaaagtggtttatctgaagtggtttttttatttgatggtctttaaactgaaagcctattcatatgagttactgaatggaaatcctcaaacttaaataccctttccccttctttctgaggaatgcagtaattcagtcttatcatctaagttttagtatattttgaataagacacttccatgttaactttttaaaacttttaaaatgaagttgtggcagagaatacacttaaaacaactataaggaaatcattttttaaaattccttgtggcttgtgatacttgctctattacttggtaattttagagagggtgtaatctgatctttgagccatatttggtaaataataattttgtgtggaacccactgttctatcagtaagaggaaaattattgcccatatataaggcttttctttgcccttaaaacatttcctaacttaaggaccaaattatatcatgcattgattgcttttatgtttttttaaaaaggattataccggatctatatataactttttaacaagagatgtgttgacagaagtattttatactttacttggaaagagaattacatgtcttcttgtttactactaattctttttatatcctaaatataaattgttatatttttatttatcatcagctctcaaaattgacctctctcatatactcaatttgtggctattctggaagataatcagttacatgtcttagaatgtgattatagttgaattatttaaaccgaaagcctgctacctagttgttgctttagcatttgtgaaaatgaaaacttaagtatacccacatgtttagaacaagaaaatgtgttacattctttaataatgcagaaaaatatattgaatgcctatatgtgccacactgttaagtgctttacatacactttagctaaatctcatggacagtacagcagggtgggtagtgatattccatttaataaaagagatttctgcagtttaatttcaaagccatactgaaatcagatctgaacttagacttctctctcacagaattccttgtcctgcaatgtgccatcacaatagatggaaaatttacatttttcacaaaaactacttttactctgttttgctgtttatattgctagttactggaaatgcagggaattcagtttttggatcttcgtcttcactacttttttttgtcctattacagttttcacaacatctatgataatttgagagcagcagaaaattctatttattttgactcctgtgggattagtttcttagggaaatgcctaagggtaccagcctaccaagcataaggacatcatttccaggttttaataatcaaaatagtacaacattctactattcataatatcctattatttctgtaaccttcgtagttgcaagtttgtttttggtttttgttttatatggccctaacaaaaattaaaaaaaaaaaaatcattgaatctattttggtaatggaaaaaaagattttccagtgtggttaagaaccacatcttatgagctgttctttgcctccctctttaagaattaccaagtatttttaaaaattggaacttaacattcaattcattgcttggatatatctaaagcatttcttaagaaacccctgggaatggatcataggaaattaggggagcgtttagaagatgattggaaatacgatagtgaaagggaagagaaaaatgacctgaaaatgaggactttacatttccaattttggattttgttgttgtttttctctttctgttagagttactctgtggtctcctgttggacagtctgttgctaaaagccattagagatttcataaaaactactgttttgagttgctggaactgagattccagaatagtgttgggtaggttaaaagaatggcttaaccaaagtaaacagcatcctttggttacttgcaatttaagagacccattttcccttcagaatattttatgtgagagactttggggactaccttactgctattacatctcataatgttatctggtcacatttcttgttctgcctacctctagtttactctagtttctcttctgctttcaaggctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccaggtatgctaaagtccatggcaccagtcaagcttagcctgtgtaactgccttattattaaatctatagtaactaaaacttgactttcaaaacttatagtcatcttgctttaaagtatagtaacactaacatctaggtaacatgcagctagtattgagtttaacataccttttgcctgaatat

SEQ ID NO: 123427 - DNA, 1036 bp, Homo sapiens
tattatcttacttggattactcatttaattctcctaacactcctatgaagtagctactctatcatcaccattttatagatgaggaaactgaggcacagaaaaattaaatgatttgcccaagaagttactgcaagtaaatagcatattaaacttcataaacgaacccatggaatcctagaatttatacttagccagctatcactgtgtatcaaatactgttttatataccttatatcataattgtctcatctagttagataagacagtgtgcacttatggaactgaggttgaaatatttagcaacattaggttatctctgttttaaactattaacatgttctttcaccagaaaattttagaagcgtgcatggctaaggtagaatactggttcttttagttctactcttttcttctcttcaggaaagtttatgcctgtctcagagtaacattttatttattcattggttccttttctttcttaagattttaatagtaaaggccaatactttgtcaagtttaaattatgtaaattgagtagtttatgtgagatacattactagttattccttttatttttaaaagttagatctctgggaatttagctttgctccaccatttactttgtatggcaccttcttgatagtaaaagatttttcagaaatttacctgcccaaaaacagcttttattttataataagcttcatttttagctgacctatggtgatccatatgtgtttattgtacatctacattttcctacactcttaaatatatagtagctgcagaatctgtttgtgtatacttaatagaggtaattttttcttcccctagttatttctttcccattgaatcaagttacatacaagtttctaaccattcctgttacaggcttgttggtgattgacttcattttaataatctttttatttcattgcctttcacccagttttttaaactcatgaaattccacacccctttccatctctattttccttccttaaatcaatactttactataagcacctcttatatgtga

SEQ ID NO: 123428 - DNA, 2602 bp, Homo sapiens
aatttcttcaaattttttttctacctcattctttctcccctttccttctgaatctccaattacaagtatgttatgataccttgccacaggtccctaaggttctgtttctctcctccccctcgcccacagtcacttttttattcatccttcagattggataatttctattgctttgtcttcaagttcactgactgtcatttcccatccatggttaagtctacccagtgaatttttttcagttattttattttttagttcttaaatttttatttgctttatatatgtataatttccatttctttgctgagagttccaggcatatttgcacttaaatccttcagcatagttaaaatagatgctttaaaatacttatgtgctaattctagcagctggctcatcttgggctttgtgtccattggttgccttttctcttgagtatgggtcagtttttttctgtttatgtgtaacaattttggattttatttagaacattatgaatgccatgtagagactctggattctgtattcctccagtgagtattgatgtttggtttgttatctgtttcaagccagataacttgactacacttaaagtataagctctgaaatcgcagttcagttattttaaccttagccttgctgcttgaatggaatctgtcgcacatatgtatagtttggagatcaaagataaatacagagtttatacacagaatttagggcctcctctctgtggttctctccttcctgtgatttactcactaagctttcagctgttatgatcatgccattgtctgtcctttggttcatcaagcaagtaagactgcaggttttttatctgagtgttagctacccaaactaactgggacctgctctctgagtaaaagccattaaaaaatggaaagttacccttgctgtttccttcttccaagtgctgacccctttttcttccctccaccaatttgtttcttcctccttcaggtagttttttatgcatttctactgtttatagttgttattcatgaaagatttggtctggtaggcgttactcagccatcacaggaagtagaacccataaaataaaattgtacaattgaagaatgttatcatttgtgtaggtgatagtctttattagaaaagcaggcaagtatggtgagagatttcagtgtatgttttaataatgaaatacgttgaaatttgttttcatggttcatcctcctttaaataataaaaatgtctcaatcagactatttgcctctccctcaaattgtgtataaatttttttttttcaaatctagatcatttgaaatatgttttggaagccttatagaaggaaactataaagaaaccttataataaaatattcattttattcaacaaatatgttgcatcttctgtgagccaggaatgatccagatcctggagatagaacagtgaacttcagagtccttgatcccatggggctaatgttttggggatggagagataataaaatatatctcaggtattgatacatgttatgaaataaaagcagtatgagggtgcaatggtgggagatggggaagagttatggcattatttagatagagggattggtcagggaaactgtctctgaagaagtgacatttgatcaacattcttaatgacataagagaagggagttgcaggtggatctaagggaaaactgttccagtagtaaaggagcagcaaatccgatagccctaagggaagaacaagagtgacttctttgagaaatcaccagactgccattttgaattgagggaacaaggagagggtagaagatgaagttagaggggtggtagatagccaggggctttgttacattgcattttgaacagggaaagtgatgactctgatttacttttcacaaagatcacgccgctcagtaaagaaaatactggggacgggaagaagtggtatgttggcaaaaagaaggaaggtggggagacctattgaggcctttgcagtagtagtctagatgaattatgatggtggcttggacaagagcagtaacaagtgggaaaaattggttagattaagaatactttttgtatataagccaagaagtcttgatggtagattagatgtgggatgagagaccaactggatgaatggtggtaccatttactgacatggaaaagactgggaaaggattgatttggatgggggaggaattaagagtttgattttggacatactgagcttgaaataagttgatacacaaaaggagatgtcagttagccagttggatatgttagtctcaaggaagagattggagttggagataataatttgccaagcaccagtatatagatattatttaaagcaatatatttgaatgaaattaccttgaagatgaatgtagatatagttgaaaggaaaccatagatctgaactctaccagccaccaacattcagatgtccagaaaaggaaaaggatccagcaaagtaaactgagaagaatctgccagtaagtagaaggaaagccagaagagtataaacctcagaagccacatgaagaaattgtttaaagaatgagggagtagtggttgaatgggtcctgagctacagagagatctagtaa

SEQ ID NO: 123429 - DNA, 2206 bp, Homo sapiens
tcagagagagcttttccattacattagtagtgaggatttttaattcaatcatttgcataaaaaaacttctcaaatttaaatatccaaatatatgttataattgtattagccagtcacttggtaatcatgtatttgtagagatgcaaatataagcattcgcttctgattgttaacatcaatcaatttattttgttttcatagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaaggtaatatgaatactaaaggtgggatggttttccatgctgggcttgttggtgtgcatttgatttcacaacagaaatggatgttagcattgttatttcattgtttaaatattgccccaaatgatgttattgtaacatttgagagtattatatgtatatacattttaattttaattttattttattattataaaactggaagtttgagtaattgggttatcagctcttcagagtaaccaaatctggttagttggtttgttaatgtttataacactttcttttcagttaatcttatacctgtggtgatgctgactttctctttaaattttctgtaaataaaaattcctagaaataacgttttaataagcaactagttgactctcttgactaatatggtaaatttgccttctttgaccagatatttgaagaataagtaattcttggctgggcatggtggctcacgcctgtaattccagtgctttgggaggccaagatgggaggatcatt

SEQ ID NO: 123430 - DNA, 1088 bp, Homo sapiens
tagatgaactgagccttttagagtaagggcatatcttagtcatatatgtatctgcagtgaatcatttcatgtatcagctgtaggttggaaaatactataacatcaccctcaggcagcatgcagcccctactgtcactaatatcctcatccttttttacatttctgatacagtgattttactgctgagtctcttagggggtcctaattgctttgccttattttatgttttaaacagctacactagtgattcttagtccaagctgggttgtggtcctttcgaattccagtatcattcatggagctttaaaaaatcagctgggcacagtggcacccgcctgtagtcccagcttctcagaagctaaagtgggaggactgcttgagcccagaagtttgaggttgcagggcaccactgcactccagcgtgggcaacatatcgagatccctatctcaaaaataaagtacgcagggctctgcccaaacttaagtaaagtgaatcctaggtatgcgtgtgcatgtatttgtgtgtgtgcattttaggggtacatgagtgatttcaattgccctagaaattgtgttaaaacttttattttccatatatctgtgattaactacaaccatttttgtttagtttcagcagtttataaatgttatatgctattattttttccacttacaacttaattctcctcttctcccaaagtcaccttctcttcctgtccttccatcaaaacatcaggtttcctatggttggatagttgctgattcttaagtagcaaattttttatgaagataatttgataagggaaattttcaagtaaagtaggcattcatatttagtgatattaaaaagatattcatgtttaactagaatgtgaaaataaagtgtttcttaaacttgctatcttcaattcccctcctattcttttttttttttttttttttttgggacagggtctcgctctttcgtccaaattggagtgcagtggcatgttcacagctcacttcagcctcaacctcctgggctcaagtgatcctcccactttagcctccctagtagctggactacaggtacacaccaccacatccag

SEQ ID NO: 123431 - DNA, 1071 bp, Homo sapiens
ttaattatgttttgagtgttttttataagcagcatatagctgaggttttacaattcagtctactgatctcatctcaacagatatgtttaattaggttgcattcattgtgatttctagtatatttggaattatccctgtctggtttttgttttgtatttctttcctttatcccctcctttcctgctatctaggtttaattaaatttccctcatttctccttaggttctgtctttgaatttagaaactgcacattctgttttaacttcctttagcacagatccctaaatactgaacatgtatatttggcttagcaacatttaactgtattcttcttaaataccttcaagaccttagaatacttcacctctgatttttgcacttccagtgtattgttattcttttccaatgttttattttcactttgttttagacaatgtctgctgctcccctgccctgccatagtcttttcctttgttttattgtcagagctttttttttttagatttactcatcttattccattcttttgtgtttaatttccttcttatcagaacatatattgagtagttatttcagcagctatctgtgattgttgaatttccccagactttgttggaaatacctttattcatttgtattcttgtataatttaattaggtgaacaaattattttatcttctaaaatttgttacttccttttttcccttcaattttgaaacattttcagccaatatctcttcacatcttgcctcttgtctattctctctgttgtctccttctggaattcttttctctctctgtctccccctacccgcccccgagttggagtctcactctgtcatccaggctggagtgcagtggtgtgatctcggcttactgcaacctctgcctcccgggttcaagcaattctcctgcctcagcctcccaagtagctgggattacaggcatccaccaccacgcccggcaactttttgtatttttagtagaaacgaggtttcaccatgttggccagtctggtctcgaactcctgacctcagatgatccacccttctcggcctccccaaagtgctg

SEQ ID NO: 123432 - DNA, 2006 bp, Homo sapiens
aacaagagtaaaactctgtgtcaaaaaaaaaaaaaaattgaaattttaaatgcctaaacttacaatattttgttttaatgtagctttgggatttctgacaaattcttgtttgcttttccaagtctgcttaaaggttaattgattaaagtgggtgggtcctcatgtttactaatgtgtgttgcagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttccgtaagtctttatgtaactgttgtgatctctgcttgaacatgagagtaggccatctaacataagtgtaatatctctatctagttttcttcagatgttcttaactcttgtttttctgtccttactttcttgtgccaaactccattctttattaactaatgactaagaattcagtgcaaatcttacttacatagaattatttttcagcttgaagaaatgcagcagctgagaagttgtaatagacaactccagattgacattgactgcttaaccaaagaaattgatctttttcaagcccgaggtaaagttcagtgtatttgtagctgaaattcatcgtatttaattcaccagcagtttttctgtggctaaaaacagacttatcaatcataatcttactgtctcagaacatgtggctttggagccagacagacttttaagaatatatttaaaaagtcacccccatctcaatggcactatcttaactgataaaatatagaagatagtaaaaataaggtttatacattctttagacaatgatagtttcttatacttgagctattaatgacaagcaatgttttcttatagtaaataatgtttacaatttaattcagttccatagagaactaaaaggaaatgttatcacttaaacctaattctgaagttggataaataataaaaagatataaaatggaaaagacaggaaggggaaggaatctaaccaaaagagaagtctttaatcacacttgggactgtgttctagaatctgttcaactggaagatgattatttttatttttattctttttaaatgttgattaagctatttatctttaaacattcatagaaaaataccataatttaactctaaaaagttggtgctgttctagaaactacaatccttgaacttactctttttgtgtaaaattttaaccattctattacatagtgcaaggtttttatatttacttgaggtaaagctgtttagttacttaagtccatgtttgatcgtttaaaattacattttaaattgtgaaattttaagttattttaacttgccacatagaacagggatctacttctacttctattaatgtcttaccagcattaatttgacttctttcacagtttaccacttacccgtgtttatgagtactacattatacctaagataatatatttgaaatatgttttgaaatcttacatataattcgaggttagaggggcaaaataaatgaaaagcatttcttatagcgtgtttatttttagaaagaaatacttgttttaaaaagtaaagttgtttttgagctataagcattgatatatttactttttatatatttcaggaccacattttaaccccagcgctattcataacttttatgacaatattggatttgtaggtcctgtgccaccaaaacccaaaggttagtgtatccattaaatgtgaaaactgttacttttgaaaagcaaaattttagaaaatttttcctgttcagcaaccttcctctctagaattgcttcaaactttggcattcttaaatgaattcattaagaagatgtttgcttattttcatttacatgcttggggttgggaaggatgcaaagatgtaatattcttagctttttaaaagtaatatgcacgagcttaggaaacactatgtactc

SEQ ID NO: 123433 - DNA, 2268 bp, Homo sapiens
attttttacttataaaataatttttttctttcttacagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtggattttgtgacttgttttcagtttgtgggacaggagataatttatacatcagcagatcatttaagcattaatggaaatcagggaaaacttcttctctagagtctccttgtgacattgtgatactcagctgcatttcttggactgtttttatcaatttccctagacttcttttttcatagtttatgatagttttcc

SEQ ID NO: 123434 - DNA, 1007 bp, Homo sapiens
gaggttgcagtgagccaagattgcgccgtcacattccagcctgggggaaaagagcaagacttcgtcttaaaaaaaaaaaaaaaagacacccatcattggttcattggatttagggctcactctcatccagtatgaacacttcttaacttagttgtatctgcaaagactctatttccgaataaagtcacattcacagatattggaggttaggacttgaacgtatctttttgggggcacgatttaacccactatagggtgtaaggtgtttgcagagctcaggaaaagctacccagcactttggctagaggttagcaaagatgttgaacagatactgagctgagccttagaggccacatttctaaacatagaatgttgcaggcattcaaatgtgaccacttacaatcccacatcattagcccaggagtaggtgcttcattttaacatgcgatcgtcactcattctttgccttcaacccaaggttcctctacctgtgtcccatagtgctcatgtcttttcattcagtctctcttcctagcaatgggtagcatgttagtacaggccatctcatagttccctgggggctttttgtaagagaactatagcttccagaaaaatgggtctctatacaccaggcactcttctaagtactttatagacactaattcctgtaattctcacagtatccttatgaggtagataagattatttattcccattttacatattaggaaactgaagtacagaggttagataatttgctcaaagttacacagttaataagtagcagagcactctggcttcaagttcatgacaccaaactgcctgccattataagcttagattctttccctaccaagatatgcaagaaaagaaaaaagaaacaataaaaaagagcttagattatttctcataccatttatcaaaataaattccaggtcatgattaaagacctgaatgtaaaaaataaaacttggggtgggcattgtggctcatgcctgtaatcccag

SEQ ID NO: 123435 - DNA, 1031 bp, Homo sapiens
tcagcactctgggaggctgaggcactgatccacctcaagtggatcacttgaggtcagaggtttgagatgagcctggccaacatggtgaaaccctgtctctactacaaaaattagccaggtgtggtgatgcacacctgcaatcccagctgtttgggaggctgaggcaggagaatcacttgaacccaggaggcggaggctgcagggagctgagatcacgtcattgcactccagcctgggcaacagagcgagactcagtctcaaaaaaaaaaaaaagttgtattgctgttatttacttaaatgagtagagtactaggaagctggacacacataaaggttgcaaatacagtatcattctagcaagagagtttgtgtagaaagagaagttaggtaatgcttctttgttgctatgaatctacaacaagaccagtgacctctggctcctgaaaaagagaaaagttttgtttgcttggtttggtggagagagctggggaaacctgagtcaggaacaaaggcatatgaaggtggtaacgagccaggtgcagagggagagcagggcggtgtctgactactgccgaggctgggaaggcaatgagtgtcaggagggaagaggaaattgggaaagggagagtcccaaatgcaaaactgagaagcttggatttgcttcgccaggccccagaaaataaggaagaaagtggcactgggatagctgagaaaagttactctgggcgttgcatgtaggacctttaccatgggttggcaccacagtcctcacatggcattgaacacgatttcattcaatatcgattccacacatcaccccaaatgcagacgtatatcaagcaggcttcccagaggagatgatgcagacgctgaggactttgatatctcttctgcatttgatatccaagttggtgcagtgctagaacgtagaacaggcacaacgacaacaacgttaaagtcatacagtctttgttacataatcactcatttgttatcacagaaataataccagtatcttcagcatgaccagg

SEQ ID NO: 123436 - DNA, 1055 bp, Homo sapiens
atttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatggacatttgagttttgtttatttgtttttgctgttgaaacaatgctgctgtgaacattgtatctagcagttatattgcttgatatattgataaaataatgccaaatttgtgttctgaagtgactgtactagtttatacctctcttggcactgtgagttacctttgtttcatagcatctccaacacttaagttcagacttaaaaatttgccaacctagtggatgttaagtggtatctacctgtgatttccagcaagattactgttatctctgctcttccatgtgtaagatgtcatttttttcctggctgcttttaaggttttctgtcactggttgtaagaagtttgattatgatgtgcttgctgtagtttttttttcacgtttctgctgctgcagctattttacctgtgggtttatggttttcatagaatttggaaattggggggcattttttcttctgttatggttttctctctgctcctctcatgcttctcctggggctctgatgacttggatgtacgttaggcccctcagaattttctcccagtgtgct

SEQ ID NO: 123437 - DNA, 1001 bp, Homo sapiens
gagacagcaagaccttgtctcaaaaaaaattctcctctctaacttctgtctttctaaacatggaagatgtatttgaacatctagagaggagctgttataaaataaaacactttaaaaattaattgctcagacccaagtatacattatccattttcttttttcgagatggagtttcgctcttgttgcccaggctggagtgcagtggggcaatcttggctcaccgcaacctctgcctcccaggttcaagcaattctcctgcctcagcctcccgagtagctgggattacaggcatgcgtccccacacctggctaattttgtatttttagtagagtttctccatgttggtcaggctggtcttgaactcctgacctcaggtgatccatccacctcaacctcccaaagtgctgggattacagacgtgagccaccgcatccagcctccattttcttatttaagacttactgacttgtctaagatctcttcctgctaagttatttcaatgatatcttcttataggattcttatgggaattttagtagtttcattgcagatcaataatgggaccacgttttgggggagtgaagggtggggagctgggaataagactatacataatcagaatttttgattttgcagattgctctagagacatgttctgatttcagttgagctatttcagttccatatttttgaagctgatccttcgtttcagccaaaatagtagatacaaatcaatgacgttgttaaacctttttctgaattattttattgctttgtaatttacaagattcttgacattagtggtagtgttcacatttaagctgttataacagccttctaatggtagacttttctaagttttattaattgaaaatgcccacaaaatgattattttactgattcacttgtaattcccccttcctttgacaggatatctatagagaaatggggtttggtcactatgaagaagaagaaagctgttgggagaaacaaaagagtga

SEQ ID NO: 123438 - DNA, 1036 bp, Homo sapiens
gttaaagcaaattactagttttagagttacttggaatagtttctctctgtggttatgacattaactagattcatatttcagttaaagtgtttcttttctttcttttttttgagacggagttttgctcttgttgcccaggctggagtgcaatggtgcaatctcggctcactgcaacctccgcctcctgggttcaagcgattctcctgcctcagcctcccgagtaggtgggattacaggcacctgccatcatgcctggctgatttttgtatttttactagagatggagtttcaccaagttggccaggctggtctcgaactcctgacctcgtgatctgcctgcctcagcctcccaaagtgctgggattataggcgtgagccaccgcgcccggccctgtttcatttttatttatttatttttaatgttttaagggttgctttaacaattttttgttttgtagttttaaaaactgtttccaaagtgaaatctacaaaatggtacatttagagaacctagcttccattcttgttccctccccttttccttcttccctctgtgggtaactattttatgtgttttatgggttattgatttaaaaaaatttagcaagtaaatatttgatatatgtagttagctctttgctataatccagcagagatagaatttcttctttctatagccctttagctgtttaaagattgccatcattcatgcctcatcccgttttcaggccatacttttgttggttcctgcaaatatttctcacatgaatcggtggtaataaaagtagtagtaggccaggtgcagtggctcatgcttgtaatcccagcatgttgggaagctgaggcaggagaatcgcttgatcccagagttcaagaccagcctgggcaacataggaggccctgtctctataaaaattttaaataaaagaaaaaagtagtagtagttaatattttttggtccttacaatgtaaggtgggttcttttatccccctttcacacaacaaagtgagaacaaaaattgttacttgcccatag

SEQ ID NO: 123439 - DNA, 1142 bp, Homo sapiens
gatgggcaggtgtggtggctcacacctgtaatcccagcactttgggaggccgaggcgggtggatcacgaggtcaggtgtttgagaccagcctggccaacatggggaagccccgtttctactaaagacacaaaaaattagtcaggcgtggtggcatgtgcctgtagtcccagctactcgggaggctgaggcaggagaattgcttgaacctgagaggcggaggttgcagtgagctgagatcgcgccactgcactccagctcgggcaacagggcaagactccgtctcaaaaaaaataataagaagaatttaaacatgataactcgatatgcattgctgaatttcctcttgattgaactaaaagaagagacatacaaatgtacctgttatcttatatagcttttctgggcattggaatttataataattttttctagttaaagatgtccctcattttctaaatttaaattttttaaattattgacaaatacgtttattttttcctcctaatttttttgcctactagtctttattttaagattgtttaggattaggattctttccatttctcctgactatataatgaaagaaaatgttagttttgttttagaaatgtactatattcttttgagatgctttttgctttagttacttttagccttatgacctcctttgtttaccagatcttaagttttgatgtcttaccagtattatttatcacatttatccttaactaactactgcagtacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggtacctctaatgtccagacttagatgtggagaaataaatattttatccctctgtaaatgatgtcttagtgatataatttaggaggtaagggatagttctaagcagagatgggtttgttcctaagaagcagaatggttgcactggggtatgggattttaattttcaaaaatatttatcacaaatgataaaagatcatttttgacataacttaatgtatcaaatacttccacattgtgaagcaagagtgatttc

SEQ ID NO: 123440 - DNA, 1108 bp, Homo sapiens
atctcggctcactgcaacctctgcctcccaggttcacgcgatcctcctgcctcagcctcccgagtagatgggattacaggcacacactatctcgttagatctttaaaaggtctcttaaagtctcacttctctcaaacttaggtctttcagatcttaaactcaggtcccaaatcctcagttttccactggacttaatgttctcatgggctcaatggctctacttgaacacggcatttgtgtgtaatttatttgaaagtttgatgttgtaatattcacatatatcgttaggtggcagcatgtggctacctagcaaaaatggatgtctgatttcaaattagtaatggagatggaattactatgattcttttgttccctttctctgtctctcgatatatgccatttataaaatagctcttatgctttttataaaataattattgttcttggttaggtggtttttttactaagctctttttttcttttcttaataaataggtgggaaatacaccaagagtgatttcaaggagtatgaaaaagaacaggataaaccacctaatttggttctgaaagataaagtaaagcccaaacaggagtatccttaccaagaatcagttagttaatatgtattgaccatctgctatgtgtagagtactgtgtgatgtgttatgaaaagtcacaaaagctatagaagacaaatttcctgaatccagattgtttgtgaggaagtaacttagtttatcattatctcttttcaagatcttacatatactttgctttttcactatactctagtgtatggagaaagttaaggttgaaagaaatctgtagcctaattcttttattaatactttcctactctaggttaagtactttcctacttatcatattctcagaagatcttcaggtaagatttgtattttctttttgggggggctttcctgcaaaaaccggaaagcctactagacaaattctaaaagagctgtaacactagctttgtattttctatatgtaattgtaatgttttctattcctcataatctgaaatttattattgctaagctgattcctttgtgctacctgctgttatgtttaacttccttacctagat

SEQ ID NO: 123441 - DNA, 1017 bp, Homo sapiens
ttcatactaagtggataaaaaaaggtcataacctaccattaggtttggtgttactgccaaattaattttaacaacaaacttaggaacacaactttcactttccaggatgtttttgaattttgagtaaaaaggattgtgaacctgtataatacagtcagtaagtgtatatttatctgttcactgcagttggactgtctctctaaaatcctggctctgacccttgccaacaacttctatacttctctaaacttctgttttctcattaagaaaatggatagtacctcatggggttgttaccagaggtatttgaggtaatagatacaaagcatttaacagcatcgggtgtgtaataagtattcaaacattaatttttgtaacaacaaactttttgtattttcagtattctagctacagaaatcttttccataaagatttatgcttgagtttttataattattatcaggaagaagattgtgagaaagcattcttcaaaatggacaatgtgcttatagatgacagaagaatacatgtggattttagccagtcggttgcaaaggttaaatggaaaggaaaaggtatgatggtttatcttttgtttttgttctgctttttttttttttttgagatggagtctcgctctgttgcccaggctggagtgcagtggcacgatcttggttcactgcaacctgtgtctcccaggttcaagccattctcatgcctcagcctcccaagcagctgggattacaagcatgtgccaccatgcccagctaatttttgtatttttagtagagatggggtttcaccacgttggccaggctggtctcgaactcctgacctcaggtaatccaccgccttggcctctcaaagtgctgggattacaggcgtgagccactgcgcccggccttgtttttgttatgcttttcatgcttgtatgagccttttattgagtgctgttaattaggagaaatattaattgatgtaactcctgccatttgtaattttacaaacctgctatct

SEQ ID NO: 123442 - DNA, 1006 bp, Homo sapiens
aagcgattctcttgcctcagcctccccagtagctgggattacaggtgcccaccaccatgccctgctaatttttttgtatttttagtagagacagggtttcaccatattggccaggctggtcttgaactcctgacctcaagcaatccacctgcctcggcctcccaaagtgctgggattataggcataagccacaacactcagccaatcttagaactttttaagttctaagtaaagcccttcagagactcttaatttttccctgttacttaagtggagataaagttgagtaatagaaagagaactgaactgggtgttaagatttagatattaatacatcttttgttattagccagctattgtatgatacttggcagtttagttaaccgttctttctaggtcttaccttcttataaataaaacttgggtattagaatagatggccccttctagagctgtaataatgatagcttatgttgcttaaatatttactttaagctaggcattatgttacttttgctgcatttaatcctcacagttctgtaagatagggaccatccccttttccaaataagttaactgagacacataatgctaatgtgacttgttcaaaatcacacacctagtgaatgaatgtcatagctgggatttgaactcagatatgtctgattctgttcccattgagtttacactgtgctatggtatgctcttttttaatgcaactttggactcatatgtatccagtagtagctcattctaagttctaattattacaaagcatttatggaataccttttatgttttcagacacagcaataaggcctagggatacaagatgaatcatggagggttggggaagatagaccataaagttatatgtaggcactgtgtcagatgtaccagaaatgatacttacaaggtacattggtgccagcagaaagacctttacctttggtttgctgtgaaaacttgtagacctgcactagcattctatcattgacactataga

SEQ ID NO: 123443 - DNA, 1043 bp, Homo sapiens
agatacaatagtaatgaaaaagtttgaaatcttgtgagaatcaccaaaatgtgagccagaaacatgaagtgagcctatgctgttgggaaaatggcaccaatagacttactcaatacacggttgccagaaatccttaattgtaaaaaatgcagtatctgcaaagtgcaataaaatgaggtatgccagtataagctttgtactttttacttagttttggtaacaagtgtctaagaattggtgcagtaaatgtggactcttaactttcatgtatttttttgtcagtctgtaactgatttcagtttgagttatgtattatttttatggtatttattatgtgtccttctttatagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggtatggttacaatttgctatctgaatgtactagaatgttttaatattgagatgtttaacacgtagtggtatggataggaacggtatgcataggactggtttctggataattctaatcccaaaaggtgaattaatataagactgtaagaatctttataataaaaaggactttttgtatttttatacttgtactaattatttataattatgtttggaggaattatttatttatttattttttgagacggagtctcatgctgttgcccaggctggagtgcagtggcgcgatcttggctcactgcaagctctgtctcccgggttcacaccattctcctgccttagcctcccaagtagctaggactacaggcgcccgccaccacacctggctaattttttgtatttttagtagagacggggtttcaccatgttagccaggatggtcacgatctcctgacctcatgatccacccacctcagcctcctgaagtgttgggattacaggaatgagccactgcacccagctggaggaattgttaatgctttaatttagtt

SEQ ID NO: 123444 - DNA, 1053 bp, Homo sapiens
aactctgtgaattaacaaagaatcctacatattacagagggattttatcatacaaactggcgatcctacagggactggccgtggaggagagtctatctttgggtaagttgttttatttatttatttatttatttatttatttatttatttacttttaacctctggaagggcagaacaaattcttttattcttaaatgaggaaaaatataattgctcatgcttcaatctgcattttaaaatatggtttaaatttagattttttcccccaagttccctaaaaaaaaaaaagtaatattttgaattctgttggcatttctgtaaagaaataattgataaccctgtatgttactagtacttctgtatttcattttgagagtacttacatttataaccttatatgttttttcagccaactgtatggtgatcaagcaagcttttttgaggcagaaaaagtcccaagaattaagcacaagaagaaaggcacagtgtccatggtgaataatggcagtgatcaacatggatctcaggttaggaaatgagtaagaatatgagatttgcttagaaatgaaggactggaaggagcccacagagttattttttaaactatccagtaaggcttagagggtttcaatcagaaatatgtgttaggggaaaaaatgcactttttctatattaaaaaatattattttcttcttttaaatgtaaagcattcctattgtgaagaattgagaaaatacagaaaagtacaaagaaaaacattacctacaactccaccatccgtgattatcactgttcacatttgtggctcatttttcagtatttctttttatttaattaattaatttatttttatgagatgtagtctcactctgtctcccagactggagtgcgatggcacaatcctcggctcactgcaacctctccctcccgggttcaagcaattctcctgcctcggccttccgaatagctgggattacatgcgcctgccacaacacctggctaatttttatatttttagtagagacggggtttcaccatgttggccacgatggt

SEQ ID NO: 123445 - DNA, 1050 bp, Homo sapiens
gacaaagtgagactctcaaaaaataaataaataaataaataaataattggaattgtaaataagggtggaaaaatggctataaaatggaaaagatgatcttttaaactctcttaatgctgttataagtgattgtacaatagatacaattggagggaaaagagaaagccacgttgttctcaatctgtgagatgcacaccttccaatttacacaatacttgttttacaggacggcatcagaattaatgtaactacactgaaagatgatggggacatatctaaacagcaggtttgtctccttttctggttttaatatataatttagctaagtgctatgcagcttatttgattttttaacttgcacgtctcatttagttaatcttttttgacttgaagagtttgctattgtttataaatattggaattaatgtatatgctgctttattttaaggttgttcttaacataacctatgagagtggacaggtgtatgtaaatgacttacctgtaaatagtggtgtaacccgaataagctgtcagactttgataggtgagtattactaaattatttccataattgctctgttttttgtgtgtttgttgttgttgttgttgttgtttgttttttgagacagtcttgctctgtcacccaggctggagtgcaatggtgcgatctcagctcactgcaacctctacctcctaggttcaaatgattctcattcctcagcctccaaagtagctgggactgcaggcatgtgccaccatacccggctaacttttgtaattttagtagagacagggtttcgccatgttggccaggctggtcttgattgaactcctagcctcaaaccatctaccctcctctgcctctcaaagtgctgggattacagatgtgagcccctgtgcctggcctgttctgtttttaataatactaaattagcaaaacaatttttggatgttatatatttccattttaaagtaaaaataggctgggtgcagtggctcacgcctgtaatcccaacactttgggaggccgaggtgggcagatcacgaga

SEQ ID NO: 123446 - DNA, 2018 bp, Homo sapiens
ggtgaaaccctatctctgctaaaaatacaaaaaaacagctgagcatggtggtgcaagcctgtaaacccagctacttgggaggctgaggcaggagaatcccttgaacccaggaggcaaaggttgcagtgagccaaggtggcaccactgcactccagcctgggcgacagagcaagactccatctcaaaaaaaaaaaaaaaaaaaaaagaataggaaagatgttgctagtgtggtatttcatacaaagtctaaagatcaacacattttaccctttcaaatgagtgtaagcagtcataaagatttgtcagattgtctttgtttttaataaatctgaaacagcattgaggtcagggatgaagaaagccaaagaaatgggttttcaactgtcttgttccatgtaaatgtcatcaaaataatcacactcactcacagatttggtggtaatctttgttcaaaggtgtcactacttttttttttatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagtaagatagtatgtttattaattgggaattaaatgatatttagatttgtgctagatattatgcatgtgttcagttattttatttgtttccgacttgataaggaaggtgcctaatgttgcctatatccaattatttagaatttttgtatatttattttagcatttgaaatgtatttttaaaatttcccatattcatacatgtttgtatcactttaaaatgtacagacattattaaatagaaagtaagcaaagagattcaatttggctcatagttctgctaccatttcctctatggtaaatgaagtctctgtgtgtaaatgaagtagaatcgagattaagcttataatagtaagtgttaaagcaggacaggaatattattaaagttgcaagttaagtgccccaaagtgggagtacggggaaataaatagtaattgttagctgggcatggtggctcacacctgtaatcccagcactttgggaggccaaggtggacgaatcacctgaggtcaggagttctagaccagcctgaccaacatggagaaactccttgtctctactaaaaatacaaagttagctgggcatggtggcgcatgcctgtaatcctagctactcgggaggctgaggcaggagaatcgcttgaacccagaaggcggaggttgcggcaagctgagatcgcaccattgcactccagcctgggcaacaacaagagcgaaactccatctcaaaaaaaaaaaaaaagagtaattgtctgaataggacacatgttttagttatataaatctgggaggaaaatttgcttttaaatttttatggggctgtgctactatttaaaataaagaataattatattttctttcacaggttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaaggtaacttaaaagaccattatttaaagtattaaggagattatttatttagttggtagctttatatactcttgaactttgttattttttacactatttgcaaaagttgctatttatctttaatagttaatatgtttggaaatgagcttgtttaaaaaaatgcttcataacatgtattgcttcatatgtccatttaaggactttaggactctatttggagcattagtagaatgtgatcagtgctggttgcatagtgacatttttcagtaattactcttactctgggtactgatcacaaaatatgtaataagactattgtaaaggttcattcagaggaagaactattcattttttcacagaaacatagaacttc

SEQ ID NO: 123447 - DNA, 1025 bp, Homo sapiens
ctcttccttctcttgtgctctaggtactggaaacagttgactctgctccatttcgtttataatggactagcctaacgaatctcttgtcaattagcaattattttcacttgatttgtagttagaaaacaatataaataattttacaggctattaacatttttgtgcttgtattgttagaacataatttttaaagttgtaagtaacttcattgaggtacattctaaaataaaatcaccatttaaaatatacaattagttttgacaaatgtagtcacccatgtaactaccagcacaatcaaaatatagaatatttttatcatcccaaagctaaaacattaaaaaatttaaagtttattcttagagattgatgcaacttgcatatctaatcgaaattcctttttcaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaagtaagtatttcttatttttgaaatgttagtatttttaatgattaaaaagtgagacatatttgctatgttttagaatagaaaatataaaaattagaaagggtaagacaaatgggagggaaaataacacctactgtttttctagctcatcttccaatgttagcaaaattgaaacacatttattgaatagctattgtgatcaagacattcttggagagattcagatgtaagtaagacaaactctgctaagaacttaaaatctagtagcagaggaaggaaacaaatacatgtaatggaaaatgcaactgtatgatcagaggtgaacaaaacccgaggacttcatgatgtattttcaaccccagagtatcagtttaaaatgttaatttcagtagacaagcaggatattcattgcagcattgtttgtaatagaaaataaaagcaaaataggctgggcacggtgg

SEQ ID NO: 123448 - DNA, 1022 bp, Homo sapiens
cccgggttcaagcaattctcctgcctcagcctcccaagtagctgggactacaggcgtgcaccgccacacccagctaatttttttattttttttagtagagacagggtttcaccatgttggcaggatggtcttgatctgacctcgtgatccgcccgcattggcctcccaaagtcctgggattacaggcatgagccactgcacccggccgagaataaggtaaactttaacttggcactgtaaaggtcaattttcaggcagtcttagagtttagcaatttctctagtgtataaactgattcttaacgatttaaagaaaattatattcaagtggcaaatttggaggcaacaggctacttcggagtccatgatatgagatggcgttttaaatacatgttttatcttcaaggttttcagctcttttctctggaccatctggatataagttgatagctgtcacaggtatgacgtccactttatccaactgaagaattcctctgaaatagaaagtgattaattactatcaaaattaaatgtttcctctgcctgtagtttgatagtgagaaaaggctacttcaaggttataatatacacctaaggttaggtgcttttgctacattctatttaaaaattcatagtggttgtacaaactgagcccaaagtcactttaaccaaactggctgagagaatagaaaggcatcgaggaagttcattatttcctattttagggaagaatagggtaagtatagatctccaaggcagagttaggttcctagatacacccaggctgagcaaaaagcctaagcctaagcctctctctaaataatactcaccaccacaacacaaccttaggtctttagatagtgttgctctttttgttacttaaaatccctgaccagagagtacgtctttggattgaatctaggaccctgcattgtaaattcagtgttattctaataagaacatcaacgggggttagttgtttatagaaccaaacagattctaaagttcacaggggagtaactg

SEQ ID NO: 123449 - DNA, 1026 bp, Homo sapiens
tcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaataaaaaaattagctgggtgtggcggtgcacgcctgtagtcccagctacttgggaggctgaggcaggagaattgcttgaacccgggaggcggaggctgcagtgagccaagatcacgccactgcactccagcctgggtgacagagcgagactctgtttcaaaaaaaaaaaagttgaccttattctctaaaagggctggctattcatatgatgaattgttaaggaaaacttaaagtggaagagaacacatgtgaagagactttgaaattatcaaaagaaaaaaaaaagaccagacaaaatctcatgtgccaataacttttcaaggtgcctttgttaaggaaattatatccacttaattactataatatataagactttatgaaaagcactttataaaattctaatttaaaaggtcaagaacttaacacttatttttttattcagtacagtgtgcctttatattaagtatgtgactcagtataaaatcactgaagtgtatcatgatttgattgtatcctgtaccaagactacttaccttgaatgctccaagatttaaaagtagtatgacatgttctcactctaaaataaactttttttttttttttttgaggaaaaaagtatagctgttttggttacactgatataaaacctttgcccaggtaagaatggctgagatgcaggagtaggtatactttcatttacactggctgaaaccatggctcaaattgaatgagtccattgatgtcatgaattagactgtgcccttggtcttgtggttctagatatagtgctgtttaccctaaaagtgt

SEQ ID NO: 123450 - DNA, 1113 bp, Homo sapiens
agtctggaatacagtggtgtggtgtgatcatagctcactgcagccttgaactcctgggctcaagggatcctctcacctagcctcctgagtagctgggactcagacacgtgtaaccacactcaactaatattttaattttctgtagagatggagtcttgctatgttgcccaggctggtctcgaactcttgggctcaatccatcctcctgcctcaccctcccagtgttgggattacaggtgtgagccactgtgcccagcctccctcagctattttctgattgctaatctgtagattattttaaaatgaaataatagcttaatagcttgatattgcatggtttcttcctttaggctcgattttattctccagccaccatatttattgatgagatagactccatctgtagtcgccgagggacttctgaagaacatgaagcaagcagaagggtgaaagcggagctgctggttcagatggatggtatctgtgtttagcttgagttgaacagggacgggaggttgttaggtgtggtgtctccagttccagtgggtcaaactttactcatagtgctaacccaagcttttaataggtattcttaacttcagatggactagagggggtggcaagaagttcctgatagtgatagtaatagatttggtacactgacagtggtgacaagtcagaattaatggccacacacagggcacccttttggtatatacaactatcttactttagctatgaaattgaaataaaaataaatgcagataaattggccttagagtttatgtacgctttgaaaaagatttaaaattgttatgtatttgagatctggcttttcgattaaatctattttgagtcatatatttgcatactacagaactcattttctttggattacaaattcacataggtaccagttaacctaagtcttaaggaggcattaagactgtgcttccttgtattgttgtactaaatagttgttgatctttaaatagctgagcttcatttggtataatccaacttaatatctttttcactctccccttacccttattttaggtgttggaggtacttctgaaaatgatgacccttccaaaatggttatggttctgg

SEQ ID NO: 123451 - DNA, 1024 bp, Homo sapiens
gtggttctcaacttgattaatattacatgtaatcaaagatctgtaatgtattacaatgagttataaaagttaacttttccacaaagttaggtattttatatttctgttaaaaccttaatgattattaggtatgggtttgaatgatattaaaaaatattggggacattaatattttatacaatgaaaatactttttttaacagaaattgccacatgtagcagtagtagtaggtattctagtggttggagatgactttatagtaatctctgtgatactctttaaccttggcatctacctcttagtaaagctggaggcaaagcagctatgttgtagcctgtctctgctttatacgatttttattctttatgcttttttttagttttaaaatacatgggctcattgtttctaaatcatggagattatggaatgaggaccataagagcaggagtttaaaatgagttgacacataaccctgaagagtgtgcctgtagactatgttctcgtgatccaggctaaaaactgtcaaccgccaataactgaagaaaaggttgtgctctttatatatctgctggttgacatggtgggcctcatcacagtgcattagttcacccgggctcagagagaggctcaccattctgtcagcagtgcaacatcatgtgcttccagtggttctcaagagtgactgcatagacatgtatcatctaaagggttgttaataaaatgtcttctctttcagggatgatatcgctgatttagtagaagctaaaaagttgcttaaggaagccgtagtgttaccaatgtggatgcccgaattctttaagggcattaggagaccatggaaagtaagtttattactgtgatggcattgtcaaagtaaatggcagcatgttgatacagagagccaatatttatctatattgggaaaagtggagggagaaagtggagtcaggaaatgtttaaattaaaaggtatatgttgtgctactgagaattttgttagaccagaagctgttgcatgattccta

SEQ ID NO: 123452 - DNA, 1824 bp, Homo sapiens
tcctgcttcagcctcccaagtagctggaattacaagtgtgctccaccacacccagctaatttttgtatttttagtagagatggggtttcaccatgttggccaggatggtctcaatctcttgacctcatgatccaccctccctggcctcccaaagggaaatcatattttaatcaaacatcccagataaatattacagttaggttaatttcttatattctaggtgacttcatgccatctatatgtcaatgaattccaaatctctctctccagaaatggcctttctctgaaattcgtaatttctctatccagctgcttcctggctatcttcacatggatttcaaataggcctttcaaacttcacatgacccataaagaacttttttttttaagcataaatcagatactgttatcttcttgcttcgaactctgcaatatcttctcactttacttgaggtaaaaggcagaccatttctattgcttgcaaaacccacatgtattcctgccgcatttcttacagttcttgccccatttcctacagttctcccctttatcagctgtgctggtcttctctctgttgctgttatttctgtgtggaatacctaatcctgatttataaatggttgagtccttcttgtttttttacggtttagctgaagtcaccttcttaactggtcttccctagccattcagtcttatgtagctatccagtcacatttgttacatcaccctgtgttgattctctgtgtagggtatgtcactgttccttatatgtgtaattgttttgtttcttttcctactagaatgtaaccagagctttgtcttattatcactgtcatttattgaatgaaagatggatctaatttgtttgaaagtttgtccagagtagtaacagggagtgggctaaataacaaactcttaatctccccatgactcatattgttgttatttaacattgcataaattactaaatcttaggctaattttttttaagtgtaaaatccttcctattgacatctcagaaaataggctctaattggtaataaacaccatcagtgatttggcatacattgtgtcttagtttgtcacaagggagaatgttgttaaccctaaaccacgatgtcagaagattaaatagacttcaggtttactgttgtcattgttgactttatttacttattcttttgttgtgcaggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggtaaagcacttctttcatatatattctcagtagacctttagaccagccaaaacgacactagaatatgccttatttttcaggcttataataaaagtattaattttaaagtataaattggtgatttaatgttaatttttattgtattctgagcatttttaaagtgcttataaataactttgttattttaggatacacacagttgtgtgattggtggagtgttggtgttattctttttgaaatgttggtgggacaacctcctttcttggcacaaacaccattagaaacacaaatgaaggtaaggtatggcatctatatcaaaagaattctcacaaagttgctacatcattgacttttatttattagtacgtagagcattttagtctggagttaaagaatgaacttgggccgggtgcagtggctcacacccataatgccagttctttgggagg

SEQ ID NO: 123453 - DNA, 1072 bp, Homo sapiens
ctcatatccaacattcagttaaagaactagattatcagtactttagaagcccttaaacaatcacttccccttttctcctccacaaagataattattatttcagaactttataatcggttctttacttttatcgatccttttatcacaaatgtgtatatctttaaataatatattatttcattttgcctactctttaacctttatttaaatataatctatatatattctttgtgttgacttgtttgaggttcctccatgttattgcttgtaacatttattttcactactatttaggatttcattacatgactgttacacaacttatataaccctaaacactttatgatccttgatcctattttatcctcacaatgtcactgtgaggcaggatgaagaaactgagacctagttagatgaagtaacttgcccaaggtcagacagaaatcaagtgtaagggctaggctttgaacccaggtttgtctgatttcagggcccatgttatttctactacaccacactgcctcaccaagatccctccaagcgctaatggaagtgtaagtcaatctaacatttgttaaatactatgtactaggtgcttaaccatatattctaatatgctcgcaacaattctctgaggtaagtattattagcctcctgtgcttctgtgaacacaagtagattgacattaaaatgggtagaactgagacaattgaacctactttaatgttcgacatagtggaatttagtgtcttcccagattcgactgaattattacctggaaagcttcttaaaaatatgattcctaggctctattcccatcttttgatcaaaaatcttcactggggcatagaaatctttttgttgttttttgtttgtttgtttgtttgtttttgagacggagtctcgctctgttgcccaggctggagtgcagtggcgcaatctcggctcactgctagctctgcctcccaggttcacgccattctcttgcctcagcttcccgagtagttgggactacagccgccggcaaccacgcccggctatttttttttttttttttttttttttttttttg

SEQ ID NO: 123454 - DNA, 1214 bp, Homo sapiens
ataaatgaatatgcatgttaacatgttaacagatgtttgttgcacattgagaacctttttttttttttttttcggagtgcattagagaagagtagaaagcttactcatctggtaccctcttcttgcactccacagctgaatttgcataggtactcactttgaatatccttttaactaccccttaggctgcacttttgatcattaatttcctttgaaatgttttctagatttctaacatgctttattaaaaattatgcatttaacctttaaatatatgcctgaatttttcccaagctatttcttaatattcaatattgaagaagataattcttatttaacatctagtttatttgcctaggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtaagtaaactcataaaatttattttagtttgttcataataatgtaatttattgatgtagtaaaatataagatggtatcatcactggatgagagccagaagatgtgggtcaggtcttgattctgttggataaacttgggtgactccattaggcacttagacttatgaaatgaaagaatgtgctagacttgattgtttagacttatgaaatgaaagaatgtgctagacttgattgtttctaaatattattaacatttttgagtcacacctttta

SEQ ID NO: 123455 - DNA, 1380 bp, Homo sapiens
acctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttgattgtagcattttattttagtatttcaatatttattcagaatttcctataataaaatctcgtgtaaattaagaaaaatataatttgcggtatacagtttaggtgtacataatacctttatatgaaaattggaggaagggttgtcttctaggcttcatacaatatcttacaacatttaaaaataaactagaaatatgtgggtctcaggctggggcatgggggctcacgcctgtaatcaaagcactttggaaggctgaggcaggcagatcatgaggtcaggagatcgagaccatcctgcctaacacagtgaaaccccgtctctactaaaaataccaaaaaaaattagctgggcatggtggcgggcgcctgtagtcccagctacttggaaggctgaggcaggagaatggcgtgaaccccggaggcggaggttgcagtgagccgagatcgcgccactgcactccagtgtgggcgacagtgagactccgtctc

SEQ ID NO: 123456 - DNA, 1098 bp, Homo sapiens
atctcggctcaatgcaagctccgcctcccgggttcctgccattctcctgcctcagcctcccgagtagctaggactacaggcgcccgccaccacgccgggcaaatttttctggattttttagcagagacggggtttcaccgtgttaggcaggatgttctcgatctcctgacctcgtgatccgcccgcctcggcctcccaaagtgctgggattacaggcgtgagacaccgcgcccgtccggaacataatcttttaacgggttttcacatttggatttctagatacagtaagtagccagttattactttaacgtcagaaaaagatgtctttaatttttttgtactctgtagtagaaaaattacgaaagaaggtacttgaaaacactaactgtatatttcctagaggaaaaactggcaaaggcgatcttcacaaagggtggaccgtaccttatacatcaaacccaacgatcccatcccacactttacattcagcttaaccagaagtaaaacctcttgtcacaccgtcaccggtattccaattatggcaataacgatctccttctacggatgcggttgacagataagatctctaaaccgctgctaatcaatcggtcctggctcaagcatttcttatctgccggattcagaaaatacagatgctggaagctcaccggcttgttcggggaaagaacgctaagcaagaataaaattttatttcaaagcgccaaaaatctggaattctgaggtccacagggaggtttcccagagcaactcagttgttcccttctgagaacgtagctccgtgaaatgcacatccctactcggtccagagaaatagatcaatggggaaaaggattgaatcaaccaagtaggctgggcgggagacagccttaacccacgggcgcgggcgagtcgtatgggcaggggcaggcgggagcgacgtggggcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgc

SEQ ID NO: 123457 - DNA, 1026 bp, Homo sapiens
ttttagtagagatggggtttcgccattttggcctggttggtcttgaacctcaagtcatccacctgccttggcctcccaaagtgctgggattacaggtgtgagccactgagcctggtctcttaaaaaataaacaaaaaaaaacaggctgggcacggttaccagtcatcccagcactttggaaggccagggtggctagatcactggagcctgggagtttgagaccaacctgggcaacatggagaaaccccatctctacaaaaatacaaaaagttaaccaggcatgatggtacacacatgtactcccagcaactcaggaggctgaggtgggaggatacctgagcccagggagtttgagcctacagtaagcaatgattgcagcgctgcattccagcctgggtaagtgaggccttgtctcaaaacaaacaaaaaacgtgtttcctgtgttacacaaagataaattatactttatttgattttgacgtcattgttatctcccacaaaaggactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaagtaagtattgtgaagatacagaaagtttatattgggtgagttatatgacatataataagcacctttccataatgatacatgtggatcattttacatcatagcttttaatggctgaattgtgtaaatttaaatagttatgtaatttctttttactcgacatttaagttctttaacatttgtttttgtttttttggagacggagattcacccttgttgcccaggctggagtgcaatggcgctatcttggcccaccgcaacctctgcctcctgggttcaagcgattctcctgcctcagcctcccgagtagctgggattacaggcatgcaccaccacacctggctaattttatatttttagtagagactgggttt

SEQ ID NO: 123458 - DNA, 1051 bp, Homo sapiens
ccagcctgaccaacatggagaaacccagtctctactaaacatacaaaattagctgggtgtggtggcacatttctaatcccagctatttgggaggctgaggcaggagaatagcttgaatccgagaggtggagattgcggtgagccgagatcgcgccattgcagtccagcctgggcaacgagcaaaaaaaaaaaaaagaaacagaaaacagttcagatgtcctgtgagtaaatgtttttcccatccaaagagaatccatttaaacatatacattaaccatgcatttttctatagaaatttaaattataagttactggaaattgtaatatatcaatccatgaaaggagtgtgatttaagattttcttgggaaaaaaaggggactcattaacacatactaccattttttaaatttttagacaatgcagatagtagtacactccatgctgtaacctttcttcgaactcctgagattcttactgtaaattcaattggacagttgaaaatatgggatttcagacaacaaggaaatgagccttctcagatattgtcactgtaagtgttgatttgtaatttcagtaatgtaatccacaaattaatgtgttaggttgtttatagctactggctttaagccatattgaattttaattgcattttaagagggagatccctgattaaaatttggtagagcaagcataacttgacggggttggtactactatgcttcatttagtaattatttgttatagtgattcagagcctttactctttgaagtttgtattatttcatggagaacttatttctgctctttcaatgattgtttaatggataaaatatactccagatgtaatgattgggggaaaaatataattccaaatattttttctgagcagaaatccccctttgtaggtgtacaacgttctctcgtaagaaaatagaatgtgtcacactgaaaaaatagttacataaactaagcattaaataagatgataaataatatttagtatataattgatgtatgagtttttaaataatttaacaagtggaaatgtga

SEQ ID NO: 123459 - DNA, 1089 bp, Homo sapiens
gctggtctcgaacccctgatctcagatgatctgcctgccttggcctcccaaagtgctaggattacaggcatgagcgacagccgtgggccagatatgtatattttagatgtaggttaattcccataagaatacaaagagttgcctttgaacatccaactgcttgatccctaaaagtcattactgtagtttgagataaatgtggggcattattaaacaatattccttttgtatctaattcagtgtatatagaactttgatggcagtagtttctagatttcattattctaaaggaaaaaggagagatttattcttgtagaagggtgtgagtcagaatttaaagatactcttgttgggaagaagtgctaattccttagtactttgctttaatagtatcctcatttctgatgcctagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccataggtaagaaaaatcccagcctggccaacatggcgaaacctagtctcttctaaaaatacaaaagttaggctgggtgtggtggctcaccccggcaattgcagcactttgggaggccgaggcaggtggatcacctgaggtcgggagtccgagaccagcctgaccaacatggagaaacaccgtctctactaaaactacagaatttgctgggcatggtggcacatgcctgtaatcccagctacttgggaggctgaggcaggagaatcgcttgaacctgggaggcggaggttgcagtgagcagagatcgcaccattgcactccagccagggcaacaaaagtgaaactctgtttaaaaaaaaaaaaagaaaagttagccaggcgtggtggcgcatgcctgtaatcccagctactcaggaggctgaggcaggagaatcgcttgaacctgagaggtggaggttgtggtgagctatgatggcactctgcagtcccacctgggtgacag

SEQ ID NO: 123460 - DNA, 1049 bp, Homo sapiens
gtgcccacactggctatcgacgagaattgactctctgcagccaccgtctccgtcctaaagtcccatccaatcagggttccgcgggaagaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggtatcgccgctgatagggacgagcccctacctcctccctctctccggttgagctgacccctggccttccgcgcgccaactcccaccttctggttcttctcgcacttttaggtcccccggacccctgtctcaggcgcggttgctccgtagctcagagccggtgatggcatgcctgagcctcgtatctcgttgtgttttaaactcaccataccatttgagatgttttggagcaacatttccggacgggagcacaacttttattttccgagagttgacgtttatgtcatctcaagacaaaactttctgttttacaggaaaattatatttcactgtggtctattggagattttggaaacttggactctgatggagggtttgaaggagaccatcagttattgtgtgatatcagacaccatggtgatgtaatggatttacaggtaaatctgtgtagcatccaaaagctaactttgaaagtcctgagtaatacatttaaacaagcagagcatcataaaagttgtctggtgtcacccctcgtttacagaaaactgagtgctctgtaagttatgatttgcccaacatcatttagccatttagtggcagaaaaaggactgggaaaggggatgtagatttaatcatacttttttattaattgactgtcgactatgtgctaaataccgtttggggagctttacaaaaattaattattgttgcatgccagtgaatcaagtatcgttactttgttttactaatgagaaaattgagactaatatatcttgag

SEQ ID NO: 123461 - DNA, 1285 bp, Homo sapiens
ggagtgcagtacaggtgatgctgctgtcactcaggtccgcgtccgggtccggcttgtgaggggcgtgccttcggggtgggagcgtgtgggctaggccttatggagagtgggctggcgctcaggagaccccaccctcgtcccctgcatttttctcaccttcctcctccataatcaacctcgctgcaagctttccctcttatgcagcctcccccgccctccgttttttcccctggagggagatgccaccgtctgatacaggcgaggggaggaagatgagagtattgccattgcagatgctgggagaaatttctcgggcggctgtccagtggaaagctccgtgcggggcggagaaagaacaggggatgctgttcctgagagacttgtatttcaggagcctttgcaggtcctggatcagcagagggttgtgtgtctgatgttctaacttttttcagggctaccataggctttaaaaaccttatgtggagtttctttatatcactctccttagttactgtattccttcttctgatgataattttaggataggatgagtgctgtgtcactttctttttttaaatcgaaatatagcgtccccgttttgttgggagactacaagggccgcagtctataataaactcactggtcagaatttatagcattattcgctactatgcagtaatcatatcttgtcacatggtatttttaattgtcctgtgttacttagcttttcatgtgtttgtcttatttctcaactcgatttgtaatttccttaacggctggcaccattaaaaaaaattttttttggccgggctcattggctcacgcctgtaatgccagcactttgggaggccgaggcgggtggattacctgagttcaggagttcgagaccagccaggccgacatggtgaaaccccatctctactaaaaatacaaaaattagccgggcgtggtggtgcctgcctgtaatcccagctacttgtgaggctgaggcaggagaatcgcgtgaacccgggacggggaggttgcagtgagccaagatcttgccactgcactccagcctgggcaacaagggaggaaactccgcctcaaaaaaaaaatttttttttgaattttctctaagaatttaacagtcatccctttttttcataaatgcccattaaatgtccgttatatgcctaaatctgtgctagacagacaaaggtaattgagagaaattaggagtactgtttggcacatggttggtactttttttttttttttttttttttgagacagagactccctc

SEQ ID NO: 123462 - DNA, 1041 bp, Homo sapiens
catttgtcattttctctacaaaaaataaacaaaattagctgggcattatggtgcatgcctgtagtctcagctacatgagctacgtgggaggctgagatgggaggatcacttgagcccgagaggttgagggtgcagtaagccaagatcatgccactgcactcgagcctgggtgatggagcaatactttgtctcaaaaaaaaaaaaatgttgagtatctgtatgggctgtatgggctttggtattgtatgcggtttcaggcatctattaagggtcttggaccgtatttcctgtgggtaaagggaaactactgtactgaccactgaaagcaattgttcttttatctatttttatttgtaaaaataattcagtccattcccctaatgatcaattgtttctacttatgtttcttttgcattcttgattttgtcattttacatatataatgtttatggaatttgtcatttagtcagctgatattttagtgctttctatatgacaggcactggggatacagcagtgaacaaaacaaacatccactccctcttgtagcttctaatgggagcagccaagtatagtatgtcacatgataagtgacaaagtagggagggaggacagagtgtgtggggcagtaggtttatagttgtagagaaggcctcagtaaggtatcattagaccaaagatttgctggaggagtagacacatatcacgcaggtagacttgggataagcattccaggcagaagaaatagcgaattccagatttggatttaggatctgggagaaaagattggaggcaaggatccaacaccaaggttttaggccttggcaactggaatgatttgccattttctaaattggaaatggtgagtgagtgagcagccacgtttattctgtgaggaggggactgtgggagatcagattattttgaggaatgcttttcttataagacatttaagtcgagatttttagtaggcatttgaatatgcaagaattatgatttgtagtttttatatcctaaaagcatttacttttgtaaataatg

SEQ ID NO: 123463 - DNA, 1109 bp, Homo sapiens
ggcggatcacctgaggtcgagagttcgagaccagcctgaccaacatggagaaacctcatctctattaaaaatacaaaattagcctttgtatttttgtatttgcttatatatgcaaagaatctattccttcctttttggaaggagtcacaagaaactagtaatattggttacctttacagagtgaaacctggatggttggaaatgggagtagggtggagacttttcacttataaatcttttaatttttttactgaattaattaaaagttaaaaattcacacactggaggtctaaaattactgaaacacatgatctgaatgtaagaattctaatcaaacagtttacttaagtaatacctgggcagatagccaagataacttggttatcttggtagatgacaatagtagaaaaattggtagaaagttggcaactttatttatataccatgatgtgtgtactttagtcttaatgaatattttgttttcttttggcagcatgcatatgcgctagaacttctatttgatcagttgcatgaaggagctaaagctcttgatgtaggatctggaagtggaatccttactgcatgttttgcacgtatggtaagagttttatttctcactctggccccaacagaagaatattatatgatttggctgtatgtttttttaactagtggttttcatgtttatttgtttgttaattctattaggatagcagttggaatgagcatcacttaggattttgttgttgttgcaagtgacagaacatgcaacccaaactggcagagctaaaagggagtttatttagttcatataacagaaaagtctaggggtgtatacggtctgttgtgtggctggatttagaagagcagatgttgttattgacgatagggttctctctgtttcttgatttggctttactttcctccacatgttggtgtcattatccggtaagctctacccttgtaatcacaagatggtggccagtagctcccaaactaccttcttccaagttctgatttggcagaaaagaatagaataagcctggttttcttttcttttttttttttttttcttcttaaaaacagaggttttattgcatttggtccac

SEQ ID NO: 123464 - DNA, 1024 bp, Homo sapiens
gctactcaggaggctgaggcaggagaattgcttgaacctgggaggcagaggttgcagtgagctgagatcgtgccactgtactccagcctgggtgacagagcgagactctctctcaaaaaaaaaaaaaaagaaattcctccctgtcaaattctttatgtaacattttaatatttaaagttatactttagatggaatttaaataaaaaattattgtactactattaaatattggtaattttcttcaaagttctagatttaatctaagaaagatataatttttcttagtattacaagttttattcaatgagagtgatagttgagaaagttgtatatatggtaaataatttatgataaactgagtgtttagcaatctatagaagccttaagctatttttgttttctctttgtagaatatgactttcgataaggaaaaacttcaataatactttagaaaaacaaatttagcccaatgagctactgaattgttttctcttttccaggttggatgtactggaaaagtcataggaattgatcacattaaagagctagtagatgactcagtaaataatgtcaggaaggacgatccaacacttctgtcttcagggagagtacagcttgttggtaagtatcagaaaactttaaaaatttcttcagaggatttttattttcagaagatccaatgcaagctaaataatactcagaggtaattattgtatttttttttacaatcacttttaagtactaaaaaataaaaacgattatttttgctcacctagtgtgtattttgcagccatctctttgtgagtttaattttgtattttcctattaacctctgagattgaattttttgtaatgtgtctgaccattaggattttgtcttttgtgaagtacctgttcagatattggattgcttgtatttttgacttacagggcttctagccctttgtctatatatataaatacatttcttctcccatctgaggtgtgccttttcatcttattggtacccttttgataatagaaa

SEQ ID NO: 123465 - DNA, 1061 bp, Homo sapiens
cacatcaccaagatagttttaggtttgcaaatctccatctctttcttttaatacattccatgcactatttcacaaaatgcttctgaaggaactttcttaaatgattaagatgtcttaaaatgtcttaaaatttaatgtattaaaatgccatttttgtcatccaaaaatgaaatgagggaagagacagatagtaggaaaaaccaaaagaggaaaccacatagggcatcttaatcaggcagaggcatggaagtttgcaggattgttacaaagggaagggcctggatggaagctgtgcagcaggcctggagaataaccagctcagatttggagcaagaggaggaaaggaaacaatgattggatacttcttgactcagcagcaaatcatagttacacagtcataactagaaatgattttaataaaaaatgattggttggattgggggaaggaagcaaaatgtagattaagggagttcaatccttatctagcgtatgttttgaaatataaaggtaaatactagaagacatagctaaaaggatttgaaatgactggatttagagagcaagggtggggtagggagaggaagtcagctgtttttcattataagccttgaaattgagaaaaacaagaagatagacttgcagacaaccaaaactttgattgagggcaccctttcctgaggtaataaatatccaaagtaaggtttctggctgggcatggtggctcatgcctgtaatcccagtactttaagaggccgaggagagcggatcacttgaggttaggagttcgagaccagcctggccaacatgttgaaagcccgtctctattaaaaatacaaaaaaaattagtcgggctcggtggtgggcacctgtaatcccagctacttgggaggctgaggcatgagaattgcttgaacctgggaggcggaggttgcagtgagccgagatcgtgccactgcactccagcctgggtgacagagcgagactcagtctcaaaacaacaaaaaactacaacaaaaaacaaaacaaaacaaaaaaccagagtaaggtttcttctttaatgt

SEQ ID NO: 123466 - DNA, 1091 bp, Homo sapiens
aggttaggagttcgagaccagtgtggccaatatggtgaaaccttgtctctactaaaaatacaaaaattagctgggcatggtggcgtgtgcctgtagtcccagctacttgggagactgaggcaggagaatcacttgaacctgggaggcagaggttgcagtgagctgagatcgtgtcattgcactccagcctgggcgacagagtgagaccctgtctcaaaaataaataaataaaataaaataaaatctgtaacttggtgatgtatgtgcttttttttttttcttttagctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgttgcatggtctgcccttattttggtttaacatatatatctttgggaaagggagggtgagacttggttggcacaaaggctttttttgtttgtttgtttgttttttttttagagagactttcagcttcaattcagtactttgtaaggattttttcttcattatcagccactctgtttttatgtttttaaattatttttatagcactggatgggcatggaaacaatgagtttggtctgtaaaagaggccaggcggagtggctcatgcctgtaatcccagcactttgggaggcctaggtgggcggatcacttgaggtcaggagtttgagactagcctggccaacatggtgaaaccccgtctctattaaaaatacaaaatcagctgggcgtgatggcacaggcctgtaatcccagctactcgggaggctgagccaggagaattgcttaaaccctggaggcggaggttgcagtgggccgag

SEQ ID NO: 123467 - DNA, 1045 bp, Homo sapiens
ttagtttgtgaaactgaggaatgttcaagtttattattccataagctctttgtttattgatgtcttcttaaagtgccttgcatctatgaaaaagatgttaggaattgactgcatttccaagactgacagtattggtgctaagggatccaattgatcccgtgttccatattctatattgttcctttttaatctctttacatatgttccagtattgtgacatacattacatccttaaaagcagggatatattctgttacttttggaattctttttgtctctcatagtgcttcgtacaaagcaaattgtacaacacttttattaccttggaagatccatgaaattattagaaaacgttcatggattttgattgttgtttccttatagtatatcttttcatttattcttggtaaagaatgtataagactaaatgttagtatcatagagttaataaaatctaataaataattaaattatgtataattatatactagtagaaatatatacagttattaacctaatgaatatatttagcatagtatatagcaattttaaagagcctttctaaaaatttagtacatactattttttattgtaaatgatctatacatgtaagtcagataaagaaatggtcatacagaattttgaacattggggaaaatttaataacttgaaagttacatggattttagagtattaggcttttaaaaaattgtgcacgcgctggcagcaagtttttgtttttccctagcacctctaattttaaaattcaggtctataaacctaatttcttttccttttttaaagtattttttagacagagaggatagttggaaaaatggtacctatgttgttgagggggcattaatttatttacagtatacttaatgtcttgcagcaggtaaattgtagtaaattattattattattattgttttctgagatggagtctcgctctgtcgctcaggctggagtgcagtggcgtgatctcagcttgctgcaacctccgcctccctggtttaagcgattctcctgcctcagcctcccg

SEQ ID NO: 123468 - DNA, 1034 bp, Homo sapiens
aaattgtagtaaattatttaaaaataacaatatctttggcttgggcatggtggctcacacctgtaatcccagcactttgggaggctgaggtgggcagatcacttgaggtcaggagttcgagaccagcctgagcaacgtggtgaaaccctgtctctactaataatacaaaaaaaatttagccgggtatggtggtgcctgcctgtaatcccagcgactcgggaggctgaggcaggagaattgctggaacctgggaggcagaggttgcagtgagccatgatcacaccactgcactccagcctaggtgacagagcgagactctgtctcaaaaaaaaaaaaaaaaaaaaaaagccaaaacaagaaaaacaatatcttcagttcatattctaaaaagcagaagtgaattttactttatgaatagagcactttgcaaataattctttgttgaccaaatattttaatgcctgcatgagttaagtaaaagctgttctatgagaattataacattgttatttggaagaatatattaagaggaagcagacttatgatttgtcatttaatagataatccaatactataggataaaggcagcttattggagaaatgattttaaaaatattttcttgcacaatttacaaaatttagtttaaaaaaattgtccagtaatttacccccacttacttgtgaaattatgagctctttatttcttcttcccttcaaatttatcttaacaactttttcaaaacttttaactttaatttttattgccaacaagttgctaggatagtacaaataactcctaaatctcttcatccagagtcatcaattattatcatttttctacatttctttcccctctttctatatatacatatatgtaatttttttcctttttcttaaaccacttgagacttaattatcaatatcatgcttctttacccctaaagttcttgtttttgtcactcacattaccttcagctatgaggcttgtgggcttctctcgtggttttattcattttttcacttttaacagtttt

SEQ ID NO: 123469 - DNA, 1589 bp, Homo sapiens
caggtatattatacctacagatgatgccttttctctcagagcgcttgggttgagattgacccactccacaattgctagtggacattctgagcaaaagaccacatttctgtccaattttgtgaatgtaactatcaactcatttgaactctaaaacacttaagttgtcattttactatagtgtaaagatgaccgtagatctaaaagatattttttctgaattttgacattgaaggaagaaatctatttttagaaatcaaaaatgaagaactcacgccctttaggttgcatacttggttctggagtggcatggaagatgtttggaatggctgaccctctgttgctttcacttgggttgtttgcatttttattttttaaatatattgcttggtgatcagcgcatttttattgacttaatagttgtgtctaaactattataaagccaaattgggtagtgtgtaactcctactaatgtatttctctcttttttcctcacagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcattggttgtttttgaatatagaaggaagaacagcaagtccaccagatagggagtgtttacgatcatgggaaaaagactgtttctctggttgtttccttttgcgaagtctgagtaagtaattagcattaatccaactgtacattgtagaatgtgactacactgctccagggccaggaccgtacttcagtcgtcatttctctttgactccctagcccagggcttgccctgtagtagctatacagtaaatgctggtgagtgagtgagtggtgaatgaatcgacttaaagtca

SEQ ID NO: 123470 - DNA, 1070 bp, Homo sapiens
tttagtagagaggggtagagaggggatttcatcatgttggccaggctggtcttgaactcctgacctcaggtgatctgcccatctcagcctcccaaagtgctgggattacaggcgtgagccaccgcacccagcctaaaagccatttgtaaagaagtaatatttaagacttttttcaagagctggggggagtgttcacatgcccacgaaggttctttgccagaattacgcacccacacatgcacccagtagaagggctttgctgggagtgctgattctgctcattctggagcttatatttcctcagttccagaactacttcttataaaagttataaatcacaacatttaaataagatcccaaagtgctactgccttcttagaaattcagctatagtcattatattaataaatctttgtataggtgagagatgggttttggtctgttcaccctcaatcctgttctttcctgactttaagtcgattcattcaccactcactcactcaccagcatttactgtatagctactacagggcaagccctgggctagggagtcaaagagaaatgacgactgaagtacggtcctggccctggagcagtgtagtcacattctacaatgtacagttggattaatgctaattacttactcagacttcgcaaaaggaaacaaccagagaaacagtctttttcccatgatcgtaaacactccctatctggtggacttgctgttcttccttctatattcaaaaacaaccaatgcctcttttacttttaactttatttggcaaagcagcactgcataaactgttcaagaactaggacacagcttacacagcatgttaagttcatatacattatcagcagcaaattagaaacagaaaaccacactaaactacaagtctcctataattttgagagagagagaagggaagaactaagtcagttatgtccaatctgaacagctgagtgtttacaggacatcacctgccatcttatggtttaatatttacaaatgcctagttttaaggtaacaaagcagctgattgtatctacaacatgctattctatgacac

SEQ ID NO: 123471 - DNA, 1046 bp, Homo sapiens
tcaccatgttggtcaggctggtctcgaactcctgacctcaagtgatccacccaccttagcctcccaaagtgctgggattacaggtgtgagccaccacacccggtcgagggtttcaactcttttccagtcaataacattagaagaaaatgacattctgggaggaaaataatccattaacattgttcatgcaagtgttttaaattccactgccctaattttaaatactgccattgttcaaaaaaagttcactgtgcagtggtgcgatctcggctcactgcaacctctacctcccgggttcaagtgattctcctgcctcagccttccacgtcaccatgcccagctaattttttgtatttttagtagatacagggtttcactgggttagccaagatggtctccatctcctgaccctgggatctgcctgccttggcctcccaaagtgttgggattacaggcgtgagccaccgtccctggcccactgaacttttaaaattggtatataatgtacctctattaaagcatcttaaaaattcaattgatctaaaatagactgacatctttgagtaataatgctcatgaatttttgaagctattcttggtgtgtgattgtcagccaggaaacagctgcttagttttgtttcattagccaggtgggtatttttggttttcagctaaatgttaacaaattttcaatagtttgatattttactaaaatatatgagtatggtaactgaacactaatattgtaaatgaactaatggattatttttagtgttctaaatggggttcagaggctaatacattattttaggtaagtgctaacattcttctaggtataaatcattgcctacaacttattgtgttcttaaagaactgaacagtaaaacaaatgggttctgattggatttcagttggatctctggattcctctgaccattttccagaaagatgagtgttgtgttctcactgaacctagcacgtggctcaaatagagggctggtgaaagaatcccacttgaagaaaaccagctgacccaaggggccaag

SEQ ID NO: 123472 - DNA, 1016 bp, Homo sapiens
aatgctgtggaaggctggaggagtagctgctatctactaagaatgaaaggaaaaagtaagttttaagtgttcaggaggagttagtgagccttaggaaaagacatgtaaaacacaagaacatgtttaagagagaaattgtggacacctttccctttaaaattatgtttccattgtcttagatgcagaactccttcaatcagataatctacaggtaagaagatcacttttaaaagtcacattcagtctacctgatataaatattttgtagaccttgattctccttccctcgagtatgctttatgtggccctgggcatgtcactttctctaatactcaatttcccccgttgtaaaatagggttggtatgattgaatccaaataatgcagtaacagctcagtcaataatagcaacttatgattatattaaaaggaaaaaaaggcttaataataaaatacaatttattaaaggaatcatgtttacatagatacagaacatcttggatatttcaacaccatagcaacacaaaattaatttcttcatgtataaaagatgtgctgaaagctgcatgcctcatcagtttttattttattggttatggctatagttgacatctttccatataaaaacaaactgcacagcatcacatatagagtacagacatcttaagttcattcacaaagttaatttttctaaactgcccttcaaaaatttacatctttgctcaattctaaacattcaacaaaattagcttcccaagaaacaaaaatgatacccaatttctttgcttttctagaagtaactttccatttgttcatgtattttgatatgttatattccccacccgaattaaaccctttgttaaaagaacaacctactttaggttcagtctaaaaataaagcgtactagattctggagtgtttttcaaatattttaaaatatttgccacttatggttaaaaaaaacgtgaataagaatatcatgtgagtgtagataggcaccatactatacactcctc

SEQ ID NO: 123473 - DNA, 1430 bp, Homo sapiens
tctttccaagtgccctagtgacaaagacagaaaacaacagaaatgagggaagggtgtaggaagtagaatatttactaagtggaagaagaatacaataatttctttaattttggttgattttaactaggaagaaaagactttggaaaccatcctttagaaaggcaggctttagtcttaaatcccacaaactagtaaaagaagctttagaagaacaaaatataagcttaagttataaacattgagaaaactttctttttaccctatttataatatcaggacaatattaaaatataatgtttaaacaatagatagctaagaatactccagatgtcaagtacctgggtgacccccttggtctgctggcctcctggacttagcctgtcccaagatatttgaataaaaggggccctgtcccctatcaagggaagagggaaaccagcctgcctcttgcctccccacacatatgtatccagagagtctcagctctagttggctgttgcctattctggttgttacatatttttgttttgttttgtttttgagacatcgagtctcactctgttgtccaggttggagtacagcggcgcgatctcagctcactgcagcctctgcttcccgggttcaaacgattcccctgcctcagcctccctagtagctgggattacaggtgcatgccaccacacctggctaatttttgtatttttagcagagatggggttttgccatgttggccaggctggtctcaaaacttctgacctcaagtgatcctcctgcctcagcctcccaccatgctgggattacaggtgtgaaccactgtgcccagcctgttacatattttaaatgtcacccccattcatatgaacagaatacataattcatcaccctagctggttactgagaatagcatcatggtgtgttttagaaggagctagaaagttgtaaatctcaaattatccaaactaagccaactaaatattaaaagtcaagaataattttcaatattctggcaagtacttttgggagatttcattttccttgtcataaaagcattaaacaggaatcagatcagacagttcagcagcctcatatctgacttagcaaatagaacattttcccagatctcgtctgttttattgttaccatagctaaacctgagccccggcattgggattggcatcttcaaccacagcttcataaccctttagcctaaatgctgatgctcatctttaagcaagtcccccggactggggctgggtgttgcggtccaattcatgagaaatgatttggggttcctggggttttctgtgggtattgaccaaagtctctttttttgtcctgttcctttgtaacatatgcaacttataggaaggtggagggagaatgacaccttggggccacttagccttgtcagaacttctttcatcaggtgg

SEQ ID NO: 123474 - DNA, 1023 bp, Homo sapiens
tagtcaggcatggtggtcccagctactacgcctatagtcccagctactcaggaggctgagatgggaggatcatgtgagtttgggaggctgaggctgcagtgagctgtgatcgcgtcactgtactccagcctgggaaacagagtgagaccctgtctcaaaaaaaataaaaataaatctcattagccttactttttttagtgatagatttagttaaattggaggcataacgttgaattactagcacatgcatctctttcaagacaacttgtttaaatgttcacttgcttgggtgaagaggatttacacaaatacataatggttatgctgtttcatctcaaaacaacctaaaatttaacactttgggtattggtttacgtaagctaagtgttaatgtatttacaaataaatgtattagtgtctctggagtaggtacatgagtgtatttagtaagtgtcccttactacaaattagtgcaaatgtcaagatttccccccgcctttctggccaaattcttaattttaactcttatttcaagatacttccttaacactcttcaaacataaacttaattgtgagccaagtttggctacagaaaacaaggttcttcattgagaacccaccgtgaatccttacctggcatcacaggaatgatttgactctctggtccccaaaaggcggaatgattcctcttctctgtgtttgataatgcaggtggcttgtttggggcagtggctttctgagacttttccaccaaggagtcaccccctgcatcttcactcggccctgtggttcttggcagggcaggactagctgccgtgtgggttaccatcttgcggtccaggcccactgaagtgtggaagagctactgttagttgctggatttcttttctgagctttaatactaaaaacactacatctgcagctgatttaaaatcacggatatttggatgtaacagcccactcatctaagacatgtcagaggaccataaaaatctattctcacgttttcaaatgggtaatctg

SEQ ID NO: 123475 - DNA, 1045 bp, Homo sapiens
accaagatagactccttttccaacctcttgatttaaccacgtttcaataaaagatgtgtccaaggccgggcgcagtggcttacacctgtaatctcagcactttgggaggctgaggcaggaggattgcttgagtccagtagttcaagaccagcctgggcaacatagtgacaccctgtatctacaaaaaaaaaaaaaacaaaaaaaaaccaagtgtatgtccaagatttcacttgggtttgtgaactgtgctcagccatttggttttgaaggaatatcatataatctgccacttccccatgttcctgagagaattgtctagtccactctgtccctgtaaaaccgtggagctcctgtgacctgcttctagccttgtgccttagtccatgttgccagtaccagatagtcacccggttctcctctagctaagtctaataaagttggcttaatcaagggagagggaaaatgcatttcaggaaaatatttgtagctcctatgaattgcactgcaaattaaaagctcctaagaactccagaagggagaaatgtcgttatttctttctttttttttttttttgagacagagtctccctctgtcgcccaggctggagtgcagtgtcacaatcttggctcactgcaacctctgcctcccagactcaagtgattctcctgtctcagcctcccgagtacctgggactacaggtgcatgccaccaagcccggctaattttttgtatttttagtagagacggggtttcaccgtgttagccaggatggtctcgatctcctgaccttgtgatccacccgccttagcttcccaaagtgctgggattacaggtgtgagccaccacgcctggccaatgtcattatttcatgaaactaaattcatgccagcccataactaaattttgtttattctctacagtaccagggacgttatgataatcaacaaataggattcaatagtaaaaacttaatctcagtgaaaagtattacttaggagacaagaatgtaagacatagcatatgtaaaatagtacctctgggccag

SEQ ID NO: 123476 - DNA, 1048 bp, Homo sapiens
aagagatgctcccgcttctcttgactcgacttcatcaaagacaattgcttggctattctgggagaggactttgtttacagatggatggtccatttgctgcatctgttccaagagggaagctaaggagtttagtgaaaccagttgaactcgtggaagcagagagtggaatggcggttactggaggctgtgcgggggacggactgggaaaggagagacgctggtcaaagggtacaaagtgtcactgagaccggaggaacaggttctggtgatctgttgcacagcatggtgactatagttaatgataatgtattgtctgtttcaaaattgctaaaacagtaggttttaaatgttgtcatcacaaaaagattacaagtaggggagatgatagatatgtcagttagcttgatgtaatcattccacaatgcaaacatatatcaaaacatcacattgtgcctcataaatatatactctcctcttttgtcaattaaaaatacatattaaaaaaacaaggaaaaggcataccacaggattgaagaaagacttggctcttgggtgtaatcaattgctgatataataagtcacttcaaaaattttagaaagagaaaaagagtgcagctaaggagtacggttaaaattaattgaaatacgcaaaggacccatcaatttgaaagtgctacctacacattttcatagacactttacgcagatgcagttatattaataatataactttaaatacatatgatggttctcacattctgttgtacaatgtaacaatgtaaaacttatttcattcatctatgtttcttacttttctaaacatctacattttttttttgagagggagttttgctcttgttgcctaggctggagtgggagtgcagtggtgcagtctcggctcactgcagcctctgcctcctgggttcaagtgattctcctgcctcagcctcccaagtagctgggactacaggtgtgcaccaccacgccctgctaattttgtatttttagtagagacagggtttcaccatgttggccaacctggtctcga

SEQ ID NO: 123477 - DNA, 1041 bp, Homo sapiens
acgaacccactgtgtgatgcagctactgacacagttcatgtaacgaagctcattaatagaaggagaggcaatatctggatcacagtaggtaatgaatgagtcagaaaaccaaagcttaaatatggggttcaattaggggtattagatgttaagaagggtatggattaatatgagaaaatccagacaaggcaggatagtggcgggcctgaaaaatcaattcatatgaggaacatctgacaaactgtggggtgctgagttctgagaacagcataccaattggtgatgttctttctttctttctttctttttttcaaagacttccaaagcttttacacaggataaaaagatgagttcagtgtttttccaaagggaagacccaacaccaatgcacagaagtaaggggaggcgtagcctgcttgcccaacacagtgatgagtaatgtcatggacatgatgtgaagtagtgagcttctgcccttggaaaagtcagacagatggcagatgagccttggaaggggtgttgtggaaggcactcttgtttggaggagaggctgggaaggatgctgggtgtattagtccattctcacactgctacaaagaactgcccgaaactgggtaatttacaaaggaaagaggtttaattgactcatagttccacatggctggggaggcctcaggaaacttactagtataatcaccgcagaaggcaaaggggaagcaaggcaccttcttcacaaggtggcaggagaaacaaccaaatacttataaaaccagcagatcttgcgagaactcactcactatcatgagaatagcatgggggtgactgcctccataattcagtaacctccacctggtctctcccttgacacgtggagattatggggattacaattcaagatgagatttttgggtggggacaaaggcaaaccatactggacgagggtgagtccaattctaatgcaatataatcagggagtaaaatcactcttacttaaaccagtgatgagggacttccagatttgtttttgttttggttccagta

SEQ ID NO: 123478 - DNA, 1055 bp, Homo sapiens
ggtttggatgcagtttatctgcctaagccaggaagtgcttatttgcctaagccaggaatccaccctgagagggtgaataaaaagccacttgtctcaccacccaagacttcctgagcataggcagccaccagccacatggctgatttccatcggcggctatcccaggagccccgggcaggagccccgggcaggagcaccgcatgctggcctccctccctcacaggctcggtgtgccccagcagacctagctgccaggtaagctgtctactttccggctcatgtgaaggataagttcatcctattgttattgtcctctttagactcctttgtagtttcaaattttctacctggatcttgagctcagaaaaagaaatagaactttaaaaaagtaatctgagtcattaaaacaaagcatgagccttcttccttgaagtgtctttgtcctctagacaagtcacaaacagcagctagaaggagggtaggctccaagacaaatgatcgagattgctgctcactctcagcagaaaagcacattgagataataaaccattttggcataatcagttttatacagtctccattttatgccttctgctagcgtacagacatttagggagcatgaagtggcaggacattacaaaagaccacttcactgaaatactcgtttttgttagcagtgacaacatgcgttaccttcatgtccactgacgggtccccctgcagcagtgcccactcatactggacgatggcgtggtcatctgtgctctcgcggccgtctagaaccaccccgtctgtgggcagatgcagaaccacatcctgcccagccttgctaagtggaggcgcatccttttctgagaaagaaaataaataattcataaaagatgatttcttattttttctaatttatggagaggtatcttgtttgctgaatagatatgattcggcaaataactgctaagagaatccatattaaatggaaattatttttctatttattttatgatcgtggaatttagctataatatgcgcagaagaggctgtgtggagtgttggct

SEQ ID NO: 123479 - DNA, 2077 bp, Homo sapiens
acaggcagcctacagaatgggagaaaatatttgcaaactatgcagccaacaaaggtctaatatccagaatctgtaagaaacttaaacaattcaacaagcaaaaaccaaataaccccatgaaaaagtgggcaaagaacaggaacagacacttctcaaaagaagacatactaagtgtccaacaaacatgaaaaaattctcagcatcactaatcatcagagaaatgcaaaacaaaactacagtgagataccatctcacaccagcctgaatggtgattattaaaaagtcaaaaattaggtggattgctgggcggacccgtcacggagaagagaggagagtcgcgggccactgaataagcttccaaaatgatgcccacactagttatcctgttgaaagaggggactgatagctcccaaggcatcccccagcttgtgaataacctcagtacctgccaggtgattgccaaggctgtaagagccaccctgggtgcctgtggcatggacaagcttattgtggatggcggaggcaaagcaacaatatctaacgatgtggccacaattctgaaacttcttcatgttgtccatcttgcagcaaagacgttagtagacattgccaaatcccaagacactgaggtcggtgatggcaccatctcagtgaccttgctggctgcagagtttctgaagcaggtgaaactgcaggtgaaggatggtttacaccctcagctcaacattcgagctgtctgcacagccacccagttggtagttaacacgatcaaagagattgctgtgactgtgaagaaggcagataaagtggagtagaggaagctgctggagtagtgtgccaggaccactctgagctccaactgatctcacagcagaaagctttctttgctaagatggtggtggatgcagtgatgacgtgtgatgatttgctgcagcttaaaatgattggaatcaagaaggtacaggatggagcccagctggtgttgcatttaagaagactttctcttatgctgggtttaaaatgcaaccctcccaaaaataccaaaatccctagattgcccttttgaatgttgagctcgagttgaaagctgagaaagataatgcttagataaaagtccacacggttgaggattatcaggcgattgttgatgccgagtggaacattctctatgacaagttagagaggatctatcattttggagccaaagttgtcttgtctgaactccccactggagatgtggccgcccagtactttgctgacaggaacatgttctgtgctggccaagtacctgaggagaatctgaagaggacaatgatggcctgtggaggctcaatccagaccagtacgaatgctttcttagcagatgtgctgggtcgacgccaggtgtttgaagagaccctgattaaaggtgagaggtacaacttttttactggctgcctcaaagccaagacaggcaccttcatcctccatggtggtagtgagcagtttattgaggagacagagcggtccctgtgtgatgccatcatgatcatcaggagggccatcgggaatgagtcagtggtggctggtggcagggccattgagagggagttctccaagtacctccaggattcctcaaagactattccaggaaaacaacagctgttgattggggcatatgccaaggccttggagattgtctcattccagctgtacaataatgctggctttggggccacagagattctcaacaagctgcaggcatggcattcccaggggcacgtgatatgaggtggacatcaacaacgaggacattgctgacaactttgaggccttcgtgtgggagccagctttggtatggatcaatgccctggcagtggcctcttaggctgtgtgcctgattgtgtctgtggatgaaaccatcaagaatccgattgactgtggatgctcccccagcagctagctggggccgtggtcgtggccgcccccattgagaggcaccccgcctatcacatgactggctggcaggctggctgcagggtgtgcttactctccttggtttggttaatagactttacaaggaaggggtagtcactgg

SEQ ID NO: 123480 - DNA, 1146 bp, Homo sapiens
actgctgaagatcctctgccatccaggcccttcctcctctcttgctagagaggcctggcacctttctagcaaggtcacgtgttgactgatgtgggcagaggggcagtgggacatgtctggggacatgtggtttctcagcagacagagacttcctcctcctcctcctccttgtcctcatgcaaggggcgagcactcgccttaaacttgtagacaccacagttctggagggggcactccttcctgggccagcccagcctgccagaggcatcctcttattgacacagcgtggaggggggctaactaggggtcttttcctccccacccacccctcacctgcctttctccacagaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaagggtaagtttcagatggcccaggacagcagggaacagatacagtggtaggttagaggcatttatagttttcatgtaaaaatacaaaagggtcctgggcacggtggctcacgcctgtagtcccagcactttgtgaggtagaggtgggccgatcacaaggtcaggaattcgagaccagcctgaccaacatggtgaaacactgtctctaccaaaaatgcaaaaattagccaggcatggtggcgcatgcctgtaatcccagcaacttgggaggctgaggcaggaggatcccttgaacccggcaggcagacgctgcagtgagccgaggtggtgccactgcactccagcctgggcaacagagtgagactttgtctcaaaaaaaaaaaaaaaaaaaaagccaggtgcagtggctcaagcctgtaatcccagcattttgggaggctgaggcaggcggatcacgaggttaagagatcgagaccatcctggttaacacagtgaaaccctgtctgtactaaaaatacaaaaaattagccgggtatg

SEQ ID NO: 123481 - DNA, 1050 bp, Homo sapiens
cagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgttaacatgatggttttgctgtgtcagtttctctgcagaggtgaggaccaagcacctcacctcgtttcatttcattttcaaggatttctaggcatgtaatcctggccctctcctcaggcatcttca

SEQ ID NO: 123482 - DNA, 1050 bp, Homo sapiens
gagagttggtttaggagttttgaacagattggatacagaactatattgtgttttgtatttagaccgggggaaagactagaatgttaactctagggtccagtttgtcatctaacagaattccgggcttgggtaggtcctgtaatgcggtacaataacaaccaggtgttaaaaccggcatcttctggattctcagattctgtagacagcatacttctaaaaaatgtagagattttggattttgattaaattgctgttaaaaacatttccaagcccatcatttcaggagatcagaaaattttcgaactttaattttgccctgtgggaccctgggcaagatacttgcctctggtcgtcttggctgcctcccttataaagcagtgcacacgaaccagatagcttctacggcctcctgctcattcctcatccccctcccaaacccctaccccctgtaatttggtctacaatatttaagacagagagaaaagtaacgggttgatgtttgactctctcagcattttgagtctggcttcccaattcctgacttgactttttgtctcatttgaggtcccaattctaagccaccaaaccacctgactaaagaaacttttttcttcagagtgctcccacctccctggcttcatcctcaaataggtcatcagtagcagtccacagtcaacagcaatggctgcacgaccttccccatccttgtgtagcagccccccaagtcctctgctaaagggcaaagcaaagtgagaaacagttacctggcaatcagatgccagataactgccccgattctgctcgtccttggtggcattttcctgcttcccctactctaaatgggcaccctgaattaggggcaccagcttccttcaatgcctttaatataggtgactgtcaccgaatacaggcttaaatatttcagtgggggattcaggctgtagttcaaagaagttaaatgatcatttttaaaacaataggaagtggcaacataatttttcaaaaccaagaataaccagtcctatgttgtgttccccctttgcggatatg

SEQ ID NO: 123483 - DNA, 1039 bp, Homo sapiens
cagtctttaagaaaaaattatagatcgagaccatcctggctaacacggtgaaaccccgtctctactaaaaatacaaaaaattagccgggcgaggtggcgggcacctgtagtcccagctactcaaaaggctgaggcaggagaatggcgtgaaccccggggggcggagcctgcagtgagccgagatcgcgccactgcactccaacctgggcgacagcgagactccgtctcaaaaaaaaaaaaaataaaaaaaaagaaaagaaaaaattataatcccttgtctcttttgacttaggaaaaatatggtttctaatgcgaaatgttggtgtattcaggcagggatgggaaggaaaacattttttagacaaagggtctgtaagcaacctcatgcttgtgtgtggcaaggcatctcagatattaatgtttcatcacaggcttgcatcaatcttgcttgataaaattaaaagctgatcccaatccattcggtcattcagagtcacgggcagtctgtgccaagtagaatttactgacagaagagtcagctttcaagtgattaagagatgactacatcttcagctttatattgtctatgctgatgaaaagcaataaatgctttagctgagaagacagaagtatatggctaatcacctagcgatggggcccaggtttgctgtggaatacctgggccatagcgtatctaatgctgcaaaacagcttcaggtatgcctgggtgatttccagtccagtgattaggagttgactgtgtatctagaatagtcttcatgtttgaggctgagtatcttttcaatatgtaaacctaaggttaaaaaaaacaaaaaacaaaaccaaaaacactttttctgatgagatacaagccaaagtaaaaatttccacatctaaacatcctttggtaaatattgaattaccgtttgatggaaagctaaatcctgctggattcgtggatccgcaaatccataactctcctcttcttttcccctcccttcgtggtcctagagggaaggcaatttgaagagtgttaatg

SEQ ID NO: 123484 - DNA, 1016 bp, Homo sapiens
cattgttgtactttaaaaaccagatagaatgtcatagccccatgcagtacggaatcatggatgtctcatgttcttaacatctgtagctgatgatcaacttggatagacccaccagaggcttgctcagggaccatctctaataggcacggaaagactgtcacctaaaatgtcaaaaggaccagatgcgcccagtagtgccagatctgcttttagcagctgtggataaggaatccagtgtctggaacagacatttagttataatatttgaaaaacttgtagaagcactggaccagattccccaagcttaagaagtcaataaaacaaaattacccacctttaggctttaggtagtcaaagcctacattcatgttgactgagctacagccaaccttacctcccctccgccttgtctcctttcttcctgtctcatcccagatcccagtcgtcctcatttcagttgcattgtccagggtaggcatacttcagaagtctgtgttttattgcattataccgtcatgccttttctgtgccacaggaaagcctgttctagaggaaggttacatctgtgataaaaacttttagagttaagtagggtattaaagcaatcattgtgttttaaaatagaaagacaaggaattgcaattgatcttaagtcctgtattaaggcgagtattttcttttaatattctttgtcttaaaaaaaaatgtgaggcctggcttcttatagtgttgtaacttcatatacattcttttgatttctaaagcatagtcattcaaagataaacggagttcagcaatttcccaggtcctcataaatggaatatagtaaccagactcttagtcaaatgcttgccaaatcatttgtctatggtttccctttaattcctaagcccctgccctcatttctaagtcttctcaattgaggacttccagtcacctctgtgatcacatattcttaaagctgcctctaactcctaactctcctctttgaggaaatgaagggattttagtacagc

SEQ ID NO: 123485 - DNA, 1050 bp, Homo sapiens
aggccaaggcaggtggatcacttgaggccaggagttcaagaccagcctggccaacatggtgaaaccccatctctactaaaaatacaaaaacagtggcatacgcctgtagtcccagctacttgggaggctgaggcacgagaattgcctgaacctgggaggcagaggttgcggtgagccaagatggtaccactgcactccagcctgggcaacagagtgagactctgtctaaagaaaaaaaaaaagaagaagaagaagaagtacttttaaatacatgaatgcttctgagcattttaaaatttccccaggagataaaatagaatatatgtgatgatttgattctgaaagagtagaaccattacaaacaatttgtaaattctcaacctttaagaaggtggataaaatggtaaagtttccactgctgagtgctaccaaagagcatgtcatgttgtaggcaatggagagagcagtgagcttggactcagtcctgtgcctaggaagactatcttagctcttgaagcttccttggaatttttgcaaggtcgtggagcttaaggcactagccttaaagaagcgaaccctgagtgggggagatttaaggacaggcaactgggaagtaagtcgggtgcctgggaattgggcaagtggtcctggtgtggtcctgaacaagcttctcctaattgagaatctcgctgagggccggccctgggaggggagcccaaaccagaagtttggttggtcattcagaattcagatggtcccagcaggggcatcagctttttgtgtacaactggaagagagtttggcttctccatgtattgagacatctgtttactctggccagcctcctgctggaagattgacacagacagtcccatgctgtgcaaagggaagatgctgtgttttgtttcctaataccagagcagctttcttacagtgaggaatcacaaatgtccccacatcactacctgcttaagaaagtgattctggtcctctttgatagatcctgaagaatctgcttaagagtttctgaagacattttgttattctggc

SEQ ID NO: 123486 - DNA, 1021 bp, Homo sapiens
tctggagctaccctactcattttagggcatttacacttgcaatagcatttaaaatttgaatacccacataaagcattacaatttagataaaaacatggactcttcctgcaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgtaagtttctgcctggcatgagcactttccaggggatgggagttttgtgtgtatatattaagtttggtggaaaataccagaaaatgctatggacatatggaaacatttcccacactcatatttcacaactgactaatctgctttgaggatttggagatatttatattctaggcccgtagccccattgacaacagccaagagaagagattaatcttagctctgattctgatggggcttaggagtgcctcgccctgtgcactgacagtttcaggcagggagctatcatgcgaatgaaaaacagattttgtaatgtttccatcagccccgattcagtaggcaattggaagggaaagctatttgtcatagattggcttttgtatggagagcaaagagaaggggctgaaaagggagaagacagatgagcagagtgataagtgatctccaagctgggcttagcgtcacttcagttatctcctcttatattattttccactacttttgcaaaatgcaagaaggctttagaaacaacgataatcatagctcttaaattcttttttcttttcttttcttttttttttttttttttgagacagggtctggctctgttgcccaggctggcgtacagtggtgtaatcacagatcactgcaacctccgcctcctgggctcaagcaatcctcctacctcagcatcctgagtacctggggctctaggtgtgcaccaccatgcctggctaatttttttgtatttttggtagagat

SEQ ID NO: 123487 - DNA, 1060 bp, Homo sapiens
gggttatgcccacagactaccactgaaaaagtagtaattccctgggccaggttgttttgaatatggaccatctgttaaaatacaaagctccaatcttgacagaagcatgtcctttgatactgaatcattagggcctacgactacctcgagtagtcttcttttttacccacctttttaagtattaaatgatttcacattggggttttcttttcacttttggttggctctcctttttgttttgcctgctggtgttgtcttgggatgccccaggatcttttctcagctttgcgtctgggtcctttcttgacatggtgggctcctgtcgacgttctccccagcaaggaggaggaaatctctcccgagtcatcttctgagagtgctgtcttccctgccatctggcagaggcacgtccctaggacctgatgagttatatccacacctcgtccagctgggtgatcgagaccacttcctgtgcccactaggctttccgtcagttgacatgatgactccttttctctttcttgtttatctgggcacaggacgtcgtaatcgaatggaccgattctccagacttctccgtgtgggccttgccgctttgccaggagcttgctctcggtgctgtgcggaaggaggagcaccttattcacctgccgaaactctcgagcatctttattgaactctctagccggggtctccaggccctgggtcagatttctgcctataaatcacccaaccaggtccagttgctcccatatcttagagcctgtcatagcatgctggccatcttgttccatcagaccttcctcctgatagtctttgagagcaaggaggcctttgggtttctgggttttttggtgatgtttcacatgggagaaaactccatacaggcttgagaaattttcctccttgtgtagagtagggaaggcacaattttatgcttttgtctgcatctcgagcaacatcagaaacatttattttaatcctctgtctggaggattaaaatgttgtttgatatttcccttggcaaacattattctaaatttttgtctgagatcataag

SEQ ID NO: 123488 - DNA, 1007 bp, Homo sapiens
ggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagcca

SEQ ID NO: 123489 - DNA, 1037 bp, Homo sapiens
gaaaaatcttgcactgaagaggggagtttgaccctagagatggtgttttgggaaacagagtatatatagtagtgaattcaggtgaattcatattaaaggagaatggagtggagatgatttggtatcacagacctgaagcctctggaggcttctagaggatgggtagataatacagtattaactagggaagtggaccaggtataaaacttcccccaaagcagctatacgttctagagatctttgtgacgtatgtttattttatcttaaaaggagagatttcttattttctacctaaagcatctgtatttcaagtgtaccacggttgctttaaatttgttgacgaagtccataatgaaggataaaggaaccatttcccccaaaggtcaaagcaagtgtccaccttttagggtgactttcacctttagatcccctccttagatctcatagcattggcctcaccagaatccaggtccacacagaccacatcttttttttttttttttttttttttttttaagaggtggaaatttggattttatgcttaagcctttctaaaattgtaaaagccgagggccgggtgtggtggctcacgcctgtaatcccagcactttgggaggctgaggtgggtggatcacttgagcccaggagtttgagaccagcctgggcaacatggtgaaaccctgtctctactaaaaatacaaaaattagccaggtgtgatggcacgtgcctgtagtcccagctacttgggaggctgaggcaagagaattgctcaagcccggaacgtggaggttgcagtgagctgatatcacgccactgcactctagcctgggcaacagtgcgagactgtctccaaatagataaataaataaataaaattgcacaagccagattgagcccctgggccagcagtttgcagcctctgacttaactgtggtttagtagcaggaatctgcttaccctgtggtcttgatggttccatgagaactatgtggagaggcatacattgctatgtaaacaggagggcaaattgggggct

SEQ ID NO: 123490 - DNA, 1039 bp, Homo sapiens
cagacatggataaaacgtgacagtggacccagccagaaatctatttttttctcatcattataagaaaaccactgagcaaaatgatgaaatgatgttattccaggacctgctgtacttataatacctaatacaatgtaaatgctatgtaaatagatattacactgtacttttttatttctatgattttttattattttttgttattgtaattttttcaaatactttcagtcccaggttgattgaggatacagagggctgaccataagttccaagtaaagtggatatcagattgtaattttatgattcccaagtgagggtcagattgttaactttatatttttacaaccttatacccttataattcccagataaggtgggaataaaactagtccaagttacagagattggttttccattagccgagcaccatactgggacagtgctggaaggacccttcatacaatcctaacaaaagtagggaattgagagctattgtcttgaccttcaacctttggaaactggggtccagagaggcccatctgtttactggcagagctgggagattgaggctgcaatgagctgtgagcgtgtcactgcactccaacctgggcaacagagtgagaccctgtctcaaaaaaaaaaaaaaaaaaaaaaaaaggcttcctgaagaaagtgaaagaggtggcagctggaggcaagaccttagcagttgagctaagggaaggtcagctaagggaaggaaatgagctaagggaaggtcagtgttggaaaagtgggaatgttggaaatgaaggaacaacatgagcaaaagtctggagtagaagagagcatgatgaatttgagatactgagagctgttcagtcgagtggggagggcaggggaaaatgagtagcaatggcaagtaagaagagctgggcagggccacgttgtggcaggtcacgaaaccattgcattgcattttttttttttttttgagatggaatctagctttattgcccaggctggagtgcagtggcgcaatcttgtctcactgcagcct

SEQ ID NO: 123491 - DNA, 1060 bp, Homo sapiens
actgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaa

SEQ ID NO: 123492 - DNA, 1040 bp, Homo sapiens
ttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccaca

SEQ ID NO: 123493 - DNA, 1057 bp, Homo sapiens
tgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaatag

SEQ ID NO: 123494 - DNA, 1633 bp, Homo sapiens
aggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattataga

SEQ ID NO: 123495 - DNA, 1083 bp, Homo sapiens
ggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgt

SEQ ID NO: 123496 - DNA, 1460 bp, Homo sapiens
atacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatc

SEQ ID NO: 123497 - DNA, 1007 bp, Homo sapiens
cccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatgggg

SEQ ID NO: 123498 - DNA, 1056 bp, Homo sapiens
ttctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcag

SEQ ID NO: 123499 - DNA, 1821 bp, Homo sapiens
gccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgt

SEQ ID NO: 123500 - DNA, 1667 bp, Homo sapiens
aaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatg

SEQ ID NO: 123501 - DNA, 1030 bp, Homo sapiens
gagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaa

SEQ ID NO: 123502 - DNA, 1621 bp, Homo sapiens
gatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatac

SEQ ID NO: 123503 - DNA, 1849 bp, Homo sapiens
gcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcc

SEQ ID NO: 123504 - DNA, 1055 bp, Homo sapiens
tagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtctt

SEQ ID NO: 123505 - DNA, 1069 bp, Homo sapiens
atttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttg

SEQ ID NO: 123506 - DNA, 1036 bp, Homo sapiens
agaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatgg

SEQ ID NO: 123507 - DNA, 1976 bp, Homo sapiens
tgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagaga

SEQ ID NO: 123508 - DNA, 1532 bp, Homo sapiens
ctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagcta

SEQ ID NO: 123509 - DNA, 1500 bp, Homo sapiens
gacaacagggcaagactgtccaaaaaaaaacccacccaaattatctaaattctgtctctaaattactctaaattctgctcatttgtttgtgtatgtgccaaatgaagaaatggttttttggaagaaaaaactattttcatacttgtttaaaatatttttagaagttatatcatgaaattgttgcctgtccctgaaaagtaaaaacaatctactctcaaccaaaacatctatgcaatttcataaaacaaacaaagaaaaagggactaaacaatatggagagagaaatcaaaagaaggtactcagattgctggtgtttacaattcagcatctttgtttgcataaacactcaaacatacgaaaaaatttaaaacctcattaaaacttaaccgagcatcacagtgctgaatcagaagcactgggtgagtgatgaagccatgcttgctgcccttggaaagcagcctacatgggaaaccactgagaaatctcagcactgttcatgtctctgggtttcgtttgcagagagagtcgtagccctgctcaagtcaggtggttcacccagtcaccaactgcccgcatccctaccattcaacccaagggaaatgcaggaatttgtgcagcctcaaacaaaagccatcagtgctgcaagaaagtaatgtaaggcccctggcccactaaacatggccattgacatccagatttagttctaaaaaaagtgaagatgtaaccacatactcatcacaactgccaatcttggctctggcctcaacctctctcctaaattacagacctaaatttccttccccaccctgaaatggacaaacattaacattttaccatgattacttaagattgttcctctttcagagaagtaaagcagcatagctgagttcagtatcccatgcgctcatcccacccctctacttcttcccatggtcataactcctatgaactcagagcttatgcagatcaggttttcagactttttctacataagcacacatgcataaacagaatatagcattgtgttatgtgtttttcaaaaatgtaacagattgtatacacacttccacaacccgttttgttttttcattgtgcatttctgagctccagcagtgtggacatacccagaagtagcattgttggttataccacgtgcacatctcttactgacgaaggagtcctttcctggggagggagccctgttagataacaatttgtccactctttcccttcacttattcgacttcagaaaagtggtatgacttatctgatggggggttggaaagaaacagtatcttaaagtacagtcctggcaaaatcattcaggaagtcctcatggattagaaactatactaactcttctccatgacttttaaagacattgaatgagactccagtctatttgctttaccctgtctctgaactagcgaactattttgattccttgaacacaggccaatctttctcccctctcaccttcttcaaggctcgcctcagtgc

SEQ ID NO: 123510 - DNA, 1028 bp, Homo sapiens
agctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaag

SEQ ID NO: 123511 - DNA, 1078 bp, Homo sapiens
gccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcaccc

SEQ ID NO: 123512 - DNA, 1016 bp, Homo sapiens
tgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccag

SEQ ID NO: 123513 - DNA, 1010 bp, Homo sapiens
ccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgt

SEQ ID NO: 123514 - DNA, 1084 bp, Homo sapiens
ttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaag

SEQ ID NO: 123515 - DNA, 1029 bp, Homo sapiens
cccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggca

SEQ ID NO: 123516 - DNA, 1047 bp, Homo sapiens
aaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgag

SEQ ID NO: 123517 - DNA, 1110 bp, Homo sapiens
gtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttg

SEQ ID NO: 123518 - DNA, 1002 bp, Homo sapiens
cccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggt

SEQ ID NO: 123519 - DNA, 1056 bp, Homo sapiens
tgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctc

SEQ ID NO: 123520 - DNA, 1049 bp, Homo sapiens
ccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagg

SEQ ID NO: 123521 - DNA, 1150 bp, Homo sapiens
agagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactaggga

SEQ ID NO: 123522 - DNA, 1032 bp, Homo sapiens
aacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatattt

SEQ ID NO: 123523 - DNA, 1046 bp, Homo sapiens
actaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtg

SEQ ID NO: 123524 - DNA, 1032 bp, Homo sapiens
agattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaat

SEQ ID NO: 123525 - DNA, 1366 bp, Homo sapiens
ccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttat

SEQ ID NO: 123526 - DNA, 1262 bp, Homo sapiens
tggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaccagcaagttttcagtgccagataaaactctgcgctctagaggtaactcctcatgggaggcagctaggagtgttacctgacaccagtttcctagaaaactgtgacaagcaaagcaataacacacgtcgagaaatatctgatcaagcgggaaatcttctgactgtcggggatctctagtaagatctcttggaatgaagtgcactgtgtatccaaaactattttccagcgccagtgaagttgctcttacctaaaacaaatgggtttatgctagtttccaccaaggaatgagtctcgatggccattaaactttctaaggcccacagggctaggaaaagtcgctcttaaaggtcaggtgtttggaaaatgtttttccttttgcccaacccttaattagtagtagagaatgttctgtggcctattcccctctctgggagt

SEQ ID NO: 123527 - DNA, 1048 bp, Homo sapiens
ctttctttctttctttctttctttctttctttctttctttctttcttttctttctttcttcctttcttccttccttccttcctaccttccttccttccttccttccttcctttctttctttcctagacagagtcttcctgtcacccaggctagagtgcagtggcacggtctctgctcactgcagcctctgcctcctgggttcaagcaattatcctgcctcagcctccagagtagctgagactacaggtgtgcaccaccacgtctggctaatttttgtatttttagtagagaacagggtttcaccatgttgaccaggctgatcttgaactcctgacctcaggtggtccacccgccttggcctcccaaagtgctgggattacaggtgtgagccattgtgcctggccaaagcatttacttcagtgaaatgatggggcctcaaaagttctaaaaatgtgtggcccctcaaattctttttgtgtatgtgtgtgtgagccaaagatttatttcttcatttcttgcatttgaagtactcttggatgacatccttggcctgagactccttgccatagtccttaactactacacaactgcaaccaaccactttacagggtttcccttctctgttaattttacagaggcctatcctttcccctagtttcttgttgtcatcaaccttaattaggttgatttggtgttcatggcaaagggcctccacgacttgacatacatgggctcatcacagttgggtacaagcacacaaagatgggcttggcacttgtctaaggcttcggcagcttcgtgaattccacgtgctaggccatcgtggatgagggcggtcttcagcacctcttgtaaagcagtattaacgtccattacacctccagcagcaatgccttccttggccatggcggtggattacgggtgaagctgaatcttgaaggcacccaagcctccgcctccgcacgactcggcagaggcagggaaagagcctcaaattcttagcgcgttaaaaatttctgcctagatctgagagacctcctcttaccat

SEQ ID NO: 123528 - DNA, 1050 bp, Homo sapiens
aatattgtaaaagtcaatatttgtaaaagacacaataggttggcttggcaatggtaagaggaggtctctcagatctaggcagaaatttttaacgcgctaagaatttgaggctctttccctgcctctgccgagtcgtgcggaggcggaggcttgggtgccttcaagattcagcttcacccgtaatccaccgccatggccaaggaaggcattgctgctggaggtgtaatggacgttaatactgctttacaagaggtgctgaagaccgccctcatccacgatggcctagcacgtggaattcacgaagctgccgaagccttagacaagtgccaagcccatctttgtgtgcttgtacccaactgtgatgagcccatgtatgtcaagtcgtggaggccctttgccatgaacaccaaatcaacctaattaaggttgatgacaacaagaaactaggggaaaggataggcctctgtaaaattaacagagaagggaaaccctgtaaagtggttggttgcagttgtgtagtagttaaggactatggcaaggagtctcaggccaaggatgtcatccaagagtacttcaaatgcaagaaatgaagaaataaatctttggctcacacacacatacacaaaaagaatttgaggggccacacatttttagaacttttgaggccccatcatttcactgaagtaaatgctttggccaggcacaatggctcacacctgtaatcccagcactttgggaggccaaggcgggtggaccacctgaggtcaggagttcaagatcagcctggtcaacatggtgaaaccctgttctctactaaaaatacaaaaattagccagacgtggtggtgcacacctgtagtctcagctactctggaggctgaggcaggataattgcttgaacccaggaggcagaggctgcagtgagcagagaccgtgccactgcactctagcctgggtgacaggaagactctgtctaggaaagaaagaaaggaaggaaggaaggaaggaaggaaggtaggaaggaaggaaggaagaaaggaagaaagaaaga

SEQ ID NO: 123529 - DNA, 1142 bp, Homo sapiens
aagagaagaaggaaagaaagaaaaagaaagaaagaacagagaagaaggaaagaaagaaaaagaaagaaagaaagaaaagtaaaaaaagtaacaaactttgtagcattctgaagcactaagtggcatacccaaaaggttgggctatttcatcgctagaggtcattaataacacaaccacttttcttttcttctcttttttttttttgagacagggtctcactatgtcatccaggctgcagtctggaactcctgggctcaagtgatcctcccgcctcagcctcccaagtagctaggactacaggcatgcaccaccactcctggctaaatttttttttattttttgtagagatgggagtttcactgtgttgcccaggctggtcttgaacccctggtgtcaagcaatccttccacttcaacctcccaaagtgctgggattacaggcgtgagccaccgcgcccagcgcaatgattttactttttacaaataagagtatgaacatttacatggcctggaaaataaacaaaaagcaagtaactgctaatctaagcagatgctgatatcttcctcagcacgtaggttgtacactgttggcttgaccctgcaatcctttctgaaaatttaaagggtagtagatgtgaaaagctttgctaagaatttcccaggaacaaagtaaatataatctcacagaatgtgaaaatgttgatagtatttgtgctacttactgatacattttcaaatgtgctgacgttaatcattctcaaatagttttttttttcttcttctttttttttttttgggacggagtcttaatctgtcatccaggctggcgtgcaatggcatgatctcagctcactgcaacctccacctcccaggttcaagcagttctcgtgtcttggcctcctgagtagctgggattacagacacgcgccaccatgcctggctaatttttgtacttttagtagagacggggtttcaccatgttgcccaggctggtcttgaactactgtcctcaggtgatccacccacctcggcctcccaaagtgctgggattacaggtgtaagccaccacacctggcctcaagtaggttttaacagtgctttttgctcttaaaatcctaagtgaggtccaaatgccacgtttc

SEQ ID NO: 123530 - DNA, 1043 bp, Homo sapiens
aaagcagatgccagttggacttcctgctcttccaactcctggctgtgaaacctgaagcacacaatttaatttctccgggcctactcctccccctcctgccaatggtaaaatgagaataatactatctatcccatggggttattgtaaagattattatgtaaagtgcattgaacagtgcctggtacagagtaagaattctaatgtttcctaaatagtcaaaatttaagtcaaaatgggggaaatgtgtataaattcctaaaactaagcattttgcaaatatactgtttcttaagagataaactccagagaaattggccttcgtgtagtcctttaaataaaaataattaattcagaaaacaggcccagtgtggtggttcacacctataatcccagcactttgagaggccaaggcaggaggatcgcttgagctcaggagttcaacactagcctgggcaacacagcgagaccttgtctcaaaaaaagaaaaagaaaaaaaattaattcagaaaacaaatttgatggtgagtaactaacctatggttcccagggtaccattcgattcatgcaattcattaggcatgaaacatcctagtgctgaactactgcttacaccctttctacaaaattgtactaaatctgagtatgagatatttatctggaatttggtgtgaatattccgaaagtttcttccttctttctttcttttttttttttgacagaatcttgctctgtcgactaggatggagtgcagaggcacagtcatagctcactgcagcctcgaattcctgggctgaagtcatccttctaccccagcgtccccagcctcctgagtagctaggactacaggtgcaccactgcgcctggctaatttttttattttttgtagagacaaggtctcgctatgttaaccaggctggtttcttcattcttaatggagattcaaagtatttgtgaaaactggggcactcggttgctagttacaactggaataaattttgtctttcagccccaaagccttaatgctttgcgccaagcaatccagc

SEQ ID NO: 123531 - DNA, 1453 bp, Homo sapiens
cagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtgggcggctgcctggacctgggctggcgcgtcgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccaga

SEQ ID NO: 123532 - DNA, 1903 bp, Homo sapiens
tgctagttttagttaccagttattcactaagtgcccttatctgaacagacattacactggttgaattatcacttgtattaggtcaaatggagagttaaacaagcttttgattactcaggcttaacgtttagatgcactaaagcagaagtcttggttttatctatggttcatttctgtaaaatggaaggagtctttatcttctattcaatcttttgtaatctttattttttccgttagatccagagatagactggaaatcttttacagtctttatatgtaagatccaggcgggggcagggggaatggcttggtctgttatctgccagggtttaattttgagacatggccgtttcacaactgcagggtgcgggaagattagatgacctgaatgctggtggtaagtaaagcctcacacttcacattattccttaattgtctgtttttaaaaatttgtcttaaaaaaatattaaggtggcaacatattcaggtggcaacagagggtggggtgaccagtgacaaactgacttccatgtctctggctaatcttgatttctggagccaggctccagactaagtctggacaatcaattaattagcctttctatatgtattgcctgatgaatgatttcaatgctggacattgaacaatggtctgttgcaacagggtgaggccattgtctctggcaggtggggagatgggggctcttgttagctccatttgattacaagagccttgaatcaccaaaacataaagatgtactcgaatagaagagtccgttgtctgactggtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaagaaacaaacaaacaaacaaacaaaaccagacaattgaggcggccagctgcatttcataattcctcccataagcttcctcctatttgccacttgtttagcaatggaaatggagaacgaagatggcctcaaagtgactacatcaccagtgttacaaaaatgggccagaatttaaggcaagaattatatgtttcttaatagagggatgtttctctgtgtgtggctacttgtattcctgtggatttttaccagattataagagctgctaatttctgatcagaacagagaccaaaaattggagatatggatgtggggatgattcttttgggtaccgatagactgcaggaatcgcagggcttcctttaaatccattacagcttataggctagtggatgaataagataagtggagattttctcttgaaatatttccttctatgaagaaaaggccttgaaatgtgcatcctctttgggttgactaatttctatgcctttacagctttaagctgacattataagattattctagtttggatcttgtaagataattaacaaaatggaaataaaatgttttgtttttaaaaatgctaataaattatttattttcctttgtcttagttagttttaatacatattcagtgcttaaagaacaccagtgcaggaaaactcaaactaaatggcatcatcccccatctctataattctatatgcagtagccattcatgcgaagttagaaattagaatttatagcactaagcattctaagaaaaattaagccagtacgttta

SEQ ID NO: 123533 - DNA, 1057 bp, Homo sapiens
ggaaaccctgtagtttctctctgcctaatcttaatcccagttgtagtagcatgtcagtttcatgtttgatttcaaaacgaaataaaccaaaatttaagaaggagagattactgcagtttattggctgaccatctatttgttatatgcaaatactgcaaactgggagtattgaaggattaaatttttcctaattcccaaacctggtggtgctattgaatcacctagagagcttttcaaagacacccctacacctcatcctggatttattgaattagaatcccaggcaatctcagggtctgggattctgtgatttttttttttttttttgagagacagggtctcactgtgtttcccaggctagtcttgaactcccggactcaggccatcctttggcctcagcctcctgagtaactgagactaccagctcctgccactgtgctgggattctgtagtcttaaaatgctcatcagatattctaatgtgtggggtgtgggctccattaccttaagggaggggaaggagtaggcgtaagagctgaataagggccagggagaggttcaggtctaggtgacactgggtgatagcatgtgcagatttcactgagattggaacttgtgtgggtgagagggacggtttcacatgatgaaagagtagcattttccttcacacatctggaggataaaataaaggaaaatatttcttccacataatttcattcctttgtttgactatattaaaaagtgggttgctggccgggcatggtggctcacgcctgtaatcccagcactttgggaggccgaggcgggcggatcacgaggtcagcagttcaagaccagcctggccaacatggtgaaaccccatctctattaaaaatacaaaaattagccagtatggtggtgtgtacctgtaatcccagctactcgggaggctgaggcaggagaatcgcttgaacctaggaggtggaggttgcagtgagccgagaccgcatcattgcactccagcctgggcgacagagcaagactctgtctcaaaaaaaaaaaagtggattgctaacgga

SEQ ID NO: 123534 - DNA, 2559 bp, Homo sapiens
gcacctaaaaaatgaaagagcctggtcattgactgtattccttccatttgtaggcaaagaaatgaggttgcttggggaatgcgtgtctttccctccagagaagacattttcgctttgtaatttttccatccccagtgtctgccctttggtttgttgttcagaaaacaatttatgatttatttttctttgtgtctgagcctatgatttttttattgaattgagccattacaggccctgggttttacctgccacaatgatgaatttctattgtcactccctgatattgaccacttttagtgaagacatgcttcattggctcctagttttcttcactctgtaaagtatattttgttgtgatacgtaagacaagattgttgatgcatttcacagtttttaacctctttatgttttcagttcttggtgataatttttcacaaagttataggaaattactcaaagaatatgtctttagaaactttcgtttgaaattgtttttcatttggatacatatgtaaaagtcttttgttcgttttaatttttttttcttttaaaataaaaagagacaggtcttgctgtgttgcccaggctggtctcgaattcttgggctgaaaggatagtcccacctgggcctcctgaaattaaaattacaggcatgagccactgcacccggccaaaacagtcttattcaacatcaataatatattgaatcctatagaaacttcaaccttaggtggcctatctactttgaacttacacttgatatgcactgcagtacaaactgggagggagagggggaataggattgtagtctacaagagattgctaagaattagccaattttgctatgatgatttttttcacaaatgacttttttttttgaggcagagtcctgctctgttacccaggctggagagtgcagtggtgctcactgtgacctctgcctcctgggttcaaacaattctcttgcctcagcctcttgagtagctggaattacaggtgtgagccaccacacctggctaatttttttgtatttttagtagagacggggttttaccatgttggcctggctggtctccaactcctgacctcaggtaatctgcctccctgggcctcccaaagtgctgggactacaggtgtgaaccactgtgcccggccagaaatgacgtatttatccaatacttagacatgagttcctgattcctatattgttaacctaaatatttaaatggaaatttttgttcttgttctgctctgttttacatgaaataagctattgaaaagcagtggaacatgtcactacaaaagtttactaaattagtcttgaccattacaatctttgtattccactgacaaaagcagtggaataaaatttaaacaaaaaatagttgaccttaatgtgggcaaaaacccagttgattggttttatagctgatttattttctttgtaaaaccttcaggaactaaagtttagtctgaactcagtttgatggcagttttagattagtcttttttgtttgagacggagtttcactctgttgcccaggctggagtgcagttgtgtgatctctgcttactgcaacctccgcctcccaggttcaagagattctcctgcctcagtcttgcaagtagctgggattacaggcatgcgccaccacactcggctaattttgtatttttagtagagaccgggtttcgccaagttggtcagactgatgtcgaactcttgatccacccacctcggccttccaaagtgctgggatcaaaggtgtgaaccactgcgcctggccttagatcagtcttcattttgttgataatacagaaagctcatttagccttgattaagacaacgatcggttattcgtttgatattcgttaaagacttactgaggtttttgaatttttgtcctaaactgagaatctggtgactgaagagggcttacaattttatcttgaatcgcaacaatgacagagatttcaagtcacttctggaactgtgcctgataaacaatctctgcatgacagggaggaatgcaaagaatgcttaagtattcagggaagtaggtcatgttaaagtattacatttgtcagagaaagtttctcaagcagtccctgtgatcttcagaacccagcttgttcttcgcccagaatgctttagttgtaggcaaatttgggggctgaattaacttcccagccgctaggagggctggactgaaagtcacagattcagcacatgtgcctgcacccttgtcaacaaaaatgaagttacagttataggcaggtgactggaaaaacagtagatgggattgataaatgtttttgttttttttttgagacggagtttcgctcttgttgcccaggctggagtgcagtggcacgatctcggctcacggcaacctctgcctcccgggttcaagcagttctcctgcctcagcctcctgagtagctgggattacaggcatgcaccaccacgccggctgattttgtatttttagtagagacgaggcttctccatgttgagggtggtctcgaactcctgacatcaggtgatccacctgcctc

SEQ ID NO: 123535 - DNA, 1227 bp, Homo sapiens
cactgcacccagcctagctcccacttacaagtgataacatgcagtatttgtttttctgttcctggcttaattcgcataggataatggcctccagctgcatccatgttgctgcaaaggacatgattttattcttttttatggctgcatgtcacaacttttaaatttacagtatgtgggaagtgccttagattatcctgatgaaagatttcatatttttaatctccttattaagttacatctgtctagacttgctgatactttggggattgggtggaagagaaagaggagtagaaaatgaggataagtaaaatttttttgcattgagcacactttggatggatttcattgttcaaataattctgataatttgcattagatttagtttttattttttggtctccagtaacaactgtttgtagaactaatttctatggcacgtaattgcatgtggagctaaccctcctggggcaagccacttatgcctacaaactctcccttaaccatattttctggggccagagacaattggactactgtggagtgaaaagctgtagattattgtgtcctcaaactctctgccgctcctgcaatgaatactggaggtattgtaactgtatgtgaacttgaacgaagatcaggggaaggtcacacagagccttcttgaatggagttgcaaattcttcctctggcaaatacaagtaaagggaaatgtcacgagtttgttgctttttatggtcatgaagagggaaaaatccccaaagcttgtgattcctttgctgtgagctgaccagctggcttttttcagcattggagaagaacttgagaaggacactgatttattttttccttgagtctgatcactgacagtctcatagaaaagcaaataactatattctgagactgtaactaaactaaacttttaagaaggttgtttctttgtaaaacctaaaaatcaacatagggctattcttgtaagattacttttggccacataaagaggaagagctcattctactgattcctgcttcttaataaatatctactaaactatatgtattttattttattaatttatttatttgagacagggtcttgctctgttgcccaggctggagtgcagtggcactatcttggctcctgggttcaagtgatcctcctgcctcaacctcctgagtagctgggcttacaggtgtgtgctgctacaccagctaatttttgtatttttag

SEQ ID NO: 123536 - DNA, 1053 bp, Homo sapiens
ttttttttttttttgagaaaggaccttcctcttgttgcccaggctggagggacacaatcacacctcactgtaaccccaaagtctgggctcaagcgaccctcccacttcagccccccgagtagctaggactacagttgtaggccatcacgcccagctcttttctttttgaaaatattgtaatattagatactttacggaatactcacaatgccccattttggcaatcatatttcacaaacctttgacttttgactgagttgcagttagcttgaaacactcgcgttttgctttcacttagagaattaccatttcttatgtgtaattctaaagatatatacagttaacaaggtcatgtttaaatttaccagtaaacacattggcagcttctttccattctgcaggaagtggctgtgtttctgtgctttcatcctgttatttccttagggtaaacatctaggcttcatgcaaagtagaaggggcatgtgcgtggtgttcaggatgtggatttgaatccccaactcagccacttacattagataagtgacttaacttgcgagcctccctctacaaactggatgaaggttgctaaagaatatgtttttacaagttgtgctaattttaatgctactgagaacaaatgagtgctcagatttggccacgtcagtgatattggtagtgttactttgacaggtgaaggatggtgttttaagtttgccttgacttttgcatttctgtaacgtatgggaagagataactgtaattctgtaggtctatgtattggttcgctattttaatttcaggttatgagcagatttagtgcccactttatcttttgaggtcttcttatatgcttcagatctcatggttgatacttcacatttgcaagaatttctcctacacatagggaatagcctcccaaatcctaactcaacccattgtattttgatgatgctatatagaattttaagtcttggaattggggcattctatgtgaggctaggacccaatttcctgcggcttcattcttttctccacacacgtttgttttattta

SEQ ID NO: 123537 - DNA, 1132 bp, Homo sapiens
gtccccagaagcaataactggaaacagttttagaggacataacctaattggtataaaaacttttcactctcagaactatttttcccattgtcataggagtggataccaaataatgttttcctgtcttggcagtgattcacattactgagtttgctattgaactattttttccttgccaggaagtacacatcagagagctgcatttcactgtgtgtgtgtgtgtgtgtgtgtgtgtgtgtgtgtatctatttcaatctactgattaccaaagagcttataattcttaatggagagtttgtggaaaagatgaaaaaaggatttttttaaagaacaataaccagaaagtttgagacaattgagtattatagcaaagtcctttcttgcggtgacttctctggttgtaatgtcttgggttaaaaaaaaaaatcaatttcatgcaaaaaaggggggaggattatgtaaacaaaaacaaaaaaatttaaagtatcacagtctatcatttgggtgagttgtggaggggaaaagaagtcatttgtacagtttgatgaagaaataaatgtattttctagtttctaagataatctgtgtatgctctaaacttaaagcacatcatttcctgtaagtcagtatttggttcaaaagtgcaaaggctttatgattgatcatctacatctatcacatgattatcttctggaggtgataatttttttttttttttgagacggaattttgcgcttatcacccaggctggagtgaaatggcgcaatctccgttctctgcaaccttcgcctcctgagttcaagcgattcttctgcctcagcctcccaagtagctgagattacaggggcaccaccatgcctgggtaatttttttgtatttttagtagggacgaggtttcaccatgttggccaggctggtcttgaactcctggcctcaggtgatccacctgctttggcctcccaaagtgctgggattacagccatggaggtgataatttttttaaaagattaaggcaacagcaatttgagagtgagtcattgatgggacacttgtttagggaaagccctttttcctgcagaagcaaacttgcttcaggaatggcatcaggctgaaagcattttctttgcatttc

SEQ ID NO: 123538 - DNA, 2205 bp, Homo sapiens
tttcctccaagcagactgataaacactggctgtgctcaagcagcagcagggctggattcgcgtcacttactttggtatgcaggaggctgcttgtattccgtggcgcagggagctaagcacacacgtcagagaaagccatttcaatttatcattttaattttgctattaagcatccacggaccctaaatggattctccacaatggcatctgcaagtccattatcagctaaatgtttaatgagttttttaagtaaccgatggatgccacagtgtataggaaactttcttgagtttttttcacatataaggaggcatttctcgaagtcacttgggatggcttaacatagctcatccctgccagctgacttgtggcctctttcccttccttccatgtgcagtgccttctatcttgaatgctgcagccagcagaggttctggcagtggaaccctctgcctagtgggcttcagaaaggagcctgtgaggcagagacatttcaattgaaaagcagtttagaattcagcctccatttgctaattcccatagatgctcgtcagcaaacacaggacagttgtttgtggatttgaaatttgctactttttcattctgtatcttacattttggtgattgtgctacaaatatttggagttgaacataataggataatcactgttgattcttggctaaatcacattatcttaggccatctttgcaaatcaagtgcattctactgaaaaggagacaagcaattttgcttgttctttttctctttcagtcgaatggagcatggacttagaattgaagttgcaatggggtgggcaatacattctaactgggtttttagttaaaaatcagcaatcagtttaagcaatctggttcaaaggcagtatagctacaaatttgcagacagtgtgtagtacagttgtccttcagtatcttagacgaattggttccaggaccctcccacccctgttggtaccaaaatacaaggatgctcaagtcccacagtttgccctctggatccaggggttcccaacctcagattcaaccaaccaaggattgaaaagatagtttttgccggatgaggaactgcagatacggaaggctgactgtatttcatttcaacaggggtctcgattatcctcctcattgaatggtaatatgttacctgttttggcaaagtttggagtaaacttctgtctccacctccctgtattgcagctgtcagcatggtgaagagcctgcaaggcgtgttgatgtgtgctgcctagggctgcctaacacaaaccaaacaaacatcccttctcaggatgggagaagagctttttatgagaccttcttctgtcttcctcttgcccgtctctgcctttgcccccataagcaagtgacagttgtgtagtgtttagccactacgtatttctcatatctgtcttcatggtggagcttctgatactcctatcttagggacacacctttgattagaagaagtaatattagcctctaaaattttttgaactttaaaatcaagaccttacttgggataacgctggtttcctcctctgttgaaattgtttatctcttggactcagaaactatttagcctttctgtggcacacagtggatttcaaaacatttggtattatcagatttctaagcaaggatgtgatgtaattattttactaccaaatgaggattcttttgagagaagcagccacttaacgtgagagtaattgcttgaatatgaagtggtgtgtaggaattgagtgagaactgagatcttgacttgcacgtatgctgtagataaaacctactatgaatttgctggtgcagggccacagaaaaaactagtcatgagaattgccagaattgtcagaaatgtgttttgagatgatttatattcattattctaactcttcacaataacattttgcttattttgcaattggaatttgtggaggtccaagaagtcaagatggtaattaatttgcccaggacagctggtaggtgcatcagctcagagcagcgggtggtggggaacttgtcttagacattcacgatgcaggtcatgacactggactataaagctgtagctctaggggtctgtattctgtgctctgtaacttgacatgatctgggacccaaagttaaataactaatcaagagaagtcaggtgcttttttgttaaacacggaactccagtattcctct

SEQ ID NO: 123539 - DNA, 1028 bp, Homo sapiens
tgtgttaaaacatactgcatgcatccgtggtgtctttagttatggggaatgttagtagatgtgactcagagagggttccttgaggaactcattttagaaaatgcagtgatttcctccttagtggttcagaatgcacattaaagagtctttaaattctaagtaaatctgcttaactctgtctgcgtcagagtttcccaagctaacctggagcacagaacacttctgagataatgcgtggtatgttggtgttgatacacgcagtatactcatgctctcagagaccggtttgataaatgccgatctttgagaatttagaggcctaatttgtagacaacattcctgataaaatgagttcacctgtagtggccagtcctttggggtttccataagcaatgtgagatacattattttctaataagacatccaacaatttgaatattaatgttcaatggaattaattttgcatgctaaaagccaactgatgattttagtggatctctcttaacaatcattctttctcatgtctaaagatgagtttgggttatttctcctgaaattatggttaactaactttcatgaattttactgaaaatgatgagaaacagaaaaatctgggatttgtagacagtggcgagaaactctctgtctagtatttatacccctcaccaagcagcactcctgggccctcaagctctgctgctgtgcagaaaccgttccagccgccttccttaaatagcaagcactgccatttcaaacacaagataaaattaatattggcattctggaaattagcatttttgcactaggattaaattaaattagttaaacgaatgtgacagcatgacaaagctggtctaaccaagccaatcaggtattgaaagtggataaatgttgctgttgggtgaatagctcctactcggcagttggtgggatgatgtagcgtaggctgtaaaccccatcttggaataaagacctgcaggataaagtgcagtaggacacgtggggttcagacagctgggccctgtttt

SEQ ID NO: 123540 - DNA, 1064 bp, Homo sapiens
ttaaatgatgtttttatttggagacgagggtctctctatgttgtccaggctggcctcaaacttttgggctcaagcaatcctcctgcctcagtctcctaagtgctgggactacagcgcacgtcacagtgcccggctcagtaacatttctaaaagagtagacggaaatttgtgcctgtgtgctatagtcttcatgtttaaagagactcagtttggctccaactaaagataccttggattgggcaattcacagaggattataagaattttttcaataattttaggtacttggtagaaccctaaactctatagaacttcagagttctggttcctaaataagaggcacaattgaccgaagtttattgcattgaaattgaggtattaagatggcttttttatgttccctgtttagtttgccatatcatgaaactgtgtatgtcaacagtttctaggtttaagattcactgggttaccatgtagcccacgataatatgtgattcctgctttcctcccccaacttttcttcctgttactaatcaaatctaagtcctgtgtacatactcaatgatatttagttagaatactctgacatttggctgggcgcagtggctcatgcctgtaatcccagcactttgggaggctgaggcgggcggatcagctgagatcaggagttggagaccagcctggccaacacgaaatcccgtctctactaaaaatacaaaaattagctgggcgcagtggcaggcacctgtaatcccagctactcgggaggctgaggcagaagaatcacttgaacccaaaaggcggatgttgcagtgagccaagatcatgccattggactacctgggggacaagagcgaaaatccatctcaaaaataaaaataaaaaaaagaaatactctgacatttttgcagatgggctttgtggagacacactgcccccttctccattccctaccccctgcttttgtctttaggtttcatttaaaatgcccatctttcatattttggtaagagaagactttaagtggaaatgtaatctgagtattctgtttaataaatggactc

SEQ ID NO: 123541 - DNA, 2316 bp, Homo sapiens
gtaattatttgtttaaaagtctgccttctgacttgttcagtcaattatgcttaacctgcatctaatcacaaggaaacattatttattattttaaagtaaaaaagaggtttttaagtctgccttccatagtaatttgtaagctcaaagctctgggaaacacatctgattttttcatggttatatttgaaataggtctggaaaggtgaatgtatgtatctggtgttccaatgaatgaattaatgagtggatgaatggctgatgggcacacttacccagatacaaggccctatctgcttgtaaggtagctggatctttcagacaaatataagacttaactcttcattgtttttgaacttccttttctctgtatttcttctttcactggtttgtattctggaagttaatgccttgtttctgacttggtcatgaggactgaaattaagtttctatggctttgtcttttccatagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagagggtaagccgcccctccaggaactggaaggcacacagcacttgcaacaaactttggactcagcagaaaatactctgtcatactgcctggtggtggattggtgttaacagcaaaaacaatcaattggttacaaaaggaagtatttatctgaccatttggataccccctatacttagaccttgaagttatgtttcctttttcttatctggaacttgatgctttttaaattattgttgctttgtcccaactgcttgtctggagttgaatgtgaattcttgttggaaacagaagtcatggttgctttaaaagagtcattatctctccctctagagaggagcctgctatacttgtacaactctttctgataggcgcattgcaaggcacgtacccctctttgcttaaactatgatgtgctgcgtgttttatagctcttgagcctagagatcttcgaggaatggttattgaagagtgaccgtttggacacagtattgggatttgatttttacccatatagggggtgaggaaccgtatcttgaggtcagaattgagagcatgtggcccagtaagtctcttgtgaaaagcgaaaggctgcatgttgaagaaggaccttgagctcgttgttccatttaattataaataaagggataaccaataactgctatcaaatatatgtaaaatgatgattcggcatacggtaaattgattcgtgtaatatgaataagagagacaaatgaagggaaaagtcctttcacaggagattcaacatcgcctcacttagatgagattcttcaaacatgtggaacctgtttttcttcttgtttgatgcccccacagagctgcttcaagcagggagctgcttttgaagttggtgggaatacttatctgtatatagcaccacaggcacaatataaagttagaaatatacacagtctcacaggcggagtatttgcatgacctagtgtgagagtttcaaataattttcacccaaatgattggaatggacccaactcaaattcccaagtccaaagctttgtctttcccatgttaacttttgaatcaagtcaagcaccagcaacatgtgagcttactatgaccaagtctgtaaggttaagacaaggcaacttggtgactaccaaatgaattgtgcaagggatgagagctgcagggttcaggtggagcagtcacttgaggtgagaggggagattagggggaggctggatttagatgtgtgtaaacaaggaatgtcagcaaaagtgaggagaataataacagccaacactttatgtgcttttattatagggcccagagaggtgccttttgtgcgttatcacctttaatagttacagcaaccctatgaagtaggtgatattgttcccaagatgcaaatccagatcagcagattccaaaaccacttaaccactgtgctctcactgtgccgggcaggttcggaggctggtgtgttggaacagcctagcccctgcaaagagtttttattgaagggtgtagaatgaaagcccagaagggaaaaggggccagataacagggccctgaaagcagagtggagtttagaaagtatttagtggacaacgtgtgatcactgaactatgccaccaaaggggtgccggaggcttcttgtctgacttaggtgatctgtaggatgtataagaggagggagggatggggcagggacaca

SEQ ID NO: 123542 - DNA, 1077 bp, Homo sapiens
cacgtcagcctcccaaagtcttgggactacagaagtgagccaccacagccagccttaagtaatttctgttcacacctcttgtgtacccagagttgaggatatttacaccagcagcaatggagcaggaagcagctgggtgctctgaccttggcatttgccactctggggctagctgctttaaaactgtcagccagtgaccagatgaaccaggccttgttacactaatcagataacggtatagaggcggctcccggtgtgtgcacgtggaccgccactgtgacaccagctgtgatcacaccccccacccccggggaaaaatgagaaacaaaaaccctcaaaatgctgtcacttaaagcagaagtctttgaggggatgtatttcttaacgttttacaggattccacttttctacatctgagtattttcccccagatatagtaacaaatacaacactttagagaatttcatttttctaatggcgcttaatgtcatcgtctgcttttattaaatttgccatttgaacccaccagctcctggtgtacagttcctctgggaaacagaaaggccgaaagattaccgccagataatcccagccctccctaaagatcttgttaccttacagaaaatccattctgagttaaaagtcgttcttctttgctttgaacatttaataactttatctgtatagtaggcaccctaagacctgctctgagcctcttcaaagatgactcccccaccccatacctgtttcctctgcaagaggctgctttctctgcccagaaggaatatttttatgatttgattccttttctatttcagttttcaaattgtgacatcattggtatcttgttagaagtgcctgtcacccacattacagccctccactcctcctttccttttctctacaccagttgttaacatctggcatttgacatctgtctctcacccacactttggctaaaatataagaatcaagcccaggtgcggtgacttacaacggtaatcccagcactttgggaggccgaggagggcggatcacttgagcccaggagttcgagaccaatctgggaagcatagt

SEQ ID NO: 123543 - DNA, 1003 bp, Homo sapiens
agacagagtctccgaactctcccaggctgaagtacagtggtgcagtctcagctcactgcaacctctgcctcctgggttcaagcaattctcatgcctcaggctcctgagtagctggaattacaggcgtgcaccaccacgcccagctaatttttgtattttagtagagatggggttttgccatgttgaccatggctggtctcaaactcgtaacctcaagtcatccacccacttcagcctcccaagtgctgggattacaggcatgagccaccgcacccggcctctaatctgatcttaaaagccattttctatatttgaagttttaatttaattaaacaaaaagttcaaggggggaattttattcaaaaatatcttgaaacataatcctcttggtgtcaaagaataagataaatcccttcacaaatgtggccactaaacgtcatcctctcatccccccatatgtgttctgctgaatgactggcggtcaggactatgtaatagggattggttatagccagggatgggggaaagaagttggtaaatgccatagctgcttgccctaaagattttcagtcagccttggagatgttacctataaatctctatagttcggaggccactcaagtccactttcaaattgggtccatgttctggcccatttgagaaggagccaggcaagtcagcctgtaggcttgcccaagtaacagtctaagaattaggcccttttctgctgggcacagtggctcacgcctgtaatcccagcactttgggaggctgaggtgggtggatcacaaggtcaggagttcgagaccagcctgggcaacatagtgaaaccccgtcctactaaaaatacaaaaattagcccggcatggtggcatgcagctgtagtcccagctattcgggaggctgaggcaggagaatcgcttgaacccggtaggcgagggttgcaatgagccgagatcacaccattgcactccaccctgggcaacagagtgagactctgtct

SEQ ID NO: 123544 - DNA, 1056 bp, Homo sapiens
agaagtggcgagcaaaagggggaagaaccccttataaaaccaccagatctcatgagaactcactcactatcatgagaacagcatgagggtaactgcccccatgattaaatttcctcccactgagttcctcccattaaacatggggattatgggaactacaagtcaagatgagatttgggtggggacacagacaaaccatatcatatagaaaaggatgctttgataatgtctgaagatatattctctgggcttaaaattcaacaactgtttagcctgttaatcaagatttattcctgcatatcatgcttcgaattgttttcaaattgctctttacttcaagtatcagtatagcctgatatcaggtagttttcctccgacctctagtgttaaccagtgcatgcattagtcattcaggtgaaaagtgctatgtgctagattgaattaattgagtgaactggttgctttcatgtgtcttaacatggacgtgcaatatttagaccaaccgcaggcataaggtcattatccccctgtattaatttgctaaggttgtcatgacaaaatactcgactggtggttcaaacaacagaaatttattttctcacagttctggaggctggaggtccgagatcttggtgttgcaggtttggttcctcctgaggcctctctcttttgctcgcagacggccgccttctcactgtatcgtcacatggtctttcctctgtgcacatgcacattcctggtctcttggtgtgtccaaatttcctgttcttataatttttttgagacacggtatcgctctgtcacccaggctggagtgcagtggcgcgatctcggctcgctgcaacctccacctctgggtttcaagcaattctcctgcctcagcctcctgagtagctgggattacaggcttgcaccaccacacctggctaatttttgtatttttagtagagacggggttctactcttcaccatgttggccaggatggtctcgaactcctgacctcaagtgatcagcccgccttggcctctcaaagtgctgggattacaggcgtgagc

SEQ ID NO: 123545 - DNA, 1034 bp, Homo sapiens
aagaccccgtctctacaaaaaaataaaaataaaaaaattatctaggtgtggtgttgcatgcctgtagttccagctactccagaggctcaggcaggagaatcgcttgagcccaggaggttgaggttacaatgaatctcaccatttacactgtagcctgggtgacagagtgagaccctgtctctaagaaaagaaaagaaaaattcatgtacctcatttctgggaaatttttttacatatatctataccttttcatttggtctatttcatagagttgcctaggtaaagaaataaatatatgtggactcaaggagagaaataatatttattctacatcacttttattatttgagtttttaatgtttattttcccgttgctttttaaagtgattttaaaattctcttttagtgtttctgttgtatcataacaattcctttgaggaactattcttcagagtatttatcttggattttgaatagcaataaccatgtctatacaaacatgtccagttcaactggaccataaaactcaattagttgatatttatctatgtgcatagcatgcagcagagagcctgcccatcctgtagataacctgacagtgtcatttagattcagggtgtgtatagatagatagatacagacagatatctatctatacacaccctgaatctaaaagacaggtgtctgtctatctatctatctatctatctatctatctatctatctatctactatctataactatctagatatagatatatctctatatagatatatatatatagatatagatatatatatctatatagagatatatctcctcttttacagttatccaatttggagctgtatttcactcaactttaaattatcttggagcatttcaaaggaataacaggaggtgaggtcaccccactgattgccagggttgacttggctgatcgggctggctaggcgggtgtccccttcctccctcaccactccatgggcgtccctcccgaagctgcacacttggttgaagaggatgaccatcc

SEQ ID NO: 123546 - DNA, 1724 bp, Homo sapiens
ctctgcccatgctcgtctgtccctatggaccgccttcctttgtgccccaggtagggagtgtcccctcatcccttcagagaccagctccaaggctacctcagaggtgagccaaactagagctgcccactcccgccactgggcgtgtccaccacccactcccgccactgggcgtgtccaccacccactcctgccactgggtgtgtgcaccatccatgactgagctcccgaggccagggatagtatctcatttagatccctgggtgttttgcgtaataaatatggagcaacaacttggtaaatatttgttgagtgaaccattctgatttgggaaaacacgttttctatcatccatctatgtattatacagcaaaatgtttcctataattcttgctttgggtggtgatgtcttcctctaaaaatcctaatttaacaaaaacagagaatggaaatgataaaagaaagtctcctgcattggacagtgaccttaggtctcatctttactcctgcttttatcctaattgatgacttttctttgtaaatgcagacacacagaggctcgctgggcagctgggccgtgcaccctgtccttgatcattcttagaggtagagatcaaaggagacccattggctgagagagtctacaacttgccacatgatctattgctctgccttgtgattttaattgcctctttaagaatatcaaatcaggccggacgcagtggctcatgcctgtagtcccagcgctttgggaggccgaggcgggtggatcacctgaggtcaggagttcaagaccagcctggccaacacggtgaaaccccgtctccactaaaaatacaaaaattagccgagcatggtggcatgcgcctgtaatcccagctacttttgggaggctgaggcaggagaatcacttgaacccgggggtcagaggttgcaatgagccgagatcgcgtcattgcaccccagcctgggtgacaagagcgagactccatctcaaaaaaaaaaaaaatcaaatcagatgtgttagcgtcttcatgaatgtcataaaaagaaatgtttcagtgccaaaactgaacagcagtacagtgacctttgaaaatgttgtttagggtattaaatgtgtaactagtgacattttgtgtgtttttctttttcttcctatccagctcagtggaatagctgttgcttgtcccagtgttagaatttggactgatagaaaggagaggagctggagattcattctgctctgcaagggcagactcgatttcagaagtggcaccagatgatagccttgtgttgtccccaaccactggtgctgagaaatgatgcagaaccaagccctcagatcccagatcacccacggctcctgggacatctctggggaagggacttattaatgtagaccctgatgcaacatcccaagtcgtctttatccatgatttgcacagccaggacactctggggctgggattgggaggagaggaatggccaagttgccctgcccccttggctctgtggactccagaaggatggtcagtaccagcagcatttcacacacaccagcctcattattaaaattggagcaatttgtgaaatagagttgagacttctctagagaaaaaaggttgggaagcagctcagtggctgggtctgggagtcagcttccaggcaatatctcactgagtcaggacaaggcccatcattccctgttcccgccaggccgggta

SEQ ID NO: 123547 - DNA, 1125 bp, Homo sapiens
ctatttccttgaaatgacttaaaaagctgagatacagaagtattagtaaatcggtgccaggaatgaagtaaccgtttagatccaatgcgccggctccagcatcgaactcatgcccagcaccctttaaaccctcccgggactctgcagaacccgctgaccactcacagagcccagctcgggggagggctttaaggtgaagcacgtgaccccctgcttgtgcggcccgggcggggaagtttgcgctcccgaagtcctggagctcagcaagggaggggccagcgccagcccgcgtgtgggtggctgggtgggggcgtgggtgggggtccgcctataattatctggggaaatgcatccgcgctctgcttttcgctgcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacaggtaaggcacaagccaggtcgcttttgtcctccctggacggcaggcacggggcacgaaaaggggctttcttccgttgaatgagcgtttggtggggagcccgggaggtcagtggcgggaccgttattggcatttatttctctccgtgtactgagtttttcttcagaagaacattctcccttgggctcagcaagaatcagacaacctcagtgtttcatttttggctgagctggaatcttcttgactgtgcctatgggagacctttagtatattttgttcggggttgtacccttccccttagggagagagggatgtggagaggaacaacagcagccgactgaatagaaatatgtcagatttgtgtgaatttgaaaataagctgtgaaagcttaatctcttgccgtagtcatagacagaatacattcctcttctgggcaaattacaagtgtttgcattttgacttgtttactaggaactttgaataaaggtacacttggtggtttaggggactaacatttaagctctgctttaagtggtggttttaataaagccatagt

SEQ ID NO: 123548 - DNA, 1166 bp, Homo sapiens
tatgccattgtactgtggcctaacctgcgtattttctcttcctgtcatcaagaaaattaaattccgtttgtgaatttaactttataggaacaggacttctttattctttaaatatttgagatcattgctgccaaatctttttttttgtttgtttgttttttgtttgttttttgagatggagtcttgctctttcgccagactgaagtgcaatggtgtgatcttggcttactgcaacctccacctcctgggttcaagcgattctcctgcctcagcctcccgagtagctggggttacaggcacgtgccaccacgcccagataatttttgtatttttagtagagccggggtttcaccaagttggccaggatggtctcgatctcttgaccttgtgatctgcccgccttggtctcccaaagtgctaggattatagacgtgagccaccgcacctggcctacattttttttttttttttaatcaactgtagaatttctaggacttaaaattttctcaatgcaactgctcctgcaaagccatgcgctccagtggaatttacaagaatgtgaaagttcagcaatactaaaattatctctcacttcctatagattagcttgtttactttgagatttccttaaaattcgacccccaagttgacttggctaacctttctaccatttactcagcttgaaagtttatgccatatctcgaaactattaataaatagactgtacaaaatgaaaaaaatttaaaacacaaaaatctccattttttcccccagatcattaacttttctatgaatgaaatatgcaaatgtgtattgtagggagtcacagctggggtggtgcttctgagatcatgacttttttctgagtactttttgggtacaatatgatttttattatattcactattcaattagtcgcatactgagattcctatggtaaaaggaggtggtctaaagttttagcagtaattaaaggttaataaactgggagcacttgagggggcttgtaatagttggctcagataatcccaatggagtgataaatgaatggaaatagtgggaaggactaacttttaaggcaaaatcaggtaattggctctattgctttctaaatttacttttcttacaatgtgggtgtggaggatatggcaaaattttgcactttt

SEQ ID NO: 123549 - DNA, 1050 bp, Homo sapiens
actagcctgaccaacatggtgaaaccccgtctctactaaaaatacaaaaattagctggacgtggtagtgtgcacctgtgatcccagctactcgggaggctgaggcaggagaattgcttgaacctgggaggcagaggttgcagtgagtcaagattgtgccactgcactccagcctgggtgacagagcaagactccgtctcaaaaaaaaaaaaaaaaattaaattgacagtaaggtttaatgaaatcttaaaggtctttgcatctttgggattattcacttaaatactatagaaggttattgtagttatctttagtactatgttattttaggaggcctgtgtttaaattttacaattcattaacaggactgatggcattttgtaggaactacttaggaacaagtttgcatttctgaaagtaaggaaaagctgtcacttaatactattatccccctcccccctgccacacacacaacccagtttacacaaaccactaaaatgaatgcagtggaaattgaattatgaaatgattgcttattcacattacatactgttgccattcttggggtctctttctctcacatctcatttgcaataagttagctttgagacaagaaataagtgatgtgacacgatgatcatccccttccccactcaactgtaaatggcgtgccagcataaaaatgcctttttttttgagatgaagtctcactctgtcacccaggctggagtgcagtggcgcgatctcagctcactgcaacctccacctcccgggttcaagcagttctccctgcctcagcctcccaagcagctgggattacaggcacctgccaccacgccccgctaatgtttgtatttttagtagagacgaggtttcgccatgttggccaggctggtcttgaactcctgacctcaggtgatccacccgcctcagcctcccaaagtggtgtgagccaccacgcccggccaaaaaaatgctttttgaattaagcaagtatcttttcgcttttctctaacacccacattactgaaactgataatattgatacatt

SEQ ID NO: 123550 - DNA, 1050 bp, Homo sapiens
cttttgcctatatcaatttaggttaggttactcattttttttttttttccccgagatggagtcttgctctgttgcccaggatggagtgtagtggcgtgatctgggtttactgcaacctccgcctcccgggtttaagcgattctcccacctcagcttcctgagtagctgggactacaggcacccaccaccacgcccggctaatttttgtgtttagagactgggtttcaccatattggccaggctggtctcgaactcctgactccaggtgatccgtctaccttgcactcccaaagtgctgggattacaggcgtgagccgctgcacccggccataggttactcattctaagccagaatcctgcagaggtgatgttgtgtccttctcagggtattgcacgcggtgtccatctgtcccttgtaggctgatgttaaggtgttttccaatttctccactgtagaattgggcttttctccctccctttcaacaataagcatgtaaatatcctctcctctcctccatttagcactttagcacccattgattcttgctttatccagctttcactttgatggatgctcgggccgatcttttgaatcactatctgtgagtgggtgggtaggatttatgcactcttttcaaaacgatgcatgactgtaactgtgaataaactctgcctttcacactgaaatagaattcaaattgctgtccacattagacataaagcagtttttccatctaagtgtaggagttgacatatcgaaatacttgttcttgccataagtggcgcttatgaactataaaaagttgtaatgatttatggaaaataagaatgtttatgctttaaaagtgtatgaaattgacttttctttcaaaaagacaaactgtgtattttgctcctttagtgccttcactctaagcactacccagccagcctttggccctcctgagataccacacacctatatgacgttggtcaagtcatatgaccgtttttaaaaagactgtttttaagagcagtttcaggttcacagcaaaattgagtggagagttc

SEQ ID NO: 123551 - DNA, 6033 bp, Homo sapiens
aatcaggaggctgaggtgggagaatcacttgaacctaggacagaggttgcagtgaaccgagatcgtgccactgtgctccagcctgggcgacagagtgagactctgtctcaaaaaaaaaaaaaaaaaaagttaattttcttgggctaggcactatagctcacacttgtaatcccactgctttgagaagctgagacaggagggtcacttgagcccagcagttggagagcagcctggacaacatagtgagatctcatctctacagaaaataaaaaacttagctggacatggtggcatgtgcctgtagtcccagctactcgggatgctgaggtgggaggattccttgagcctgggaggttgaggctgcagtgagccgagaccacaccactgccctccagccggggcaagagagtgaggccctgtcggagaaaaacaattttcttgtattgtaatcaccttttctcttctccccacccccccgcccctttttgttaatagttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcaggtaagcttccttgtcttctaagataatttttctcttttatgccaatagatggcaaatttgttacataaggaatcgggagcaaataattaatgccttcgtgtagaaccttcagttgaggaaaataactatcaactagattcaaagatctaggatagtttcatggtttttggtgattgaaatgccatttagtcttatcgatgttatgaaaagaacgacttcgttttacctcctaatgtgactgctttagaataaaataaaacggcatgtgtgtgtgcacatgtgcgtgtttgacccaaaggcataagaaatacattgtgttcactcaactatcttgttgagtttttttaaaaataactagtgctccaatggctgggcgtggtgcctcacgactccgtctcaaaaaaaaaaaacaaacaaaaaaaactagtgcccccaaatgggctaatattaaactgcctgaaatatagctgatgatagctctttcagaaaaaatgga

SEQ ID NO: 123552 - DNA, 2029 bp, Homo sapiens
gatctgcccgcctcggcctcctaaagtgctgggattacaggcatgagccaccgcacccagccctatctttgttttttgtttgtttgtttgtttttgagacagaatctcgctctgtcgccaggctggagtgcagtggcacaatctcagcttactgcaacctccacctcctgggttcaagcgattctcctgcctcagcctcccgaatagcagggactataggtgcatgccaccatgcccagcttatttttgtatttttagtggagacagggtttcaacatgttggccaggatggtctcgatctctttacctcatgatctgccctcctcagcttcacaaagtgctgggattacaggcatgaggcaccgcgcccggccccatctttgtttttttaatggagttaaactatggtattattaggtcactttgacaactatcctgttgttaataaatgagagagaaaaaggagattttatttacgctgattcttcctcctcctacagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatc

SEQ ID NO: 123553 - DNA, 1047 bp, Homo sapiens
tctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttctt

SEQ ID NO: 123554 - DNA, 1090 bp, Homo sapiens
aagctaacactgggtggtcaggctccgttacttccgagtccccactgcccaggagaatggatcgcccttcgtctagggcaaaaacatccgagttctggttttggcatgaatgtttaacaacctcattgggagtggagaatgttttgtcacacaagttgcatttgtagggtttgtttgtttgcaccagcatgttgtccatctgactcccttcctcaaatgtgcagagttccagagtctgtttgtccaccatggtgtaagtgtcgatgctctggttgaggcacacgtggcgggcagcctggttggccctgcaaaagcttttgtcacaagtgctgcacttgaaaggcttcccggtgtgtatgtacatgtgttccctccagtggcttttctggataaatttgcgtccacatattgtgcactcgtacttccgcctcttcacctccctctcctggtcggcctgctccaggttgtcaatgtcagcaatgtctgaggggggtggggtttccgactgctgctgcccatcgatgatgggagaatcagagatgtgctgcagctcactgtcacttatcatcccggcttcaggcacttccatggcatctttcccgaggtcagctgcattgctacagagagtcagggggacgcgactttctccctgttggctagatgtgaaaggtactcctgtgtggatctggaggtgttcacgtaagctgctccggagagtgaagcgccgtccacacaggtggcaggcatagtactttggaaagctcccattcctcttcatgatgcttggcttgacgtgggctattgtgagggacgcaggctgctcatcggaggaagatgcttccagattggtctcctccccgggaggagggggaggaacaggagtggaaacaagttctggagacagcgaggtctgcagggggtctgagggagtcatatttgtccgattcacctgggccagatttgaagtcagctgggagagctgtgaggcctcagggacctgctcctggcttatcctggaggtctgtggccgtggatctcgcccgagtttttcaggtgctgaagcaatcttggtggcttgtctcaactgatg

SEQ ID NO: 123555 - DNA, 1042 bp, Homo sapiens
tccttggcctcccaaagtgctgggattataggcgtgagccaccacgcctggccaagttaaattaaatattatgtattctatttttatacagaactccaggagttccttatcaaatgccaccatcaacatcagcactgctcctgggctttacagggatgccttctcacttgattgtcattcattctcattttacaggaaaggattgaggattagagggttaataacctgctcaatatcatgtagttggtaagaggtggagctggtatttgaaacaatgtttgtctaagtccaaagccaccacagcaagatcctttagagaatcaaaacaatcctgtatggtagataaagtggatttatttagtccgatttgacagatatggaaactgaggtcccaaaaagttaagtgatttatctaaggcacctaaagccgttgaagatgctattaattttataactttagattctactccttttatcatttcagaaacatcattcctgatcaagcagtaataatgaagaggttcccaagaactcttcccagaccatcggtagtaacaaattctaaagcatcattagaaattagtgagatctatatccacatatcacaaggtatatattatattccactgagtggatattctatagacaatgcatttcaaattcaaagacagcttccttgaatgcttttagaatttataattttcttttattatactttttgtattgtaatcttctttggcccttttagcaatcatgttcatttgattaacaaatattttcttttcttttctttttttgagacggagtcttgctctgtcacccaggctggactgcagtggtgcgatctcggctcactgcaagctccgcctcccgggttcacaccattctcctgcctcagcctccagagtagctgggactacaggtgtccgccaccacacccggctaatttctttttgtatttttagtagagacggggtttcaccatgttagccaggatggtcttgatctgctgaactcgtgatctgcccgcctcggcctccca

SEQ ID NO: 123556 - DNA, 1059 bp, Homo sapiens
agccagccacccaacctcagcgaacccttccagcagtaatctttcctggactcattatctaagccctatctctcattcctccagccccagtcccctgagtatccccctgactttcagcatttattcttgtctcctcctctaacaagaagctcgagggcatgaatttctccagtttccctcttttctatcttaaaacagctctatctttgctcagtttctttcttctcatctctcctgtcttgagaaaagggcatctcagtgtctctggaaaatgatctcccttcttccctcatgctgggagttcccactcctctatttttattctgttctttttatctgttttcatacaccccccaccctgcccccagcccatgtgggatcagcacatcctggacactgctgtctgcctgagttacggtgctgcttctccttcactttactatgaaagcccttaaaagggtaatcgaggtcctcgcctgcactctcctcatcccacactcttcctatcagtgcgcgctgtggtttcctcccctccttcattctgctgcagtcttttctcaaaggtcacccctcatcaaaaccactgcccttctctcagccttctagcatcctgtcctccagcatctgctgttgtttgcttccttcttaagtggttgtcatctgcatttttatagctgaatatctcttgtttttctgccctctaaacctgggcctttggtaaattttgtcttttgcacccttcctatgggtgtgtgtctttttcctagatctcgcctctgctggaaacttcagtttataactctggccttgactgttctgtctccagaactctattcccaaggcctcaggctgtgtgctgggcatttagagttgagtatctccttttgtgtctttgaggatgtactgaattaggccttctccgaagttcctcctgcctattttcttatcttcaagtatcccaagcttaactcagtccccaaatcatgttttcttcaaattacctttcacatttgtcacttcttttcctttctcacttccattacctcatcacccattctc

SEQ ID NO: 123557 - DNA, 3690 bp, Homo sapiens
cggagagactagtgcaaagaggctgcgagcggctcccgccgggggggagaggcggcgagagagcagtggcggcaagagccccctccgccccccccccagccgctcccctccccccgcccgcctccgcctcctgctgctctgccgccgccgccgccgcctgcagcactccactgccgctcccacccaggctccgcgctctgctccagccaaacttctgcagaccatgtgcagccgaggcgaggaaacttctctccacctattggggctggaggcctgagtcacaagccccttgtttacataaagtgtttaggtagcacaagtccttgagatgctcggggtagagatggagagccactgctcgtatccttctgccggcttctgcttgagatctcttggcctttacccttgtcccttgacttttcgtgtttgttttaatctttaagacttgaaatggagtggcctttagaaccggggagatactgtaaaccagcagtatctttgtgtcaccaatggtaactgaaagtcatgctgaagtacagattcctgtagcgtgcacagaggcagaggtgcttcctttaccttgcagatgagttgagcggcgtaagatgtttctgttagggttgaatttcatggttatttcagcaacgattttcgtttttgaagttttggcccccccaaaaatgaaagtctgcaacgcatgtttgttaagagaacagtttattctcctgttaggttttggtctttgaggtatggattccagagttggctattctgttagatttagaggtgtggaaaatcttttaacggggagatcctgaaacacggaaacatggcagggaagttagaatttcctgatggtcatttttaacattttaaagtttactttttggttgttgccatttttctagaatccgtgtcttttttggggaaatacagtcctttgaggactagaatttaatgatttctttacacatctaggattttttgagatttagaaaggatatggctttattcctaaggaagtggaggcagcagtttctaggatactctggtttcaaggcatgctaacttggttgtgatgtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtatttcaggatagggccaagggaagctgtcatttctctactaagtctcattgtggaaaagccacaaatgtccctagtacagtaataaggaaaaaaaggctgagcgtggtggctcacacctgtagtcccaggactttcggaaggattgcttgagcccaggagttgcagatcggccaggacaatgtaagaaaaccccatgtattagaaaaaaagaattagccaggcgtgatggtgtgggtctatagtctcagcttgggaggctgaggtggcaggatcgcatatagcccaggagttcgaggctgcagtgagccatgatcgcatcactgcaccctagtctgggcaacagagtctctaaaaaggaaaaaaaaaaaaaaagttaaatcgctgtttaattatgtgccaatttattttggtattttgagaatctggtaaattaggaattcaaaaatagttttaacactttttacttcaaagaaaatcacagtgcaagcaatctgagtggattcatcaaaagttatacatgaatattctgcagagtctggtgttgctgaaagttttgatttgtgttctgctgagacacaaccatgaaaatatgcacttgcttgtattccgaagaggatagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgatttaaaaaaaataatagtaggaaaaaataaatgcggtttgagtccaaagcagcatttttcactaattttatgaaggaagtccttttgagtaatgtcttaaattaggaaaatggcgtacttttacatgttagacattaaactctagggcagataaccatgccctgtgtgttgtgtatcaagcttagcatatacataggaaaagatgtattgtgagagtgtcttacatttcgttggtttggtcataaagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatgtactctgctatcttct

SEQ ID NO: 123558 - DNA, 1045 bp, Homo sapiens
cgcacctgtagtcgcaccactttgggaggccgaggtgggtggatcatttgaggtcaggaattcaagaccagcctggccaacatggtgaaactctatctctattaaaaatacaaaaaaaattagctgggtgtggttacgcatgcctgtaatcccagctactagggaggctgaggcaggagaatcgcttgaacctaggagactgaggttgcagtgagctgagatcgcaccactgcactctagcctgggcggcagagtgagactgtctcaaaaaaaaaaaaaaaagttttcttgtatacaaatttttctttgcatcttagattatttccttaggataaactcctagaaagggaattacctggaccaaaggatatgagaacatttgtaacactcttgatacaaattgtcaaaatgacctccagaaagatgatatggtgtctttttcaaaggaaaagttaaagtgctttttaagatttagaaggtattatctttttgcttttcacaggggacagtcaaaacttcacaggggggaaatcaagttaaattcagagctggatttagatgatgccattctagagaagtttgctttctccaatgctctatgcctttctggtaagttactactgcttatgggatagggtactacagttgtcatttcactgagggaagtttaaatagtcacgattttggtatattttcagaatactcaacaaagccttagcattccttttcctttttttccctccatcagaaaaaatatctagtataaaagatagtactgtgctgaagttactcattccttattaattgtattaataaagcttaacctctccaaaagtattttttagatgatgattatattagcctttgtttttttctcttctctctatgcgattgttattcttagatagtctctaatccagacagagaagcccagccttgtgtgactgggcacaggtcccagtgtagaaaaacatactctagtgttccataggaatgggacccagagtcacagtggctataagtttgttctgaaagatccacatcc

SEQ ID NO: 123559 - DNA, 1061 bp, Homo sapiens
gtgagcgtggggagcattattccatagaggcctttaaccatctgatgcttaaattaaccaccatctctttattccacaaaaatccaggcatagccctttattccttgcacatagtagagtctgcctaatgagagctaagacaaggtctcaaaaaatttccttattctgatttctgtggatcagaattgaaccaggtatgaaagagtctacatacgtgaagttatatagtattacaataatggctatttgtttggcaaaccatgtgagaaatcataaattttgaggaggtcaggttttatcaagaattttattttagctcttattgtaggaagttcacctaaggaccataatatcaaattagtaagtaccatcatattttgaaaaatcgcatcctgtatacattctagaagttacatggttttatatacgaccctaaagaatgtattccatctgtatcttagttgtttcttttatttttttaaatcagggaaggagctgctgtgttttggaatgtgaaagacaaaactgtaagtgtaaataaaaatgtgaaaatataaaaatttagttttgtgagaatgaattgttaattagcacatactgaaacattagaagggaaattaatagattatgcacaacttatttgctctgcattacatgatacttatcagtttcatcttccaaaatatattgtattttgggttaagatttcctgctttttcctttctctagacacacactaatttgtggagaatcagaaccatcctaactatactgcagacagaagtactgtagactttgcatgttgtactatacaaaatgtatgcagttaattggaagctggttgcattgagtgttcttttaagtcaagttgtctagaacttactactcatgggaaataattttttcaagatccaaatcaagatttgtttaatacaaccattttagaggcaaattggtaatctacattaaagctttatatttaacccagtaattttacacctagaaatttatccaaaggaaataatcataactattcgtgatgatttttgtacaaaaatgtt

SEQ ID NO: 123560 - DNA, 1054 bp, Homo sapiens
attcttaagactcaatcccatagaagatagttgaaatatcattgtgataatccaaacagaccgtttgtgtgattaggtgacaaaaacaagcatagttgacttagaaagacagagctatgtctagagccccttggtatgaaaatttgcctggaggtattgttggctgatgctgaaggctgccagctgtgtggtctgtgcttcacagaattgcaggcttcactgccctgggttgtttcagtcgattttattttgcttttggctgtgtaggcaaactctgtcctatgtaggatgtagtaattaacaatttagaaaaaaaaaaaaaatcacagttttggtctgtgtctgaattgcccatcacccagcctttaccagaaatttctgaagctttgaggatcctaattttatgttaattccgttaagacatacaaccttttgcaaattaatagtatattttttaattgatatattaacattggttgtaatttatattatggaatatatgcttatgataaatatcactatactaatatataaagcaacttcttatgatgaatattggtatattagtatatgttttaacaatacttaggccaggccccgtggctcatgcttgtaatgcactttgggaggccaaggcaggcagatggcttgagctgaggagttcacgaccagcctgggcaacatagtgagacctcatctctacaaaacataaacaaaaacttagccaggtgcggtggcacatgcctgtagtctaagctacttgggaggctgaggtgggtggggcgggggggggtcccttgagttcaggaggttgaggctgcattgagctgagatcatggcactgcgcttcagcctgggagacagagcaagaccctgtctcaaaaaaaacaaacaaacaaaaaaaaaactttttttttaaatagttgcaggtggctgcagtggtagcccctgtagtgattaaccttgaaatcacatatgttttgaagtggtcagtatctttatttctgtgtattttctattgccctactttttatactttaaaattcagcaggag

SEQ ID NO: 123561 - DNA, 1330 bp, Homo sapiens
gtactctggtaactcctgatacatttttatttgtatatccccgtgttcctactttcatatgtgactatgggaattagctaatttggaaggaattagcagttatctgctcataattagggtactacatccatttatccccacattccccagtaatttcagcttgtctgactttttttctaattggattagtctcattttgtttatgagtagatactttattgattttggatttttcagtttgcatggatcctcaggttctctgttattcctctacctttaaaccacgcatcagagctgtggaacagattgaggaagggcaaatggggtcaggccatttcatgagaaagagccaggagatacagaatggaggtgggaggaaggaatgaattaatatatacttctctagaatttcataccaggaatatacagaatgggaaagaattggggagctgagaggagtaaatcctaagaataaatgttgatttagtgactcataaacttgttttggccaactagaatctaacaactactgaacagttgtgttagccacagtcctgagcactttgtttattagcttatttaaactttacaacaaccccataaagtaggcattattgttattctgatactcttttaaaattgtaaccaacttctgtgcctaaaatcttaactcttatgccaatagctttcaaactttattgaccacatcttatagtgagaaatatatttaacattttacatacatagcgacctagagtagatacatagatacatgtaagtgacagaaaacttcataaaatagcatttcctgtgaataatgcactgtaatattttctatttagttttattaaaaaagctgttttgggccaactaaattggtatcagaactcactaatgtgttgtgacttacagtttgaaaaaacacagcattgagccatagtgcttaccatctgtattttatatagacacaagatgactttcctcatgtgtgcaaaggcaagatggggcatgagacaaagtacaaaccaaaccaagacacatgctcagatttacagacctttttgttaaatgttaaccagtgtaaaaatactgtaattcctttggggatttaaaggaatctgcctgtacaagagtagttacaaattaggaaatgacctcaaatactaatgttgctttgaaaaagagtcatggaaactcagggttggagagacttaaacattccatccagtcacccatgtgatgccttaatcatctctattttgcattcaatctgtgcttgagatactaccagttgagtgtggcttccctttcagaataatccattccatct

SEQ ID NO: 123562 - DNA, 1084 bp, Homo sapiens
atcgcttgaaccggggaggcggaggttgcagtgagctgaggtggcaccactgcactccagcctgagtgacagagcgagactcccatctcaaaaaaaaaaaaaaaaaaaagaatttactcaaagagaataaaaagaatccaggactgtagacaaacttctaaaatattttatagtttcttcaaaattaagtggttcaactggcatggcatagtactaattaaaggtgaactacagtagccaattggactagaatgaagcacagaatgcgagcttttgaagggattttggaagcagcaggttctacctcctaaatatcactgtgaatcatctttgtccttatcctgaagagaggtagtaaatacaaggtagtgggtaagagtgttgactttggaattgggaaagcctgggttttattttagttacatctctgcagcttcttaacggtgagcacttagcctctttaaacctcagtttcctaatcagtgaaatgggatcattatgaggtgaagccgagcacttagcatgtagaaagcgctcagagtgatgtcagagtctgtcttgtttcctcctacatatcatcaccaaaaatttgtttcatgaacatgcatttgaccgtgtgactctgagttaaaagctcagctttctccccacctgtagaaactttttaggatgactttatatatcctttggtgatctggccatcggctcttttggtccttacctcctgcagctcactcctacctccccgagatggggagatgaataggactccatgcctggggtgtttaacttgctgatccttctgccctttcaagactcagttcaaatgtcacctctgtgacaatgccacactcttcacatgctcctttctctggactagagcaatttgtgcatctcgttcattttcctctgctagactttgaattctgagatcattgattcatctatctctagcacctaacatattatttttaaaaaaagaattattgattactacggtctaacttttttttttttttgagacagagtctcattctgtcgcccaggctggagtgcagtggggcaatcctggctcactgcaacc

SEQ ID NO: 123563 - DNA, 1014 bp, Homo sapiens
agcggatatggaagcgagcgaaagccggaagcaggcaagggaccgggaggtcccagggcctagggagcggaagaggtcgcggcgacgcggctcacgtggtcagacagtcacgtggcccgagtttctcccgctaagtgggaccagagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagaggttagtgtattgccttttctttagcagctcgagtggtccggcttggaggtctgcgccctggctcctggccgcccggaacgtgtacagttacgggttacgccagtgcggctgtgaccctttgcctcttaccgtgatctttggtcagcttagctgggagtaaaaagcactcaattaatgaaccctttttttgagccagtgcaccgcggtaactgtagaaatcgataaaataattttgagtttgaggaattgaacggcatactcccaaagatgagcgccacttagctctcgaatcgtagcctagctgtaatcgattttcttaattggtgtaattgttctctaaaagttgaaatgtgcccgggaactgagtaactgccttgtatttcattttaaaaattcgatcgaatgcctactatgtgctgggcgctattgtcaggagatataataggaaaaaacacaaatccgtatcctcagggagcttccattctggaaggaagacacaaaaatctgccctttcctcttatttttttcctttagctttgtgtctcacgtattttactgatttacctcgttttgtctgtcactcccaatgcaaggttcaaaagattcaaaagataggatttttgtctattttattttcagctgtattgtcagcaactaggacaatacctggcacatgataagaactgagttcgtttgcagtatgaattaata

SEQ ID NO: 123564 - DNA, 1117 bp, Homo sapiens
acttctttcagagccagtttacatgcctcaaaatgaaaattagtcttcctgtatttttactcatttttgattaaaaaaaaagtttttatccaatttgatcacacacctcattctactgaaatcactccgagtgacttttggctgtttccaaaaataaattgactccaaaggatgaagatatgtgatcactgacaggaggtttaatgatgtgccataggttctgaagaaaattcctaaagaggaattccaaaagtgctctgagcaatggcagcgcccttggaataagggtgtagcttcccgaggtgactgactggctggaaggaggcagccatcatttggatgtttaaatactggtatgttatttaaaaaaacaaaacaaaacaaatcaagccgattacatcagtgttagattgtttttaccctaacatgaatgacccatggaaaaagtagctaatttggaagacccaataatctgaatgtcttttatattcaattcagtaaagattattatattagtatttatatctccttagttatgattttcttaggccaatataatatgatttaatctctcactggaaaacatgaaggtgtagccatgccacatatatcacctttggttaaagttgcccaaaaatacctaaaattagtgataaaaaattatcattcttctaaaacttacaatagtattgtctgatttatcttaagtactcattgtatttccatcatactctgtgtttcattctgttaatgattgctgcattgtattcaaatattctgtttatattctatacatttgttactggaactctgccacatcggtggttaaaaaatgtttgttgaactaaagcagttgtcttgaaatttatctttctccttcttgtgccctggaatccctgctaggtagataattatgagcatagtcactatcactatttaatatgtccagaaaaatacttgatttgggaacttttttgacaattaaaatgagtttgagagatttttgtgtaatttgattatttagtattaagtttttctagttaattagataaatgttatatctagtttctgttagcactgattattgagactgtatggtgctattttctttcaagaa

SEQ ID NO: 123565 - DNA, 2821 bp, Homo sapiens
aagtagcgtctttagatatcactttgttcagttttttaaattttacaaatgagagaaccaaatcccagagaggtgtcacgtcctaaggttatgcaattagtgaaagaaactggacagttctgcagggccaaggaggaaaaaataaacttttatttcttctcttgactctggattatatgggcaactttgagcctctcttcacacatccgatgatgttctaatatctgcaagctgcaaaaacttttattctgaataaacaatgtgagtgctgaaataattgaaaccagtttttttaagtccattacatactgatgaattaaaaatttcagttttatcttgttaatacagcatcatgtgaaataatttttgtgcattgttagagaaagtatagatttgatggtcatgtaaagagttttgtagatatttagtagttttttagcaatgtccccccatcccgctacataatggagttttgttggctattcagaagaagggtgaatattttgtactttttctttttcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaatctccttggttttattttctagtggggaaaagtcaagaaaggaagattaaaaatgagatttatataaaaagagacataatatatattctagatgttgccaaaagcagttattaaatatcatttataaaaggttattagtctatgctcttgctaagtattaaaaaagatttttgcaaaatgtttatataaagctgtacattttgaatctactgtgtttctttatccacatgtgtgcctattttaaagagtaagtttgtaaaatgcttccatattagaattatttgtaggcatttgacataatttagaacacagttgtatatttaggttgacttcatagccaccgtgtgagctccagcactggaagtagttcagcacccccactcccccatgaaaaagagcaaggaagcaaactagtgcgagaaaggtggcactgaggaagaggaagtcaggtcaaggtggaattttttttaatgcttagcaggaggaagggcctacctatgttttcaccagttaatttttaagttttaatgttagtttag

SEQ ID NO: 123566 - DNA, 1130 bp, Homo sapiens
gcctccctagtagctgggattacaggcacgtgccactatgcttggctaattttttgtatttttagtagagagaggtttcaccatgttggccaggctggtctcgaactcctgacttcaagtgatccacccacatcggcctcccaaagtgctgggattacaggcatgagccactgcgcctggcctaccagccaattctttaaagagctttggttcctaagactggtgaatggtgcttagaaaccaaaattgatgatttataaatgctcatttattgaatacttaccattagcccagtcattgtgctaatgatcagagaggttattcactttgctcaagttcacacagctattaaatggcaaagctaggatttgaacccatatcattacattattgtaccttcagcaataatcctctttccatatatattcacagttacatcctacatacaagtctgatgccagaaactatttattagtcagtggaacaacaataataaatagccatacaaatgtcctcagtgagtaattttaattcaattataactagtagttattaaattatcaagatttgaatattagggggagaggaggggttaaaaaagacttgactattaggaagaatttaatatttatttataaaaatgcatctctagagatcagtagtaggaaacgagtaaggaaatgtgttgtaatagcacattcaaaaaccagaacttattcctcttcttatataagtgtcttcacttgtaatgactgatgcaatgttgttcagactttggaaacacattcactttgggatgaagttcctgccaaaatcataaaaattgtaaaaaaaaaaattatatgggcaataaaaaaacttgaggtctttaataaagtactttattcataggattgtgcctcccgaagatttactacttaaaaataccatcaggtggttttactgacacattaacagactcaggaagagtcttcataatgctttctaaagctctatttttgaggtaggaaacttactttattagtgaggtccagaaggactgcagaagtagaagtagccacaggactagggtgtggtttctacataactcagcttttctgatctgcttgaagactctacttcagttcctt

SEQ ID NO: 123567 - DNA, 1030 bp, Homo sapiens
gaattgttatcagcaatgttatggtgttcggtggctttcaacgaaataaacacacctgacatccttagtaaagagaaagctttctgaaataagagtgagggacagactgggacatgatgctttgcatgaaataggtgttcagtaagtatttgtagagttggaagaagttagattaaacagggctattgtatggcacattgtcattagggagttagagagggcttctggaaaggtttggtcagttttgacttaccttgcaataaatttggactataataaccatttcactagtttgtaaaaggtactggcaaccaaagatggggaatgccactcaatctcacttgttctactttcaaaagcttgctttggtcacattgaaaggttccatttggtgaagtatagcatatcacagaaaacaatggagtttgggagttcgggaacaaatggttgttttgtgataatgaataactttgacatttcgtttgaagttaagttatgttgtttgaacttttctgtccctgaacaaggcatcgtatgccaagaacaggtaacagtttctggatcactggggactcattagtcatggatggttagtggtactacattgtggtcttccttcaatattgaaagctgtaagaagcttgtgacaaattcttaccttggccctcacacagtactggtagggctgggatgttattgcttttgtccaccaacttccaactgtagaagtctaggatgatcacagcagttagagatgatccatttagatagtctatattaagggaaagtatccttcatccatggtgttgaacattcgtaggattaaaatgaaagaagccaaaacctttctagatctttattggtatatcaacagaattagctgattaggtatgcagaaaaaacttgggacttgaagacaccattaaataaataactgtacataaccatacattaaataactgtaacaccattatataaataactaactataaataaagagctctacattcaaactgcttttcactgcatt

SEQ ID NO: 123568 - DNA, 1055 bp, Homo sapiens
aaatggtttaatagagcaagtgaccctttcaactgaattttttaagaatgaggatttagccagacaaagaagggcaggtgaggttgtgaagaggaactgagtggtactcttcagagctccagcccagttccttggacagaataaatgcttactaacttatagagctgaatattgaattaataaaataagggtaaactgttaagaatcagagaaataacttaaagaacactgatagctagtgttttttgaacaccatgtacccaggtgccttgccgaaaaccttaatgatcatcttgtttaaaccttacatttctcataagaggctggtactattgttattctcattttatgggacgtagaaactaagacttggagaggggaagtgacttgcccaaggtcatacaaccagtactggagaattagggattctagatctagaatttggactctggagcttaaggttttaacccacgacattatgcagagaaattgacaggatttttctgttgctgatcaatttacttggcagttagtttgttacttccttgtctttattttagttgtgacaatgctttcatcttagactgtgtcccgaggctgctgcttttatttttatgggaaatggctatttttatgatccttgctaaaagcatgtttaaacaattttccattaagtagggggatgtttttccttctaatatcagaagccaataaatgaaattctacaaagacttgctggtagcaaccttaggaatttctttgcatgtgaaacccatctgagaacttaaaatctgggtaaaattgtagtgtaatttggtgcaatcgtctctttgcacaaataacatcataaaatcatagtattgtcatctaggaggggccttagacatgatggaatcctaccttttatattttccaggtgaagaaatcaaagtctagaaaggtgaaggaacttcccccaaagtttcccagctggtagagacagaaccagggctaggtcctctattctgactcctgaccactacctcacacctaatagatggaggcatgcccagttc

SEQ ID NO: 123569 - DNA, 1638 bp, Homo sapiens
ttcatgctagtagaatgtgtatagagcagttattttcgttgatagaaaatgtttcaccacattaaggggtaaaaggagtagaatttgaacctaattacttacgtttagttgactgactaaatgtttatttcttgtcagtgcagtttccaacaacctcatttgatggtggggggtgacctgggcacactgtggaaggctggcagctgatcgccaggctggggtgtgcttggcatggccctttagcttccaggaaggtgcagaggcaaaaagcagcgtccctccgacactggagttatctgagtaatttatgtccattcttctctcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctccattccttttgcacatgggagaggcttcctaggagctgatatctgaggtcccttctcc

SEQ ID NO: 123570 - DNA, 2201 bp, Homo sapiens
taaaatgatcgggatatttctttaaaatgctacatttatttcagtgacagtatattgactgccattgctttcattagggataaccagtgctgtcaacttacggtgggtttgaatattttcccctgttattctctacccacactacctgtgatggtaaattttattagccaaaagcgcttttctgatcatggaattcgaatgtttctatttatgactcctgttctggctgaaaatgcatatgttttactttagaaggtaatagactcttgtcttgtgattgtatatggtcaattaaatagcccctacatgtcttttttaatgtaatgagaaatacatctattatgattcttttatatcaatgtaagcaacaacaatagcaaaatcacatgagatttgtactccctaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctgtatgtaacattgattttcttagttgtcattaaatctaaagagaataagtcgtgtgggattgggttgtattgatagtgggtgagagctcagactctggagctggagcacctgagttcaagtcctagctttgtcctacattgtcgctgtcaccttcggcaagctactcacttcacccttcttgcctcagcttcctcaaaagtgaaagtggtttagtagcagtaactaccctgtacaaaggattgttttgagcattagatgagttaatgtatacaaagagtttagaagaacatttggctcatatcttctatggaagataaataagaatcttttgatcgcagaaacatggggcagcactgctctagagaagcctctagaagaaataagagaagcctctagaagaaatacaataaaaggaagcaaagtgaacagcttcttaattgatgaggttaggtttaggtgaattttcattcttccattttcctaattgctaccataatcacatcttacttatagagatgttattagagtatttggaatcttctacgatcaaacctattttatatctgggctataaggacaagctaaggtcttagtaatttgctcttatttccgatccttgccagtgtgtaggtgttgtgtggtgggcatggtagtagattgcctttctttataatatttatttaatcttatattaattatttgaagtatgttttaatgttattcccattttaccaacaatgaaactgaggcttatgtaggataatttataagactttttaattttttcccactcaaaaaaaaaaaaccctgtgggatgcctgggactgttattcccattttatagatgagaaaactgaggcccagaggaattaagttccttatccaagcttaaacaggaagcacacagcgtaactgagatttcaacccagacagtcaaactctagagcagcactgtcccctgtatttctgtgatcagaagattcttatttatttgctcataagaagttaaaaattgtccccacatggtaggcaggtggcccagataagaagctagtctgaccactacagtgacagggttgccttgacttcccttctagctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggtaggaaagagcctctccagtttgccagcttaaaggaaagtcagagggaattaatattgccctggaaacatgacagctatccagaatcatttgcttccttctttcatgcggggaaattgtacctaagtgaacacttagatatgaatgtgattataaaatgcaaaatttggt

SEQ ID NO: 123571 - DNA, 1091 bp, Homo sapiens
tatgcttctctgtggccttaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaaggtttttgctatgcctcatctgtaatttagaggccagaggatgggactgggccatttgaatgcagtcttgagacacagtctcagtgattttgtaagaatgggatggcaggaggagtaaaccggggagtgatatagcaaaggattgcaggcttctcattgcttgctgagaaaatgactttacagaacactggaattcgctgtgccatctccatatgtttagaaggacttttaataaaaataattgttactactttcctcttgccttccagcattttattggccagcgtgaggagtttgagactgcgcgggacagcattctggtctggctcacagagatggatctgcagctcactaatattgaacatttttctgagtgtgatgttcaagctaaaataaagcaactcaaggtaatagattatttttcaagttaccaaagtgaagaaagcctgaaaatgaaaggatttgtggctcttttgtgaagaacatagcaaataacttttcttttgaaaaattagttctggactgcaaaaaaattcagaaaatgtaaaatatataaaaaatcagataaagagcactacccagaaataaccactattgcttatatctgggtagtgctcttatcttatttgatatcgatattgttgttgatatttttcaacagcttgattgattttcaatcagcttgattgccagggtgttagggatgttctgctgttgttgttttgttttttttttttttagagagagtctcactctgtcgcccaggctgaagtgcagtggcgcaatcttggctcactgcaacctccacttccctggttcaagcaattctcctgcctcagcctgccaaggagctgagattacaggcacataccaccaagtccggcaaat

SEQ ID NO: 123572 - DNA, 1050 bp, Homo sapiens
atgaggtatggagtatgttaactttacacactatttatatcacagccttattataaataatgatataattaaaacaatgacagtttgaatttgagctatatagattctattcctttaaacttctctttcacaacatgaatttaaggataaataaatgtagtgaagagatttagaaagaattagaagtactgtacacccaaagattgccatcatcctcattacctaccctgaaactaggaatatgaaacattaatttttattatgttaactagaaatgattatgtctatattcacatgaaccaggatcatgaaaaataaaatagcacatatccacatttggtgagaggtggtaatctgctcatgagtgttggttattatttccagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgtatgttcaggagctaccttgttttccccacatgcccttcttagactgcccaagtttagcttttggtctgtgtaagctttggtatgtctttctatgtgagacagttacccaaaaataactgtcttaggatcaaagagcctgcctgattttcagaacacaggtgcacatgcatcagactaagaggtctcctcccattgttttattttttaaaatgagttgttttcccatttttcctagtggaatttagtcaatgtgaaagattgaggctctttgtgttttctagggtggtcaatataagacatgaccatatggggaatagtgttctatctttaaaaaatcttctgttccagatgttgtccatttacattcattaactcctatgtaagcatctacacaatagtttcatctaagatattaatggtagaaagaagtctttctctcctaatttactggtatacttc

SEQ ID NO: 123573 - DNA, 1047 bp, Homo sapiens
ttttacttttttaaagttatgctaatttgccatgtgtaaaaagatgactttttttttgcatttgagtgtaggaagaagtacttctgcagcgtgcctcttctgaaagagataagctttttggattagtaaaaggtttttaggacatgaaactataatggcccaatttcagtgcaccccagagttccataatagaacaatttaaagtgactattttttaaatctttcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggtaatattgctcacagaaagccagctccaggaccgtgtttgccagctctgtccaaactctgggttttggttttcctaaagtagcagaggaaataatcaaatctatacattatctccttgtacttttaagtccacttcgttatcctcttttttttttttaaagtctagtttctggtgttttctagaataagcctttattttaaacattactctcttaatgatctcatccattcccatggcaatagatcattctcaaacatctgtctccagcctggcaaaagatatacaaagtggatatctgtatctaagtgatgcaaaccaagctaaacacttttctgacagagataaataattatgaggaaggaatatcttagatgttttgtcttaagatatttatctgagtgtgtgtgtgtgtgtgcgtgtgtgtgtgtgtgtgtgtgtttgcgcatatgtgagatagatatggatattgttatagctatagatagatttcactttctgggacctgactacctgtattcaaattgaaatttctcacattctagcagtataatcttgggtaattttcattacctcttagtgtctcagtttcctcatctataaaatggggataatgatcatacctatctcataaggtgttgtgaggattaaatgagttaatgcat

SEQ ID NO: 123574 - DNA, 1035 bp, Homo sapiens
caggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcaggtacaaaaaagtctcctcattctctttacccatcatttcaaaaacaattgccctgattttagttgaacatacttgtttgtatttattgaatattgaattaaaaaatttcagaagtgtgttatataaaagatatttagtattacttcatgggattttcctttgttttttaaagtgaacatactttatattcagagacaaaagaacaatgttgtattaagatatttttctaattccacacttaattatatgttgatgaaaaatatacagccttgtctataacagtccccttagaaggttcccagaaatttcttattttgatcttttcttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcaggtaaacctatgatcaagaaagagtgtctttccattttgtttatagggtcagtcctcttgtgtgagagttcttgattttcacaataatgtcttcttggagacagagttaaaaaaaatagatggctataaaacaataatattaaattagaagtctttttcataggcaagatgatcatagatatgaccaataatgccatacaattaaagataatttttgtgcttcccctcacctttaaaaaaagacttaaagaaacaaaaagtaagatatgtttcatgtgttcaacaaatatttagtgaatgcccagagtgtgccagggactcttccagctgttattttatttcagcagtgcaacaaaatgtcagttaagtaggtgaagatgttggaggaaag

SEQ ID NO: 123575 - DNA, 1050 bp, Homo sapiens
atgttataatttagttcaaattttaccctatctctattgcagaagcatctcagttagagaaacattggttatctttttttgagatcattttttatttttacttttagttgctagcttaaacaaaaagtgcaatatttataccataggaagagaagctgcaaaaacctctgacttatgtttatgacaattaacttcaatgattttatgtattctagcatgcctctacggttatatttaccctgctcatgttctcttcccctaatccggatattacactgtgatgtgtggtccgagaagttatcaactggggtataggcattgcattttgcaacatctggggagacatacaactgccttagatattagatgaaattgcagaatcttggggggaaaatccatttagatgtactggtcatgtttcattgaatttgaatgatctttatagaggtagaaagcagttctcataatctcagcatgattgtattgtctcagatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtagtaaactcctgaaagtttgtgttattcttgtgaatcattcagagcgtcagtgaaaatgtgtgaagtacctatgatgtgccaaactgtattgactcctgggaatctaaaagtaggaagaaggtctgaggttggctctagtggagttcatgtgccagccagaagatggacatgatactgaggggccaacttggtagactagaaagagaatggggccaggcgtagtggctcatgcctgcaatcccagcactttgggaggccaaaacgggcgaatcacttgaggccaggagctcgagaccagcctggccaacatggtgaaaccccatctctactaaaaatataaacattagctgggcatggtgacgtgcacctgtaatcccagctaccctgggattgaggtagcagggtacc

SEQ ID NO: 123576 - DNA, 1050 bp, Homo sapiens
ataaagttgatgaaatagtaattagattgttttagataaaaattatgccagaattataacttattaacctgaaaaatatagggacatctttttgtctggtaataataccatggagtattatctctctgagaccagccatgaacacattctagtgttaaaggttacttcatcattccttatgtaactaatctcttaaactcattgactcttcctcttggagtatccctgaaaacatacatgtgcttttgttttcatttaatatataactaaggtaaattgcaagattctttcaaaaacaatattaaacagtgaaataatctatcttaaactttgatggataagttacttaaaagtagaattctgaaaactctgtattggtttcacttttgcaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagagggtgagtgcccccagaacattccacagtgacaaggaattatggggagaggctgtgcagtctagagactttttacaaatagaatcgatgctcaaatctttggattcgttttggtgtgttgccagacaggaaatacgaggataaatttcacagttgctatgtgaacacaaaactaacatattttgtatttgattgatgtgactaagcagtgaatttcagatattggtttttttgttttgttttgttttgtttgagacggagtctcactctgtcgcacaggctggagtgcagtggcgcgatctcggctcactgcaagctccgcctcccaggttcacgccattctcctacttcagcctcccgagtagctgggactacaggcgcccgccaccacgcctggctaattttttgtatttttagtagagacggggtttcaccgtgttagccaggatggtttcgatctcctgacctcgtgatccgcccacct

SEQ ID NO: 123577 - DNA, 1016 bp, Homo sapiens
cgcagtataataggaggtagagctaacaggatttcctaatggtttagaggacggagagctagagaggacgctggaacaattcccatgttctgggttgaccgtctgggtgggaggtcatggcatttgctgtttgaaaagagatggaaagagaagggggcttcatgggggctggggtagaatagggatagggtgaacatcaggggtccatttctggacataatcagtttgaaatgttaagagtagaaatataaagtagttaattggtaattcatatgttagagaaagttctggaccagacataaaatacacacacacacacacacacacacccatgcattcacacacatatctgtgtcaaatagataaaatgatggaggagtggacgaataaataacctgaggtcacttgtcaactgtacaattaaaatatcttgattttagcagtgtcgttgatgtgatggtgcatgaatggccactttatttttcttaaatgctctctagttattaaatgaagaagtgctgagttacagcagcttgctggagaccatcgaagtcaaaggggctggcatgacagaacactatgtcacccagctagaactccaggatctacaggaacgatacagagccatccaagagagggccaaggtacggcaaagcactttccttgtagactcaccaaaaggggagtgtttggagctgtgctcctttaaagactcatttatgttcaagaatgacaggcttgggaaaacagaacaaaagcaaaatgaatttttaatattttaaaggaattactggcaaaatcaaaaaccttcaaatattgttagtattatgaaagctatgaaagtaagataattttcaactaaaaattcctagaaaggtaccaacttaaaaaaaattctggacaccttcaattgaagactcataaatgccttattatgtctgatgatgagagttttctaaggtgggaaataatcactgatagtattaatcattcttcatttagtcctcacaaagaaa

SEQ ID NO: 123578 - DNA, 1034 bp, Homo sapiens
ggtttgatagagttaagtgttgcttctctccctgcccagagctttggctccagaaaagacccactcaggggatctctctcagttttgcctttgaggctcccccagtgtctcgtgtccccccagccgctgactcttgagttgatagctagttccatgtttctgcatattggcctgggtttaaatgttccttgcttcctgaggctgcccttcagacctggactcagtgtccttaagccctgggcagcctgctcactcccaagcaagcttcttcctgatctcttgaccccttgcttactggagtggatggagcagacacaatgacattttagactcctaaggattctcaatgtggatttattgtcctttcaaatccctttcagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaaggtgagagctggatttcagattccatgtgttttctcacaggcttctttagaatgccacagtcagacaaaaatgggattacgtgtaccctagggcagtgcacataagcaaattacgtttggggcttttagtataatctctaaaggcttcttaaactggactttcatttgtgattactttattagtgagtgaaaatttttccttccaggaaaaccatgtagatccatgttttatgatacaaaccatttaaaatgtagcaccatgaaatatcttttaatgtcttcagcctgctcatcattaggaagtcttccttttttttttttttttatcacatccctttgtgttatcttttgtgcattcgtcataatgcttacattagtacagtactacatggaaagatttttttaaataaataaataatggcatgttcttaaaacttattggcagtagtattcaaacatgaagttttacagtcctttggtttatagctgcagcctcactcc

SEQ ID NO: 123579 - DNA, 1094 bp, Homo sapiens
agaccagcctggccaacatggtgaaaccctgtctctactaaaaatacaaaaattagctgggcgtggtggagggcacctgtaattccagctacccgggaggctgaggcagaattgcttgaatccgggaggcaaaggttgcagtgagccgagatcatgccactgcactccagcctgggtgacagagtgagactccatctcaaaaaaaaaaaaaaaggaaaaagaaaaaaaaaagagtactgtatatgtcaatttccatatgttattcacacatttcagcttccagttccatttcccacccacccatccttgtaatcttaataaagtaaaaggtatggtcaagtctgactttctttgtggtccctgttcccaactacagtatttatttcttcattgcttcccactgagaaaacgtttctggctcctttcccaggcaaagttccctgatctgtgcttttgaccctacattgagggctttgctcccaaatttgtgctccacccctggcattttcatttgcttgctctcctttggaagataggatactttccacagggaagtgcagcttggctttggctccttgggctcattacctgtcctcttaaagagccagtgcatctacataagaagcagaagaggatagcacccactctactttatcaaataagtcagaaacaatcatattagaaatcattctactataaagacacatgcacatgtatgtttactgcagcactgttcacaatagcaaagacttggaaccaacccaaatgcccatcagtgatagactggataaagaaaatgtggcacaaatacaccatggaatactatgcagccataaaaaggatgagtttcatgtcctttgcagggacatagatgaagctggaaaccatcattctcagcaaactaatacaggaacagaaaaccaaacaccgcatgttctcactcataagtgggagttaaacaatgagaacacatggacacagggaggggaacatcacacaacgggacctgtcaggggatgggggcttaggggaaggatagcattaagagaaatacctaatgtagatgacaggttgatgggtgcagcaaaccacca

SEQ ID NO: 123580 - DNA, 1016 bp, Homo sapiens
tttggtcaccacctgggaattctgggtaggtctagctctactttcagaatgccctctcacatcttccctggaacctcagttagagcttccactctcccacccagtgttaacacaatccttcctctttctatttgcccatcacttcatgtgtttggcaactgtgtccactgattttccttcttggaaaggcatattaacattggagctggcttccatgatgagacttgtgtggctttgacaattaagctgcacgtgaacagaatttctactgaatgagtattcttctggtcttcagagatattgatgaaatcttgcttgatatttagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggtaggtaataaactatcattaagtgcttccattcaaatggtgattgtagttctgttttgtggtgactataataaaaaatataacctctgctctcagttacccatatgaacaccagaccaacttatttatgacattgaacacagcaaagtaagcaacacgtgaagaactgggtgcaggtgttcagaaatcaaaaatgaataccttgaaaatagaaagcatgtgttgctgtagtgcctgctcagagtctatgcttgttcaaagtttttttttcttttttataaaagggtggagcctctggaagaactatgtgacttccacaaattttcaaacttgagtatccaatagtttttcatcacttaattatatttattggtcactgtgacttctttcatccagataatgtatattttttgaaaaagaagaagttgagaaaacattctatttccatgttttctatttttttatttttattttttgagatggaat

SEQ ID NO: 123581 - DNA, 1108 bp, Homo sapiens
aagcatcatttgacatcagggtgttccaaaaagaagaaagcaaccatgacctgaaagggagagaaactaacaatgagaactttgtgatgatcaatttccatgatgtgttagaaaatcctgtaatgtaatgcccggcatctgaataacatggtttggcaaaggagttgaggaaaggatgggtaggaatatagatgaaagaggttggctatcagttcataatttctgaggctggaaataggtataatctctctacttttgtaattatatgacgtttgggcaataaagggtgttcttttaaagaaataagtaatagaatgtagaaagaagtcacagtaatgattattcttatggaagacagaaaaaaatgaatgagcacaaatgtaggtaataggtagaaagacaaagtttatttcatacttgaagaagccaattttttaaacttaaagaaagaaaatcgttgagtataattgaagctaaaggcaatgttactgatttctagagattaataacttgccttaaatgatactgtctatgctggaaaattcaacagtcaaaattgcttctcaaaaaagatttattgtattacagatttatactccaactttctcccatcaacttttataagacgtttaagaggaagctacgttcttttgccttttgtaatcgcttctctgaaaactctgtcaccagtgtctatagcatcggaatctgtggccccacctttaaatgttctccttccttgacttggggggtactccattcttctggttctcctgcctttctggtttattaaacactggtgtctgcactcatcttccacaaagtcccttctcagaaacctgtactgactgtttcccgccctgaccataaagggcaatcctgatctacaatctggttcctgtcttcttgcaaatacatgtggggtattcccagaggggagggacttcacagctcttttccttataaatgaagacactgactcaaggctacatgggcatgtaaaactgttgctgcccatctccacgtggaaactaagtgccatatgactgagaggactgcagactctgttactcctgcatcctgacattgcgtcagtaaggcagcctcg

SEQ ID NO: 123582 - DNA, 1110 bp, Homo sapiens
tttttttttaacagaggcgcctacctttggtaaatagaaagcgggctcccataagacatgctaagaatgccaccattctaatgtattattaactgaaaagagtgactctgaatttatccacagcctagaaatcacagaaatggtttcttcagaggctgtatttttgttcagtactgtaaggaacattatgtaatattgcaaaaacagcttataaaagaaacagacgagagatgtgttggcaggggaaagaactaaatcgaagacttcaatcattcatgctttgcttttaaatccagagctagaaaaggaatcggatttccagaaaatgatcagccagagttagaagagcttgtggctgcattctatttaaggctgacatgtaacaggttaagtaagcatcagttctgttactattagttacattctataaattctccctgttttatttctaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtggtgagtcccccgtgctttgacagagaattcctatgagccatggatttagcaacacagttcagtttctttgatgttgttattttaattcttgaatttaaacataaagatagcgtgtgttaaatgggttagatacaagtttatgagcttttcagaattatctgaaatctaaacctatttctttggaatttgattatttaaaatcccctagttcagtttagtttaatgctttgctgcattaatcatatgggaccatcctgactggctttattgatttttaaaaaaagtttttgtattgcatacccacattttttattggaggtcaccatttcaactacattaaaatacttaaagattaccttcatgtcttttaaaattcaactatgactagtttagaaccattctcaagtgtccaaatgggaactatctattttttttagattgtgtccactgtgtctttttttaccgtaattccctgggcttcattgcctc

SEQ ID NO: 123583 - DNA, 1065 bp, Homo sapiens
aaagcaggtcaaaatgtgatcatagcaaaatatatcaggttagaaatagtttggccctaaggtttttctaccatgttaaaatgtcatatgtgggcaagcatatacaaacctgaacattttaatttataatagaaaagttttcacttgtcccaccaagtgtgtctcttgattttaggctggttttgctactaatttctctaatttgctaaattttagtatgagataaaaatattaattttaatgtattattttggtggtctaatatgtcttactttttcaatgagtgacacatttttaagtactgtatttattctgcaatcaagacacaaactaagctctagaaattaaggcatgaatctcctttcacctgacttcttccttgcttctatgtgagaaattggtgagggagtgtaaaatacatgtacatctttttagaaattagtttgtaaatgatgaaaaacacagcaaacaaatcaaagaagattcaaattaacctaaataaatgaatcaaacctgtggagttctatacagtctataattaatatttattaacatcacatttaatcttctcactgtgttacctatggggtattccctgcacttgtttgaaattttctaatcaaaagggtatttcaaaatatattgtaatatgattgatttactttagatggcaagcaaataccactttataatagtctgcatgcattcaaagtaaaataacagtagaaagcctaatctcttttgccattaaaggtttcaatttgtcatgctcagttttaagcttttaaaaaccaacatatccagaaaggcaaaaaatactaaaatcatttcatagcagtaattacattttcctttggatcatgtgcctttaaaacgtctgaatgcattgctgtgcaagtgtcatgtgtgtttaaaagatgcataattattagatgcagttccagcatagtgttttaagtacaagcacccagctcctattcaaggtaagagcctttgacaggcaccaagctgcctctgaatgtggcagcgggatcaaattgttgaatacattgactcatcggtgcg

SEQ ID NO: 123584 - DNA, 1033 bp, Homo sapiens
tcatctcctctgtgccctataatctgttaccctaccaccttttcactgtatcctgttctctttaccatctccttttgtgctctgcttaaatgcaatgtaaaagccccactcatccacatcctcgcttgccttgtccgtatttcactttgttttagtgtcctggtaaaaacacaatgccggtgaaagccagctctttgcctagttcatgcccacacacatgtagctgactgtggctggaaaaaaacacacccccaggcgcgatgactaacccaagtgggcccttaatggtgcctggcaatcagaaggcatttcccgactccattccctcttcatttctgggacaactatttcatatcttgtctcttcaaaccttccacacctcctccccatcctcactcttagctgatgacattacttcctttttctttgagaaaatagaagcaatcagaaaagaattgccaccagctcccacggccacatcaacccacctacgcaattgcatctgtgcccgaatacacgctcttcacttctgttactatgggtgaaccatctgtgctctgggccgaggccaacctctctatgtgtacattagatcccaccctctctccaaaaggtaattcctgtccttcctcccttctctatttttttctctttctttctttgttggagtttactcatccacatacaaatatgctgccattaactcatctttaaaagtctttttcttagccccacttcccctcccagctactgtccaattttcttccttccttttacagcaaagctctttgagagaattggctctttcttctttctaaattctcttctctcattctttctaaaatccattccaatcaagcttttatcttgccatctaccatgtgaagtttaccaggctttgcctcattcctcatccaatggccagttctcagtcttcttacatcacctgtcacaaacatttcacatagttgtccctttacccttgaaagactttctttaaggcatggtggctcatacttataatcccagcatg

SEQ ID NO: 123585 - DNA, 1036 bp, Homo sapiens
gatgtgtgaaaaactgtctgtcttcactgttcaggtctcaactggagttttcagagcaatttgagatgacaatgaagagtaataagaaaaccaaaaaatgtaaaatatgttttctttttttttttttttttgagatggagtctcactctgtcacccaggctggagtgcagtggtgcgatctcggctcactgcaagctccgcctcccaggttcatgccattctcctgcctcagcctcccaagtagctgggactacaggcgcccgccaccacgcccggctaatttttttgtattttttagtggagacggggtttcactgtgttagccaggatggtcttgatctcctaacctcatgatcctctcacctcggcctcccaaagtgctgggattacaggcgtgagccaccacacctggtcaatatgttttctaaatagacttagaaacatatataaagaagaaaaaggctaaggagcataaccaaaagcttacaagtagacatcacgccaatagttagaaatcagtgacttcataaaagaataagcaaaatagaggtaactactgtttcctaggtctctaaatgaaattaatttggcatttgatagaaatatgttagcttcttaaaaacaataagttcagggaacctcttttgttccttgccaggattggggcacaaacattggccaccagcgtgacttaactatagttattactagtaaagtaattgtttctaaaaagcaccacaaatggctaaagcaaagactccatgtgcaaatgctggcatggattgatgcaaatattttggagtcatctggggcttgctgggttttgataatattgctgtgtgaataagaaactctataagaaaacacattagacttacctcatatagcacagagaaaatccatccaaacttccatctggtttttatacgtgaagtccttatattacccagatggatttatatctaatttggtgtctgaggttttactgttttagagtctctgacattaatcatctctccagattagtaaactgagt

SEQ ID NO: 123586 - DNA, 1050 bp, Homo sapiens
gaaattttcccctgtgaaattcattaatcttatggatattagcatatattataaattttttgtgtatgtatgctaaaatggatgtggagaaaattctagagaagttgtaaaatgaagctctcaaaatgatcctagagatcatagtagattctttcataaaaagttaaaaaaattgatgttctttattttccataaagatatcttaaacgtcttatactgattgattcaaaggaagtagatatacaagtttgtaatctataccagttctcaatttttattttttgtcattgaacctgatgaatgaacttcaccagtgagacaaaaatcccataggtatatctcaaatcatttacaatgatttttgtgctagcttttactccacctctgtgatgtaaaactagtaaatttaaactttcaagagtaaagtatttgtgaaatgattttgcatctgacacaaatttaaataaaaaaaatgtacaaacatctgagctttttattaataacacacttcatgaaatcttggctgagaattattgagctagaggtctgaagggtactttattattatttgttttcatttgttaggaattattaaaaggatgtttttgatggtaggctatagaaattgaatgagatagacttaaccatgtaagtccattttgttgggacttagcaaacaactttgtagtggatgaaaaacattagcatgaataatttgggtcaattgtacatagattgacgtctctccttaatgctttatatgtcatcacccaaaagtagggaactgaatgctaataggctctgttttgctatttcttgcctttcctttgtttttctttaaaacgtattaccacagtcaggttctaaactgactacctacctctttattccctttgaacaaataatgctgattttgaaagatgatttatgtatatctattatcttctccctttgtttttcatgtcagtccatgcacagaggatcaccggttagtacaaattttagaattcttaactcctgatttttataggtaaaagggaacataagtta

SEQ ID NO: 123587 - DNA, 1052 bp, Homo sapiens
actcccaccgcccccccacacatgtaaatgcctttatttcagttagcctttgctgtgtaacaaactactccaaaactctgtggcttaagccaatcagaattcatgctttctcacagtatgtggatttgctggttagttcagttaaatatggatggtttcataaggacacatatataagacaatataccaggcagggggctgatctttaggaatacgatattgaggaaaatgctttcttcctacaaggaatttgtatcaagtatgtatggatgtgagagagaggaggtatcagacacatcagtctcgaagtcttaggcctcagtttgttgacttcacttgggttcacctgtggctgagttcatctgcagggctgactgagcttgaagatccaaggtgacctcattcacgtgcctggtggttagttctaggtaacaaatgagacatctgaattcttccacagatggaaacatcttctaatataaactgctttctttgcacagtggttttaggatggagatccaagacagctaaaacagaaacttcacgacctcttaaggcctagaatcagatgacataaagtaatttctgctgcattattaattaaagcaagtaccatacgagttcagattcaaggggaagggaaattgattctacccctggatgggaaggacaaagtcaccatacaaaagaaggatgcatagttggaccacaggattttgtggccataatttaaaatctgtcctctggtcactactgtttgttttctttctgcatggaaagtacattcatccattctcaaggtatcaaaagtctcctccagcctttggtttggcatcaagctctaagtcctgtgttgcatcgtttgcatcttgtccagatagagatgaggttcctcaggtgaaatttctctcaatccatagacccgttaactaaaaagagaagttacctgctccccacttcttcaacatgcagtgatgaggcaggagtggggtcacttcaatagatgcttctgtccaaggagtgagagaattgaacagagggagcaattgtgg

SEQ ID NO: 123588 - DNA, 1041 bp, Homo sapiens
atttaaaactcttggctttcctgatttcttgcttgttatgtggctgtagagggttaagcctggcttatttttcaaaaggtgcccttagtgctgggtgccctcccagggacccacctggatgggcctttgcagggtgtccctaccagcctcttttggatgcagggtgaagaggaaagaaagttaattacctagaagacttcaaaatgtgcctgcctttccttctcccttctaatgttcaccagaactgcaaagcgaggaagcctggacagtgagtttcaaaagagctcctctggcaagtctgacatcccacacatccctcctccccaacccttcctatccataatgtaggggcagcttgacctgctgagaggattcttttttcttctgcaagtctattcttgacattgcttgtcctagaacctagttagctactgatcaggactctcattggctgtccatctactcagggagtaaaagcacacacagaaaaaatccagaccaaagaacttttaatagaatagttcttgcctttctgtgtgacattgtatcactgatcatttcaatcttgaaaattgtcatctctatttagcccagcacggtgtaagcttcttcaaggcacagattatataagatacttctttatccttaatgcccagtacagaccctcaacaagaaagttattttaaattttcttgtgggttttgttgttgacatttatgttttattcactgctgcccaccttagtcctaagtctgatttgagacatctgtatctgatgaagcagctgggggtgagaagttaaagaacttgaatgtcagctagactgtgtaaatctctaggttcttcagacagacaagtgataaaggtgaagcagtcttgaaattttacggcatctatgtctaagataagtgtccagttaaatcctgctattattattcttaaacagaaaaacatttacaagcccaatgtaagagttggttctttgattcaaggtgactgtccctcttacttaaatcaatgtagtattcccaaaatcataat

SEQ ID NO: 123589 - DNA, 1050 bp, Homo sapiens
acatcagtgccctacatattgtctagcatagtgcatttcataatatggacacttcataagtatttgttaagtgcatataatataaatagttaatattatatttattttcaatgggggaagctgggaggccggaatagaggttatttttgacaagtcaagagacagatgatgggttgaacggtggatggggagagaggtggtaatattctagatatattttgaaggtaagactaaaacaatgtgttgatgaattcggtttggtgtataagagaaaaaaattaaacttggtcctctcacttttagttttgaaataaagaaaaactgttgtgtggaacagcattgaggaggaaaactgagaccttattttggatatgttacattttagatacctggtagatttccaggaaaggagttgagtatatgtatgtaactgtagagatcaatggaggagacacagcaggagaaaacatttggacgttgtcagcacagagatagtgtttaaagctgtgagattggttggcaccacccagggagcccggacagataagaagaaaagaggtttgtgaaatgggcactcaacactgagggaagtggggaatgaggagagtcccacatatgagactaagaagctgcagcctgtgtggtaggaagaaaaaagacaaaaggaaggtctgaaagccaaacaaagaatgagttcaaggagggagtgatcaactgtgttaatgttgttaattttctttacatgtacatgtttctacatgttcataatatataaaaagagtatgtgcattttatatataaatatcaggtctgagccggtgcgcgtgtgcctgcctatcatttaaaatcatttctggaaaaataaagaatggctttgtgcattgcccacaaggaggttcaagatgctcagaaattcactggttaggagcaattctttaagaacacgttaaatataattctataccttatgtagagcccatttagacataagtcctcagagtaagacgtctcttctttcaggccctccctcaatcagcctccctctcttgt

SEQ ID NO: 123590 - DNA, 1063 bp, Homo sapiens
atgtagataactttgcaagcttaatttagataacttaccaaaattatagaatattttctgattcatgttgatcagtaaatataaatcctacataataaaactattcttaaattttatgccataatgactaatgcaacatacagatttattcaaaaagcatttattgagcatctatcagataatgcatagataaagggcaatagttagggcagtagttatcgtatgtgtgacagtgatatttcatacatgaattggggaaggtgcaagggtgtccttggttttattaactaaagtacatgtaattcttgctgaaatttgttaatgggttttttttttctttttaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtg

SEQ ID NO: 123591 - DNA, 1060 bp, Homo sapiens
agtgctgggattacaggcatgagcctaaacagcttcttgagggacagtcaaatcagtaccacagattctactttttctgttaacatagtgagtttctaaagttgatttctaatagcagtgtgcctagagtactttgaaatttgtctattacttttaccagatagctaacatggtatcatatatacagtgggggctactatttgatgtttgcagatattgtgaaaaaatactgtacaaagcagtggttcttaagcctcaatgcactcagaattacttaatgaggagggagctttttaaaaatacagagccctgagcttcattttagaccagttaaaaccgccaggcaattgtaatgtggtcaggtttgagaagcactaataatataaaatatctttttgcactgctgatgtttttctactgtattcatcttagctctttgtgatgctttaattatttcatttatggtgatttacttttccagtgtgtctaaagtgagcacaacttggaagaagatcctagaagatgataagggggcattccagttgtacagtaaagcaatacaaagagttaccgtaagtgtttgcagatgatgtttttagttaaaaatgcactgttagtgctcttctagaaatagaaaagaaaagaggtaatctggaaacccttctttacagtcataaagtatttcagccttatactggaacttagaaaccacattcaaaaataaagaaatctcaactcaacatttatttcttggattcttcctagaaatagaatgtctaaagtaacaaagggaaaattactcatttctcagatagagtcgaccatttagtcaatcttagttgccagttgtgtgtatgtgtattttataacatctggaaaatttggaaaagctgttttactttttaggtattaagtaccatatagactgcatctaaagtgatttcccatagtatttggttcacagtttctgtctataagttaggcttgatatgtgtgagtatttaggttttgctttgtttaagtacgtgcaggtaaattgcatgtagggataagtctctta

SEQ ID NO: 123592 - DNA, 1050 bp, Homo sapiens
cagatgtttattatatagcccctttttccactattttttactcaatcagttatagacaacagtcaggtgttacagccaggcagatccaaaagcagtctgttctgaagtgccttctcaagaataatataatatgtatgtacttataagatttaagtaatattttcacatattattgtcatatcaataattaaacttgaataacatcacagctatgtaagcaagtacatgtagacaatacctaatgctgagagattgcaaagtaatctttgtatatcccaatttaagaagtagggatgtgtggaaattttgccattaagatgtaaatgttatgttctttttataggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggac

SEQ ID NO: 123593 - DNA, 1559 bp, Homo sapiens
ctcctgcagcgccagccccagcgcagtgacagccgccgggcgccctcgaccctcggatagtgagtgaggggagcggtcgcgaggggggcgcgcacgccaggaggggtgcacggggagggtcgcagcctgagaccctgacccgacgtccctcggagcctggacgcgcggccatgccacacgcccggcctcgggcggcggcagcggttcctgggtccgggaggagggcggctgggtgtcggggggaagccagaagagccagatgtgcaggggcgggatggcgggccgcggggtcccgccacccacgccgaccgtggactccagccccgggaggtgcgggtcgtggcatcccagggcgccctttttcctcctcggaagacccacctaccccaccctgcttgaataggcgccaaatgcccctcccctcccccaccccggggcccccggcggtgacagggctgcgagcgagaagcccccagggcctggccaggtgcctcaccttctccccctgcgccccttttctacatctgccccgcaccctcacagccaaaggcagtttccccgatttttcgcggtcccagccttgctggcgggcgcgggagatcgcgctcgcggttatctcccgcctcctccgcgtgtcccgcgccctgaggggcagccccaccgatccctcaggagttccagggtctccctccccactcccgccaaatggagagacacccccccaactcattggaccaaactcaactgggacatccaaacaaaaacgttactttttcccaattttttctccctttgcccgttaacccagtctcagggcctggagtggaaagggaagactttaaaaaaagcaatttttactacgaaccttgaatttgtccatagtattaagatgattttgtaagaatcgaagaattggtgactttttcccgataactcatgaagaattagatagtcctttatttcaaagcttgcagagaatggaatgcactcaaatgcttatttttatcctctttgttgctacctctaaataaaatctatatgcacttatttttacctgagaaataacccaaaatgaaaaaatttagcaattcggcattgtactattttgtaatgactctattattaaaaaagaactctagaaaaaaatacttaattttaattttaatagattaaatatatttctagaagatcctggatcgtcagtctaccatcgaaattctgaagcttgatggccttatgagggttttttttttttcttttttgataactctaattgtctttactaccttgctcctcagaaagaaatgactgcctgttggaattttttccccagtttacaggtttgaggagatgaaattaaaaatacatatatgttacttccaagtagttttcaaaggaggcttttgtaaaattttctcttaaagattactttatggtcacaagcattgggcctcttaaattcttaaggaatagccatgcctaacgttgaccacatggtcgttatctgtaggtattagagactggaacttaattatttaacagaagagttacaaagattt

SEQ ID NO: 123594 - DNA, 1047 bp, Homo sapiens
ctgggattacaggtgtgagccaccgcgcctggccggtatttaattttataactacagagccttttaagaattcctcaatatgggaaactcaccaccttgttaccacggaagatgactgcattaattcacagagattatatgtattcagcgactataggaatagcatctatgtgccaggctctattgtcatcatcactgtgtagtagacactgtattttgcagatcgggaaactaagttgcccgaggtcatagaacattgaagtggctgaggcaggattcagatattaatctgattttagagcacgtgttcttttttctatatcatgttcccatgtcatttgagattctaagtgtttaaaacctggttctcgcatttgattcatgttataaatcaagaacttaagtctccaaataagttaaatttgtaggtttaaattgccctgaatctagctgcatctcatctttttctctatatacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtatcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagctt

SEQ ID NO: 123595 - DNA, 1003 bp, Homo sapiens
atatgactaattttccactgaaatagatcctcggttaccagagaagtatatacttctaaggattgttattaaatatttgatttacttagaatccttacctgatactccgtgggataactgcaaggcgaggaagagggagggatccaaactcagggaatgtctgtattaattactatttatagaaggtgtggatggtcctttcaggtggagttctgagttttacacttaaaaagaaaattctcacaatgaagtaattatcatgggttctttatcagaaaatgctctaaattgttggttctgagcctttttgcaggggaggggaacatggcttcctttaaaaaaaaatgatatgaaagcattggacctcctactcagaaacacatatacagttttgcatataattgcaggggcttctttccattaagttcattcacatacttcgaggggatctgattctagatagttaggcaaagggactatatcgaaatctccagtatactgtagctcgaactaaacgtctttcacaggtatcaccacagtgattcacatgtgataaagagcatagggatagcaaatctcagttatctagaaaggaaacaagaatctcttactgtgactgatctcaaatgggcatagtccctattaactaatagtggttgaggccagtactggattgttaacgattttgttcttttaaattatgagaatatccttatgttaaactggatgatgtcttaggtaatacagaatatgaaacaaaaattgggggaaaaaatggatagcctaaaaaagttaagtgattttctctggtaataggatttttcatgtatcgtagtttctataagtagttgttacttttaaaacatggtggctagctgaggggaaacaatctgtattaaatgatttatgcttattgtttagtatgtatgccttcagtatagaaatactttgtgctaggccgggcgcggtggctcacgcctgtaatcccagcactttgggaggc

SEQ ID NO: 123596 - DNA, 1079 bp, Homo sapiens
tcagtctaaaaaatataattttataatgctaaaaaattaaggatttgtaaatgatacaatgttgcattgtctgtgtattagtattttcctaataagtagttattgtgagatcatctctgtgggtgaaataataacctatttaaatatggactggttgcctttataatgacttctgccttgtgtgactggtttgtggggtattaacagcaacaatcctatttaacaaaggtaattacttaacagaattgctgcttcataacccagttacattaaaatgaaagtatattgttatactgttcataatgagtatactttattctcacaaagcaaattctcagtctatatttttaagataacttagtgtaggagttctgttttgcctcatttcccttctactgaaaagtgatagcagatatctgacttgtttttcagaatgaagtgtgaatgctttgagaaggaactcttagtggttcctatgctaattttgggaaaaagtgctatttggctctgtaataggtttaatggagttcctttctttaggtcttagtttctttagatctaatttttgtgtgaagcataggtgagaaactaagcagttaagggagagagtaaagtagaataaatggcaagagccacatctagaaacctagtcacttatgtttaaccatcttggggtggaagttttcaggaaaagatgagagactgaggtccatgtatcatctaattcctctagcaaccataagagggagtcaacacagggagacatagaggtagaaggcccagagaatggtaggattcttactgtcagcattgcagagatgtcacagaatggttcttagttgttcatgaaacagtgcttttgatggtggctcctaggacaaagcattaccttgacctcagatcccagtgtgttgaggaattgagactcatgacttcttggccactcccatttccatttggctcatctttgcctccaaatatgtttgaaataaaacaaaacagacccttcccacagttctcacgctaccatttttttttcctgctgctaggctctttaaactcagaaaaatttgaaaaaa

SEQ ID NO: 123597 - DNA, 1027 bp, Homo sapiens
acagacaaactgttaagtattaatcccttgtctattttctccatttctctttaacttaaaatggtattttcagcagttcttgataactgaaaccttgaaacccattttttaagaccggtagtaaaggacagttaataaaaaggacaatttgtctgttgccaaagttcaatttctacagggcaagactgtggccaatagtagatcaagagctgcacagtgaatagttaaacatttactgaatgtctgttgtaagtagttttagtccaaatgtgtgtccatattttaccacctgtagaaaagaaagatgtaaactcaacctaatatttcgtaatgatcgctctaatatggtagcatttgggatgtttgtaaatatcacagaaacagatagaagagccagaattcatgttcagaaactcgtgattcatgcctgtagactccagatttgtcactctacggcaaaggcacaacggagaaaaaaatttctcaaagatgtttaatgaaatgaagtatacctgcgtcatgtgtactgccttctgtagaacactgtgtggaaatgtaataaaaataaactcaaggagtttattatttaagcaggggatgaaagctcttttgctagttgtgttatagtgccttaatatgtgtttgcacacacacatagaagctcaataaaggttgacagaatgagtatcaatttcctattttaaaaagagctgaatagaatttaccaaaaaattgtacattttatatatacaggaagttttacagaatattgtcagcagtgtatccccccccatccacttttcccatcatgactggaaatacatcaaattccagagaagaactttcttactcattcatgaatctcctctaaaatacttatctggcctatttgtatagtgacatagaggactgaggtttcccaggctatctcaaacctcagacacattcacagcactcacacgcaaatacctccaaaattatgcactgtctctgaattcctccccaaaattacactacgctaaaggct

SEQ ID NO: 123598 - DNA, 1002 bp, Homo sapiens
attactaggagtataacaaacatgtcaacagctatcgagttctataagcatgttattcaataacactttttatctactatctgtgcaatgaattgaagaaacaacattgaattaagatgagtttgaacataatcgtcaaacagatatggatttgaattatgtctctaccccttattagctatgtgactctgaaaacctgggttctgctctttttctgtaaatacataggatattttatctcacaactgattgaaatatcaaatgagtaatgtgtcatgtttcaataattctaagatacatatttttcacattccagaaatcagtacacattttacaatcaatgatatctttggttcaataagatgtggtatcctcttcaaagcttttatatgtgaagctggatggtaattatggtttagaatcttccaggtcactctgacaattttaagatgtttacctctcttcctctattgggaaaaagtagcttctactgactaatgataatgtggttttgtcttaaaacgtttaatagccattcttttgtggattgtctttaaaatttgtttcctgattttacccaaaagaaaagaaaagataagatacatttttaaagcattaacaacagaataatttgctcaatttatttcttctcaagaataggctggcatttggtttttcggggtctctctacctgtgtgtttgcctcagtttggtttacactttctcttgcctttggtttgatcatggaggacaagaatagacgaatatcctggcaacctcagcaactgcactttaacataatatggttgctaggagaaaagggtggtagcagcacttgagaggaagtgtggctctgctgtcctggaggagccggtgacagaagccaacagctcacaacagcatcctccaccccgccttctgctgaaggtcacggaaatataactatcgtatcagtggtaataattatggcatatattaaataaattatgaacacaaagggaa

SEQ ID NO: 123599 - DNA, 1007 bp, Homo sapiens
tatagaaatgttggaatgagaggtcaaaagaaggagattccaccctcttgccttctctcattcaaggaaatatatggctcatagcatctgaagttctgggcacaagggggagaagtgagcttattttttctcaggctggaaatctgacttccctccaggaatttcccaggaatgaatgcctgtttcatcttcatccctgtgccatttctgccatttgcctgccaaacttgtttcctagtattctgaggtacatttctgagaatttagagcataattaactgaagcagaagaattttgagatataccagaacatttagatcacatttaatggagatagaaaacctaaaggaatatgttcctcagatgcatattaggtgataagatggaatgcagcaattttattttgtctaaacttttgggaaaattatgtacggaggctgtataatgtgctcagccagaatgggaatgaaatgaatgaagagcagaagcagcctcaaataacaaaaaaggaggtggcactttttgggggacgggagaggatggatattttggagattgccccataactgacatgaactcagggtttccaatcatatcataggagaagcactatttcctgaaagcactcatttggagcaatctgagctccccttttacctgtgatttttttaaatgacatatacacaataacggatggctttgttttcaagaatggcactgaagcaagaaatgagaaattatcaagagctgttagggatttgattgctgctaagggaaaatgaaagaaaagaatctgaatgtattccaggaaaatatgtaatgatagctaatgcacctgttggtgttttatttgttttgaaatgatagatgtggagaagacgtagcaggtacccaaccaacacttgcaacgatttcaggtgaaacagagcaagtgatatttttacagctaagacttttaaatattattttttttaagttgtgtgtttgggtggagttaaaatttcatt

SEQ ID NO: 123600 - DNA, 1360 bp, Homo sapiens
atactctctcattctcccattccccattagctgatgagctagtctcaaatgtcattttggaaatacagactatcagaattgaaattcttcatcttccactacaggatctatccacttaactatatcagaacttacatatcctgccttcactcctgtagaaatggatgaggtgaaatattcatgctcccagggaagacccgttcttgatatcctattgtctctttcctccgcaaagacttcacacagcaattacctcctctctctccttcacctgctttccctgtctgctgggtcattatcaccacaccaatatgctctgggatttctcattttggtctcacatttccagtattccatttttcttcttcttcttcttctttttttttttttaagtagttagcatttaatgaaactccctccatgcggcttcaagccaccaggacacaggcccccccaacactcttaatcttctcctcagctcttctgctgaagaatttggcctgcacggtgacagcctgcttggggagctttccctttcccagaactttgtagtagccagatcgcaccacatcaatgatgggagcagccccagtcttgtttttagcagcattcacccgtgtctgttcactgaccaaagtccacaatttgtcaaggttgacagttgggcagaagctctggttcctctttaagtggtaatgcttcataccaactttcccaaagtagcctgggtggtatttgtcgaagttgatccggtggtgatgcagaccaccagcattaccgcggccgccggggtgcttccggtgcttgcctatgcggccgtggcggtggctcacgtggcccctaagtttccgggtcttcctcagtctggatggcatgttggcagcccagacgaaaaaaaaaactatcttcttcttcttgagcaatatttctagaaagacttgaataggagttaagacttttttcaactcctattcacactttaaaaatataaatcaatattcttttagtaacacaacgaatagaagtcaatttcaagaaaatcagaatgcagaggaacaagagaaaaactatcaataatttcaccactgcaacaagttcaaaatctgctatatgttcttcctttttaaactatttaatttataatttcatcaggtagtgtatatacataaaaattttaaaaaattagagatgaggtcttgctctgtcacccactctgcagtgcagtgatgcgatcatagctcactgcagcctccaactcctgggctcaagttatctttccacctcagcctcctgagtagctgggatgacaggcatgtaccaccacctgtggcttatttatttacttattttgagacagagt

SEQ ID NO: 123601 - DNA, 1208 bp, Homo sapiens
tggtacatgcctgtcatcccagctactcaggaggctgaggtggaaagataacttgagcccaggagttggaggctgcagtgagctatgatcgcatcactgcactgcagagtgggtgacagagcaagacctcatctctaattttttaaaatttttatgtatatacactacctgatgaaattataaattaaatagtttaaaaaggaagaacatatagcagattttgaacttgttgcagtggtgaaattattgatagtttttctcttgttcctctgcattctgattttcttgaaattgacttctattcgttgtgttactaaaagaatattgatttatatttttaaagtgtgaataggagttgaaaaaagtcttaactcctattcaagtctttctagaaatattgctcaagaagaagaagatagttttttttttcgtctgggctgccaacatgccatccagactgaggaagacccggaaacttaggggccacgtgagccaccgccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctccccaagcaggctgtcaccgtgcaggccaaattcttcagcagaagagctgaggagaagattaagagtgttgggggggcctgtgtcctggtggcttgaagccgcatggagggagtttcattaaatgctaactacttaaaaaaaaaaaaagaagaagaagaagaagaaaaatggaatactggaaatgtgagaccaaaatgagaaatcccagagcatattggtgtggtgataatgacccagcagacagggaaagcaggtgaaggagagagaggaggtaattgctgtgtgaagtctttgcggaggaaagagacaataggatatcaagaacgggtcttccctgggagcatgaatatttcacctcatccatttctacaggagtgaaggcaggatatgtaagttctgatatagttaagtg

SEQ ID NO: 123602 - DNA, 1018 bp, Homo sapiens
tcatatcttttctattaaatcccttccacttccttcaatgaaatcgtatatgaaaacaaagggaatcggagcattttgcccacctcctagttggctgaattatttttgcctcccattcccatcttgaagtggtattcctcaaactcgtttctatgtttcctgtggttttaaataaaggaataatgtagaatggtatctattttggacattctcatcgtgaaaaggaactcttacacaaatacaaagccaagagattgtgttgccattgttgaagctgaaaaggacagtcactggatgcctccccacccaaggccaaggctttggtaggtccaggaagtgaaaaggaaagagaagctatgggagagacaaagggaagtaaaaaatggttgttcggctcagcataacaatcacttttgtggggcttattggttgtgcataaatttcatccatttgggcacacacacagatgtgacacccagaccactcagacacttggctaacactgatgccgtcatcctgaatgttgtttctggaaggactttcatgaatagaatctatttcagattggccgtaagtctcgatttattgatccgcaccactggactggggtggggttgtgtccactttttccctgccccttccctgctttggctcttgtgattgtgtcctccgtgtgtcaggcagagccctgtgaaggtgtggatatgtggccatattttacctgcataatctgcagttcatatgattcagcctaatgggttgcaatgccctgaggacagagaccatactttttcttcctttgtctttttagcgaaattcaatcctgttctgcgcctgcgccacagttgcaggctgtactgtctgccctgtgcatctcacacacccccactgcactgtgcacctagtgatggccgcagatttgcttttactcatcttccagggcctaccctgttaattccatcacagttgcaggctgtactgtctgccctgtgcatctcacacacccccactgcactgt

SEQ ID NO: 123603 - DNA, 1054 bp, Homo sapiens
tttgctgatagccatcatcttcccattgcatccttacatggcagagagagagaaaggaagcaagcaagctctcctttcccttcttgtgagggcgctaatattcatgagggctccaccctcaggacctactcacttcccaaaggcccacttatggtattagctccgcctcctaataccattgctttggagattagggtttcaacagatgaattttgggaggacataaacatgcaatccatagcactctgcttttgtatatttttcaaacctttcatgctaatcagctggaaggtgaatattttaaaatctattttaaaactggcttaaggagcacacaaaagctgatttctgatgtttcttccaatacgtggaaaattttgcatgatgtattaacccctagttagggtccctcaaccccagttgaggacctcaacacacatttggtaatacctaagggaatttaaatatatattttgtagcctatagcatatggaattagaaaaaaattagtctctttactgtaaaatttaccttttaattatttggaaatttcacaattgccaagtttcaacttaaagtttctatttatttggggccagaattattgccagaagtgtgctaatttgacaaagggtaccttttacataagtaaaggaaaaagtgattacatcatgttcagacctgctagagggccttgtttttcctctagttttaggggtgtggagtctgtcccaaaccctatatatgtgtgcatttgtgtatgtaaaagacaaattttttatactcaaaagtttgtcttaaataatggcctatggcctactgatttggatagaggagagaaattttgtctataagcaacaaaaaatgctacacagccaggagactgtcacacacagtttttcagaacctttgggccacatactgcactccccttccatagaaatacacatggggtcagtgattaaggactcaattctggttgtgacttggccatccataggcatattctaaagttctatggcaacctttatgaagctcgtcttctgagttgatc

SEQ ID NO: 123604 - DNA, 1036 bp, Homo sapiens
tgtttcaggaggctgaaaaatgagtattgttctgaagggactgttgttaatgttttataagtttaagtctcactcggggctatgtctctaaacgttggagtaatgagttaatctatttgtgattcactccagggcatgtacatcaaatcaacctatgatgggttacacgtgattactggaaccacagaaaatgtaagtgtatattcattaagtgtaaaatctgttgtgtgtttaaacagatttgatccacagtctctatactttgaatttaaacgtgtgcatgctgtttgattattgtgagagcgtgggtacctgctttgtttatttctgttgatagagtactgcttgtcaccagctgttgtcaatctattatttaaattgtcctttattgctcttgttcatataccttgcccagtttttacccctacccttgtgttaattattccttttgcacactggaagtgttaagccataaatacaaaagcaatgatctttttgtttttgagagtcactcttataagaactgggattggtggccatgtgtataaaatataattttttttatttaatggaatttttatgtctccaaagcagctatttcaggattttttacaacatatttttatagttgtgtttcataatatttggcatgatattgaagtttagtcctctctccccagcccttgaataggaaaagcaggtctgtttctactgtgagagacttctgtacactgtgtacttccttctggaaattctgctatgtgtagagttgtctttagcccctcaaacattttgaatttgtgagaagtagagctggttgaatgctttcttcttgcagcctacaatgtggcttgcttttgaaagacattgatatgaaactaaaaatgtttgaatagcttccctgggtctgtgcaaaagaagcatgtatttgggggaattaacctatttaatcagctaagacaggaggagataattcctaaaattaggggaaattttagtagctgcttttctaatctgtttggtagaaatatgtgtc

SEQ ID NO: 123605 - DNA, 1033 bp, Homo sapiens
cttagattgaaaaatatgtttcttgacaagtgctcttgacaagcgcatgttctgtagtaattgaagaacatagctgggagaggtggctcacgcctataatccctgaactttgggaggccagggcgggtagatcacctgaggtcaggagttcgagactagtctggcaaacatggcgaaaccccatctgtactaaaaatacaaaaatcacccagggcatggtggcggacacctatatatcccagctacttgggaggctaaggcaggagaatcacttgaacctgggaggcggaggttgcagtcagccaagatcgcgccacttcactccagcgtgggtgaaagactgaaactccatctcaaaaaaaaaaaaaaaaaaaaagaacataggtgctttgccaaatggtgatatttgtgcatctgtgcgctcagatacatacaaattagaaattacaaacttgataaatgagttgagtgtggcttaccccatgtgcgttgtgatggtagcaatgagattgaacgtgccaggggacttcacattctcttgcagctgcttgacagaagatctgttgactctttgggaagacatctgtctttgccatttattccttttaactggggaattggaggaataaaagttgtatctctttccagtgacaaagaacatgttctgtctgagcctttattcttggtgtccttgtctgtgaagagacatttgcttgtcccatctctcttctacatcttgccgtccccccttcttcttcttgtggtgacatccttccttccatccatctctgcatccttccttccaataataatttatgagtcctctaatttgaaggatacatattgctgcttcttttctcctgcaaggaaactgcacatttcttttaagaaatttcttcatttcttaacattttttcagctgtagtcctacaccaagtacaaggatagatcttcccgttcagtgttgaggctgtaatttgagatgaaggaccccaaggtgggaagggattgagatctgtatttccagtgtagt

SEQ ID NO: 123606 - DNA, 1111 bp, Homo sapiens
atgtatatggtaataaaagttccaagtaatttatggtgacattgattattgaaagctgactttcctgcttttagttcaaaactcttcatgtaagttggcaggctgagtgaccgaatgaggggacctttccctttaatcatagttacaagtccttcaaaacaagctctgtcttgtggcctctttatccattcaattgtgagtctttgattctttgaatttaaaaagctgtgatgcaaatccatcttatttttgtctctctattgaaggacaatattattatattttagtctctagaaaataacaaaaaatgaatatcacatttagatagaaaaatactgctaatatagaatattcatttatattttgaaattcagtttttttcaaaagtttggaagagaacattttcagctaatttttgcttctttcaaaatttctaattttttaaatattattttttgtttcactaggaggtaacataaatttaaacttcaagtaaaatctatttaaaattagaattgttttgttaaagttaaagccttttgttgttgtttttaacttaccattgttcatcttgcaaaaaaaaaaaagtttcttacctacttccgagtatatttatgctttatgtatcttgattttgacacgtgacttgcctctctctggcccacatagccaaagccagctgaaagaagtttctccacagccgggtgcagtggttcatgcctgtaatcccagcactttgggaggccaaggtgggcggatcatgaggtcaggagattgagaccaccctggccaacatggtgaaaccccgtctctactaaaaaattcaaaaattaactgagcatggtggcacttgcctgtaatcccagctacttgggaggctgaggcaggagaattgcttgaaccagggagtcagaggttgcagtgagccgagatcacaccactgcactccagcctggtgacagagtgaaactccgtttcaaaaaaaaaaaaaaaaaaagtttctccacttcagaggggatgtgtagaattttgagaagctgaatagctattcagcttgtgctggatccaggatcactggacagttttccttattcttgtctaatgtccatct

SEQ ID NO: 123607 - DNA, 1014 bp, Homo sapiens
atttaaataactgatatttgcacttgacatgacctataaaatgggaaaaaaatgtggccttcattacattttgtagatgatgggttttggctttaacatgaatgagtaaaatcctgctgggtcctgacactagaatcacatgggtagcttcgttaggtgtgggccaaaaacacctgtaaggacattttgtttataaattggttagtgtgggtgggattcaagtctgcctgtcccggtgccaggctaaagatgcagtttacttaactgtcaggatttggacaaactcgacagcattcaggctgggttagtaatgccctgaaccccagccaggggtatatacaattacatcactgagaatggtgggaaagaatgtgctgctgatgattttgccgtcgctggtctgcgtactgttgattatataacacttgctgcattgtgtgtattcttcttcttaaaatggacagagccttgtcttctgctctgagatgtgctgctcttgtttaggaaagtaatggggaaattatttgtagttgataaatgagctgccgcctgggagacgctatggccaagtagtctgagcacgggtctgggaagcaggaatttgcattctaatcctggctctgctacatgctactccctctgtgacctctggggaaatggtgatgtctgtttttcccatctgtacagtaacgctcaccttagatgtggctgtgtactattgtgtgttttgcactgcccagacatctaagcatcctgtttattaccgaaactgtattttcttttttttttttttttgtacaaacgtgtttgagtttacttttattatactttctgggaacatggcttttccgtcttttctgcttgatgttttgcaaattgtctctttcactttgcagtaatactttgaggacaggtaaatttacttggaaatccaaagtaagagaggcaggaagggtcagctagagacgcatcacatgcatcaagtgggatgataaacgtaacagctgcctctgg

SEQ ID NO: 123608 - DNA, 1249 bp, Homo sapiens
tggatctttattatgtgtttggatttcacagggcccctgcttccaagggagcagcagttccagctcacagctctgatcagggtcaaaacccgacttacatgcatcgtctttatatggtttttttcaagaccaagttcattcatttgctagtctttctttctttcctttctttctttctttctttctctctctttttcttctctttctttctttctctctttctttttcttctttctctttctttttttcttctttctttctttttctttcttttgtagctttgaggatatttaggacttaagtttctgggcagcttatttcctttttcattctctgctcttgtaagtaaaggtaacttctgagtagctcaaacatatgttggaactatggatctttagacctgaaagaagcacggcagctttccaatccagttttcagacattatgtttcatcatggtccccgttcttcaaattaaatttaaccacaaacctcgaaggatgactgataaaatcagagctgcaattagtagtgtgcgtgggtgtcagttctaatggaagcctgctaatccactgatgggaagcctgagaaccagaactaagtgagttagccagtgttactggggcaggacagggagtacagccaggaggagaaattgggctcatttaggtagaaatcagattagtggcagctggggacggggctgtagggagggagtaggcagcaaaggggcccgagggaactttttttgggggtgataggaatgtttctatcatgattgtagtgtggttgaatgactgcctgtttgtccaagctcactgagttgtaccctggaaattggtgacttttaatgtctataaattatgcctcaagagaactgacaaaaagaaaataataaagtggctcaaaagttgtaaggaacctcctaaaacattcaggtctttcattaggggaggggggagcattttctatggttttaaattcagtgtaactgtatgaaatgattccttaaaaaatacaacaaaaaaagaaaaactcacattcccttaattccagactagactggtggagtctatttttctggtcggcagaggtcatcatcactctgtactcatcgctgctgtcagttataccaagggcctgtaaacctgggccaggtagtaaatattttaggctctgtgggagagccatacgtctctatcacagctattcaactctgccattgtagtacaaaagcagccagaggcaatc

SEQ ID NO: 123609 - DNA, 1051 bp, Homo sapiens
ctgaggccgagattgtgccactgcactccaacctgggcgacagagcgagactccgtctcaaaaaaaaaaaaaaaaggaaagaaaaaaagaaaaaggtgagaagatgagggtcagacaggttcaccggaaagaatactgacagggtggggggaaattgtacaactttattgatttatgcatctccaaactgcagtcttcaacctcagctggacttttccttcctttttttctctttcattcaaccaatcccaaagtgcttcctctgtgctgggcagtgcaggtggcgaaatggtaaataatgcggccatgcatggtcctggccctctgtggcgggaggcagggggctcgctgcagcataatgaacacataaacagtcacaggtttggaaaggcttgtgaagggcacagcgaataacagaatgctgggctccttcatataccgtggccagctgaagcctccctgcagatgtgaagggagctgagactgagccattctaggtagatgggacctcacagggaaaggcctcgagataggagcccgaggtgcttggccagcatccagcatagtggttaggggagaatgtggccggagatggagatgccttcaggaagatcacactggacctttttggctgtagattttatccccagtgcagtgggaagccagtagggcttggagcaagggaagagcattgaagttgtgcattaagaaggctttaaggaacctcaaaaacttgatactaagtgaaagaagccaatcacacaaaaccacatactgtatgattctgtttatgtgaaatgtgcaggatccattatgtgaaacatccaggcaaatccatagagacagaaagtagactagtagttgcttagggttgagggtcagacaggttcaccggaaagaatactgacagggtggggggaacttatacaacgttattgtataatttcggggggagggacttctaatgggtacagaattttctttggtgagggggtgttaaaaattctaaaattgattgtggttagggttgcacagctctgtggatattcta

SEQ ID NO: 123610 - DNA, 1039 bp, Homo sapiens
cctcttccccaaagttttgcctccctctttgctgcctcctgcctgcctgtcctgtttgttttctctttgcttagctctcttccttggagtggtactcccacattttcttctcttccataaaaaaatacaggtgggctgagctcactcctctaatcccaggactttaggaggctcaggtgggtggatcacttgagcccaggagtttgagcaagcctggacaacatatcgagaccctgtctctataaaaaaaaaaaacaaaaaaattagctgggcgtgatggtgtgcacctgtagccccagctactcgggaggatgaggcaggaggatcatttgagcctgggaggtggaggctgcagtgagctatgattgcgccactgcactctagcctgagcgacagagctagaccctgtctcaaaaacaaagcaaaaaccaaaaaagcaattggaggacaatagctcaagaggtcttttttcactcatccttcccctccccacatccccccatccccaacatgttttctttaagggatcacctagttgtttccataagggccaaggctgggtcctggactctgggagtgtgaaccctcagtcagggtttacaatatttccaaaatgttgccagtattgctgctcatgcttgtgcgtgtttctgtggggcaggcgcttcctttgtttttgtttttgtggtgaaacacaagtccgtacatgagccaagggaactggcccttctctacttacaagccactagacaggtattttgtttctggagcccttaggatatacaggtacatggtgacctgtgctgacaactacttgacattttctctttctgtagtactgtttctctctccctgcttttgtctatttctgaaatgtgaatggcacacagaaaacttgaagtacacagcctaaagtaccatattgttatttggttccagcaagggataacttgccattttctaaagttttttcaaaataaatttggaacatataggtagagagtttgtgaattccacaagtgtttcatcctttggaggc

SEQ ID NO: 123611 - DNA, 1054 bp, Homo sapiens
acgtgtgttgggctgggtgaggaaggctgaattgtatttaagcacaaccagtgcattgtgtgtgtgttttttttaaattatacttggggccagttctgtcagtaaagcccatccaggcactttgtcacattatggatagcgctgtctgggcttgcctgcccagggcaggtgctctttattttaatttgtattacgtatatttgctctgaaagttgtttttgttgaaacttgaaaagccaggtgcttgcagctagagaatgggcagacttattggaaatttgctgaacaaggtttgttaccatgaagtagggacaccctcagccaagtgtaatgggctatgtagagaattgtccatcaaaacccccagtatgatggccactatggaactggacttctatttcaggactggcatttcctgaagcgttatggcagggtctctcaaagtgaggtgcctgggatagtaaagagattacgttataagagacacaaacgtgacagggaactactgtgtcactgatggttccagcaccttgctgtccagtctgtttgatgaggtcaaggaaagattctctctgtagctgtcatttttccagcaccttttatttgcaaatttttcttttagcatgaataagcaggccctgggagacagttccatctagctaagtttgctttgctttcatatttatattcatgttatttatttattgagagggagtcttgctttgttgccgtggctggagtgcaatgatgcgatcttggctcactgcaacctccgcctcctggattgaagcaattctcctgcctcagactccccagtagctgggattgcatgcctctgtgccaccatgcctggctactttttataattttagtagagatggggtttcaccatgttggccaggctggtctcgaactcttgacctcaagcgatctgcctgcctcagcctcccaaagtgtgcattcatggtatttctatttatggcaagcaacacatatttatagcagtgacttaaaggttcttataaaaatgaaattaaaaatgaattgatttgtt

SEQ ID NO: 123612 - DNA, 1064 bp, Homo sapiens
cattctagtttggaggaggacgtagtggagcagagctagccacagtacttggaatttgtcagaggtgcagcagggtggctccgccccaggaaggcctagggctggggagtcctcctgtccccagaagactgacatttgactgagagtgcagctttcagggggacttggatggagctgagagggagcaagaggccctgggaaatgcccaatagcagaatcagccccatctgtcagcgggtggcataaggtggccagaacaccacacctgagttgaagcttgtctatacatgccggtgggtagggaggacagcaagggccgcagcagatggaggaggtgaccatttccaccggggagggggcgtgaaaacttcatggatgagggtggattattgctgggtcctgcctaatgagcacagtgctggattggagaaggggagggaagggcgcccagggggagagatggtggccaggagggacgaggtggagaagggccaggcgtgtgttgtaactctgaggtgctggcttcttagcagaacttgttctacctcccggcttctctggctgagcctcccagtgggaagacaatgggttctggagtcggatgggcctggacctcaagaccagttctaccactttttagctgtgtcatcttcagcaatgtccccagtccctctccatcagcttcctcgtgtacaagggagatcaggagtgatcttgcagacttttcagaaggaaaaaacaagacttagatttaaccatgaacaatgtaaacatagtatatgctcagtaaatggtgatttccttgggccagctcttccgcagggccctggtctggagcctcctgaggcccgcagtctctgcccaactttctgactcactcacagccactgtcaagtcagcaggcacaggaggaaaggcatgacctcatcttcttcccacacttctcctctctcttttgtgccacattttctgtctagtgtagagtttgaacctggtccaaacccttggcaccctctttggctagtttttgcctttcatgtgatgtcgtagtccatcatctcatc

SEQ ID NO: 123613 - DNA, 2271 bp, Homo sapiens
gggagttttaaataaaaaggcatttgtttgtgctttcttcatgggcagaccttttcaaagatggcattgtaaaaagaggatgtgcatttcattcctttattaacagaggccctagaggcacggctgtcttgaaggacctggggctgctgctatggagatgagtgtcacagctccgggactttaaggaactccactttgctcaggcgtcagacacatgaataaacacggtgcagtccagaggggcagaagggagaagtgatgaatcttgctggtgaggaagctggtgcgtggttggtgtccagagaaggcctcaaaaaggaggagaagcttctggggagccttggaggatcaggaggagttggccagaccagataggtgtgtgggtgatgctgtaggcagaagaagagcaaatgcaaatgcatggagtgtggaagcagcgaggtgtgttaggagaaggaatcccagctcccgaggctggagtgcaggttgcaagaggaggacgggcggaggaggagcttggccagcaggcctcgggccagctttgggaggcctttgcttgtcatatggtcatgtcattcaggctgtactcacctttcttgagaggacttcttggataagtgccattctgcagccccggtgcctgccttagccttcttccaagcacttaccgcctgccctgttctgggtttgtgtgttcgctgcctctcttccgtcataaggacggaagccccagcagagcaggacgttcttctgtgatggctcccctggtgcctggcggtgagtgatgttaggggatttggactcatctttgtagtgaatgatgggaggatcactgaaggtctaaatcaggggagtcacatgagtgcatttgggtgtttgaagagcagtgtggatggcaggagagctgatgacaagtatttagggagagcctccatgcacattgattgggagtccattagcagtcctgctcttcaggctaccttgggtgggcccaagctttgctggcctagttaattaccaatagctagtatcaatgtcattccatcagtgacattttgaaactactagaaattacagagaagcagccagacaccgtggctcacttctgtaatcccagcactttgggaggctgaggcaggtggatcatctgaggtcaggagttcgagaccagcctgaccaatatggtgaaaccccatctctactaaaaatacagaaaaaaaaaaaaaattgctgggctttgtggtgtgctcctgtagtcctagctactcaggaggctgagacaggagaattgcttgaaagtgggaggcagaggttgcagtgagccgagattgtaccactgctctccagcctgggtcactctgctcaaaaataaataaataaataataaaaataaaaattacaaagaagctcagaatttttttttttcactctgcaaagctgatagctgcccaggtattccaataaaagccatgatgttataatgttacaatcatttttgatagttcagtgattgaaaaatctgaaggaattgtctttttttgaaatgctttgaaataaagttggttctttatgtaaaaataggtttttttaggtccttaaattggcttcaggacatcctgacctcacagccatgtgcatttcatagttgggctatttgcaaagttaaaagaagataagaaagtagacattctgcagttcttctgagagaattgatatgatgtctcattctgtttgctgggcccatgagggaatgaactgtttcatatatagggattttcctgataaccgaaccttaagacctggtttaaggtctttaaacctggatatttttaagacctggatatttttaatttttccctgtagttttggatggaaacctttctaaaataaatttttaactttttgggcttacagagtacattcaacctgagttaatgatttcttcattccttgcttatgaaagaatgaattattcagaatcactgaagtgtgtggttaccataatgacagggcctaccgatactcgtatgactactttgccgagtgaccccagaatgccatgttttctaagttactgtccttggcttttaggtaaccgatgctccaagtaacacacactggctcctcttttggatttactaaacttgtctctcttgaaggctgggaaacaaaagaacttttctgctttctaaaatgagaacaaacaggccttgggtgaaggtctgtctttttttttttttttttttgagacatagtttcgctcttgttgcc

SEQ ID NO: 123614 - DNA, 1080 bp, Homo sapiens
taaataaatatcaaataagcataagactgctatcaaataaatatcaaataagcataaataaataagccaaataaatatcaaatatgcgtaagactgctatcaaataaattagaactgactgctatcaaataagcataagactgctataaataaaatagataaatatcaaacaagcacaaataaataagcaaatacataagcaaaataaataaatatcgaataagcataagactgctatcaaataaaataaatatcaaataagcataaataagtaaatatcaaataagcataagactgctatcaaataaatatcaaataagcataaataaataagccaaataaatatcaaatatgcataagactgctatcaaataaattagaactgactgctatcaaataagcataagactgctatcaaataaataagcataagactgctatcaaataaatttcttaaagatatgggatcatgcctggctttaaaagaaatagtaattgcgagatatggtggcacatgctcagtgaactgttttaatctggctttcaaggaaactgggctttatgggattataaggaggtcaagaacgtggtatatcttctgttggatgtaaaattgatgtttatagttcagtagtgtcacttctttgatagtgggcaaccagggacacgctcacatgatggttaataaaggctcttcagacactagatttaaattctgcattcatccatgtagtaagcattgactaatttaatcgcatggagaatgagccagggagacagctttgttttcctgtatccatcctgctcatgagactccgccgctctcaaaggctttacctgcctgcctgcggaagtcacacacaccagaacaggtgccccacctgctgtagggggaaagcagagccagtctggggcaaagtaaaataacccgtgttgaatcctcactctagcactcaatggtagtatgaccttgagcatttagcccttcggagcttgctttcacatctgcaaagtgggcataataatacatcacatggctgttatgagcattaatgaaacagcaggagagagtgcccagct

SEQ ID NO: 123615 - DNA, 1049 bp, Homo sapiens
tcacaccaattttgtgggttaaggttggtaattatcatctttggtggtaattatgtaactataacattataaaaacattataagactaccttacttttcttataaaagcagattgcatagtttagatcttatcgttgttattgctagttttgtttgcgctttacagatctaaagttatagtgagagtgacatactgttgataagatgtaaagattagagttgtttggtttgttttttgtttcatgtagttaacattcttttttctcttttaaaaataattattttcatctcaaagtcaagtgatagtagtgttaacatttgtccttgagatggtcaaggatggcatctgtttgttcaaattagggccctggcaataaaggtctttggtaaatatttgacagggaagaaggtaaaaccctaaagtctctttgtccaacaaagttggaatcagcctataaaaaccatggctctggcttcagcgcgtctgttttgggtaaaggtgggagcacatgcctgtagttaattgcctgcaatagagaataattgttttacttttagggattttgcctggagagaaaatgtattcatgtgtccattcattcacagtctcttcctgtctctgttggggctggataaatcagtgtgtttgtgggtgggccgttcctcattctgaaacattgtggctgctgcagggtgacacagtactggagaaccagggctgttcaggagctgcccaagtttggatcctttactcctctcatggttgcctgacgttggccaatttatgtacattgtttagtcaactagctcatctttaaacttggaatcatgctgttactaaactttcaggatttgttttcagggctaaatgagataatgtgagtgaagcatttatcataatatcagccatattttaagtgcttaataaagcctaggtgctacttttgttgcatagaactcaggcatatcctggaaaaaaaaatcacatcttccaacggggtagtttcaatctcaaatcaaacaaggatactctgccttttataaatagt

SEQ ID NO: 123616 - DNA, 1034 bp, Homo sapiens
tctgttgtgaggtgaatggaaatagatgaggctggagagtcgggagtgggatgttagatcaccaagcccctctgtaagtctccaagcaggtgggatccaaggaaagaatgaagatcttttcgtggccttcctttgtggaggaactgtgtgtgtatttgtatctatgtattgtgtgtgcacacatataatagatacattatacatattagatatattgtatacgtatatacacacacaatacatggatacatatgcatattatatatcatatatacatgcataatacatatgatatatatacttagatacatacatataaatatgcatacatgtgtatttattttttagggctcattatttgattcagaattctatcaggcaggcactgtcctctctttaatgggatgtagcactaactgggttttagacctgcagtggcccagtcaccctactgtaggggaagctcctggatctccaggggaaatgtcactgaaaggctctgtgcaaaaaggaacttgacttactgggtatttatttcctttgatctgtgaaatgtaaaactgagctgactttaagcataagaaaacattaaaaactcttcattaaagaaagaagaaactactaacacattgacctgagctaaaaaaaagagatgggagtttgggctgacagggagtgggagaggaaaggggagccatgatgaatggagaggagggagactggggtgggggaaggcggaggagcccagacggcggaagtttggaggggagtgttccccggaggtcacaccttgaggtgtgggtgttttctgtgttatcacctgtgatctgctgccccttgctgatgaacgattaggaattgtttctagcttagtatgtaatttagtctttatatgttcagagacttcactctggtgggataagccaaagcatagcattggttggaattttttctctggaagtggttagaaatatcaatcatctgagggttaggattccctaaccccacgcccccaaagaagggtacatgtaaga

SEQ ID NO: 123617 - DNA, 1112 bp, Homo sapiens
agcataaatcagaaaataaagcagagaggtgaaggagagggactgggtgggggactcctttggatgacgtcatcagaaagcctttcagaggtgacatttaggcatgaatggtaggaaggaaccagccatcagaaaattagggagaagggcattctaggagagggaataactcatgcaaaggccctgaggtgcgaaccggcttggagagtttgagaaaaggaagttgtggtggggtcatgagagcgagggtgggggtgatgggtgaagagcaggtgagagagacacacagaggccagatcatgtaggttcttacaagtcgtggtcagggaggtgcaattttttatttttattttttaatagttacggtggaaagcagagagtgacagtatttgatctgtgtgttgaaagatcagtcagggtttttgagcagaaatgaattcaggaaatccagctggaaggcattgcagtattctggaggcgatggtgtcttggattcaggtgttggcagtttcagcctttgtgaagccaagttctagttacagttgggtcattgacagcttccaatctcagtaatgtaaacattatatttgaagttgggatgtctgctcattctttcccctcctgccagggctaaggtagatgctctcctctgcccctggctcctctctggccaagtatgatggtcatttagaatagagagcgccctctgtctttctgccttgttcacatcattgttattttctggcactttttgctgcggctagtttctgaagctgtttattcatctatgaatagagtttttgtgaaattggacttagcctactttgttttctttgacatcaaatggctgattgaacatttttaaacctgggatcagaagggcaaatatggttgtttattaaagcaaagcagttccttagaatgcgaatcaataagatgtagaaattagaaagctttctatgtgaaaacttttaaagtatttgagtaaagaaactggtgtatctgacttaaaatattttgccctactgaaagactatcctaatgtttgctttagaaactatagctcccatacttttggtggaatagatggcattttgagaaattttcaacaa

SEQ ID NO: 123618 - DNA, 1087 bp, Homo sapiens
accaacccctgcccccctttaaaaaaaaatctttaacacaagtagtaagaagggagttgtggggtggtcagtggtcactgtggttgaagtttgttctcaggatcctcagtaggacctaggaggatgagatgggcttttggctagtcacactatcctatagttggtgaccacacggggtttaccacacttaactgacttttggtggagattttattgttgatgggaaatgacaccaaatgtcatttcaggaataaataaccatggcagttctaaaaacttggcacaaatatatgagttgcgctgagactggggtagctccatcctttatccatggagattggcaagtgacaactcctgctccggctccttcgtgcattccccttattgtgaggaagcgagaggggccctcccgtctgtgtccccatgcctgtgtcactgcctctcttttcacccagcgtgttgtcttctagctcccggacctgagcgttcttgccttgctttctctctttcctctcatttatgctatttctggcgtgtcatcactggcttacccattatgtaagctttaagtgaaaaaatcagatgttattttcatgagctctgagggcacttctgcatttgttctcatttgactcttctgaagcctggagatgcacaggaaggcagtttccactgcagatgagcagcatggaggaggcttttggaagtgaaatgaattgtccaaggtccagaggtgaggagctgggaccaggcctcacaggcttctgttctgtggtcctgtcccgtccctggtttctgctctatccaggtggtgccttctagttccttcctaaccaacaagtgtgggaggctgggtgtggtggctcacgcctgtaatcccagcactttgggaggccgaggtgggtggatcacctgaggtcaggagtttgagaccagcctggccaacatggtgaaaccccgtctctactaaaaaaaaaaaaaaaaaattagctgggcatggtggtgggcacctgtaatcccagctactcaggagactgaggcaggagaatctcttgaacccgggaggcagaggttgcagtgagctgag

SEQ ID NO: 123619 - DNA, 1009 bp, Homo sapiens
ctcttcctttttcctatagctccaggacacaaactgttttctctgagcagtgaagtctttcataaggtgtattcttatcatccaggggcacctgtcagtgtcaaagagatttctctgccgtttaccagctggtcagaggatccggggcagaacttgcagctgatcaggaaggttcttgattagcggagtgataaatgcctcttgcaaatttcgtgagctttccttgggtaaattagtttgagccatatttcctcacttttaaaaaatagtacctgggcttgcagtgagcatggcataggatggtttttgctgtcaactgttggcccctgtctggtacctggtctgtgaccagcaacttcagcatcacctgggagcttgttagagatgcagaagcttgggcctgccgaatcagaatctgcattttaataagatcccctggcgattcgtgcacccatcacaattagagaagcactgttctagcacgtagctgcaaatgtgttttcaaactttgctagagtcctgctattgtagtattgggctatctggtctggtatgtactccagctgttttatttacattctggaatgatgacacttaatttgagaaggcttgtctttgccactaattaaagtaaaaaaccagtcttacggtgtgtgcttatatttataagcaccacctagcaacagcatcaggcaattcttagcaaaataagtgagacatttcccttgagatttcttccttattccttgaagagttcttataacagccttttttttttttttaaataagaggcagggtcttgctctcttgcccaggttagaaagcagtggtacgatcatagctcattttagcctcaaactccagggcttgaggcttgagtgatcatcctgtgtcatcctcccaagtagctgggaccacaggcacatgccactacacctggctaattaaaaaaaaaatctttgtagagatgggtcttgtggtattgcccaggctggtctggaactcctgg

SEQ ID NO: 123620 - DNA, 1043 bp, Homo sapiens
gccagggagaaacctcgagccaggactccccgggaggcagtgacttttgctccgggaggcgccagtatccccggtggcgctgcattttcaggccacatgtaagcactgggaaggagaaatataattgtttggaaccactgtcttgattcatacaatatttgggatgaggaaggcagtggggctggggcggtgggggggtggtggggggaatgagcagaggtagaagcttgtcctcctagctggctcgcttacttttcaatgtctcctacgatttcgagggaaaggtactagagtttactcaacccttttctgtactttcaagagaacaaagtccaccaagaacaatctgtattttcatggtttccccccacccccaacgacatctctgtttcaagttactatttgtttttctatctgctcttccaggtgaggaatggtgttctttctcagtaataactagaattgtgtagcgctttacagtttgctaagagctctctctgttattgtccttggtcatcacagtaagcctgtgaggtaggtaatactggtaagaccaggtcgtctttcaaaccgtcccacccatggctgcagcataatgaaaactgatcaccgctacatctcatttctcacgcctgtgacttacacatagaccacgtggaataggatgtccgaggtgtgtggggtgtgtcagtgggtatgtctgaccatttcctgctcctctgggagaactccttgagaacgggtttgtcaagtgagcagaatttcctggactcctatataaaatgaagctaaaaacaacacatgtttctgccttggtgactaggtttcccttggtaaagagtaagtggcattgccagtacttggtaggaagcatgagcttaaaagccatccatgcccacgctagcttgaaatgaggtgtgttcctccattcaagatgctgccaaattccctaggctggcagcttcctgaaactgagttgatatgtattttatctgtatgtccctcatagagccaacttgagacactgcaaatttcagctactg

SEQ ID NO: 123621 - DNA, 2215 bp, Homo sapiens
ccataatttctcaaaggagttgacctttcacttctgtgttaaaaattactatgtcagaagatcctttaattgtgcaggaattatgtggtaaatttttcttctcacgagttaaatgagatttaggctcaataatttattttttaagtgccccatgctaattttgtgggagaaaaataatttctatttaaacatcatcactgtgatgaaagtttaatcccatgaccactactttcaattctgaaatgatggaagacttaagttcagattacaatacaagatttcctcagaggcaatgggtgagcagttaaccataagagaattatgagtgcaagctattgcagttgctgctgctctaagatggtggcgcttgtaatgatttagcatttcttcctagtgaaaagggtcgcagattgaactgcctaaatctgtggattactttgggactgcattgattgctggaatgcagcagttttatgtgagctgcatatctatactctgtacttaagaatgatcactatgtggaggtcattctggtaggatcttgttctattgtttttttgtttccttttttgtttctttgaaaaggggtcgtgagacagtggcagtgcatgacccattctttcctttagtttgagagggcattttaaaatacagcagattgttgttgttattgtttaagactgagtttctcttgcccaggctagagtgcaaggacaggatcatagcttactgtaacctcgaactcctgggctcaagtgatcttcctgcttcagcctcctgagtaactaggaatacaggcatgtgccactatgcacacctaatttttaaattttttgtagggaagggtggggggtgtcaatatgtggtccaggcttttcttgaactcccggcctttaatgatcctgctgtgttgacctcccaaagtactgggattacaggtgtgggccactgcccctggccagattcttttaaattttaagtactttaaaaaaacaaaaaacaaacgtagttcctttaccattaatcacacttcaaaaaagttaacagtaaatctttaatataataaaataccaatcagtgatctatttttttcaggtcctttgtatagctagtgtattacaatgtagcctttcccccatgatctatttctcttgctgctctgaataggctgagtgggaagatgtaggaccggatatgtaggtttgagatatgtcagaataataatttcagtttaatttctggatttaccttagttcataaattgagaggattctgttacctttagttatatttaggatacctaaattcttagtattttttgtctttgggatccttttggatagattaatctttaaactgttccaggatgcaggctttccagaatcaatttaatatccactacatttttctgttctataaagtgaactcccatctccactttattttacttccaaatttgtatccagggtgggtattttgtctaactataggactttttataatctcaccaacatctagtagtagacatggcttggtagagaaaagtggaaaaggtagagggaataatataaacatgtgaaatttgtttttagtttatttttcctttgttgatggttcaggatagggaatttatgggaagcagctataaaacactgcatttgtcttttattttcatctaccagggaatctgtctctggttttcctttcctattatcattttctagagggagttctggttaattctgtcagtcaggctatatttttttctttttaccttgtgaaagtcctttaaagatgtagcatattaattagtattataaaggaaggaagtctttcactaacccctttctgctcatatgagaacccaagagctaagtatcttgggaactattgatattttgggctggatacttgtttgcttggggagcagtcctatgcattccaggatgtttacagcatccctggcctctatgcattagatgccactagcaccctccacaattatgacagccaaaaatgtttccagacattattaaatgtttctttgggggcacagtgaccctggtccagaatcactgatttaggtctcctgttaaactgtcttaaaatactgtgctgtttcttccagtgatcatagcaattttaagtaattttaatagtctttaccactagataataagctctatgaggacagtgactgtatttcctttgtttc

SEQ ID NO: 123622 - DNA, 1956 bp, Homo sapiens
ccccagtagctggaattacaggcatgtaccaccacacccggctaatttttgtaattttagtagagacggggtttcaccatgttggccaggctgatctcgaactcctgacctcaagtgatccgcccgcctcggcctcccaaagtgctgggattacaggtgtgagccaccgcgcccggcccgtttgcatctttttcagaaggggtatcagtggcttagaattagtgatagtattactagttgtatgtacaatttcagatatctctttctaaggccagttacgctgttttggacaacttctaactcataatggtgtgaaagaatgtaatcaaccttgaccttgaacactggctgagctcctgaacttttaagtgagctcattttgtctggttttgtgttctcaacatctttctctactcctctctctcaggattgtgcctctactcctgcttgtacagactgcttttccagcagcatggacacaagaagcatagtaagatgatgataacccacataaggcaggccctttggaatatgttaggtttcaattggtagtggaatagtgtatttgattatatggttagtacttgggaagcagaatgaagtttgtcacttagaatagattggtagtcttaaaagagagcgtctagggaataagttgaattgcttcacaaaaaggttaattggagaaaaaagttttatgctcaatagtgagcataaatcatatatatataaacttttgttatgtttacttgtattctgctccatgtgattttacaaaagagatagaactatttgagtgaattgcagacctcttaattgaataataaaatacaccttttgaagaatttctttgaactataagatgacaaattattgacatatatgctataggaataaagaattgaatttttgattttctaattatagaggcagcagattgtggtagaggtactattgattatgagaaataaatgctgatgagaaatgtttctatagtttgtgatttcgtacctaaatggattctgtctcatatttgatggtaaacatgatgcatttgctttttctgattttgattttatgcatttgttttgtctttctaattttgttttataagagtttctgatacagccatcctttaaacttaaggaaggctatgtaaatgtattaaaatacctattataggtcaggaaaaatctcagtaactttgacatttctttatttattcagaatggggactatgttgctcatgttctctaaagacaattttgactattaagttgatgtatgacaaatttgtttttaaaataattctgcaacttaatgtgatttatatagattgacttgaaagatgtaggatttcattctttcattaatttgttcatgcacgtaactaatatttaatgaacatgtatcgcggcctagggatttttttttccatctcctgggatatagtggtaaaccagacaagcaaaaaccatgccctcttggagcctatgttgttgtgattcttttccttttgtctcattagcagtttgtgtattgaacttgctgcagagctggggaggctgtgcaggcattactgactccagcattgcttctttgctagggactatgttgtttgcagcctgatccgttcttagcattttgcctcttagagtccagattgcctgtccactgttcaaaatagagactgaacaggtagacttagttaaatgatttttcaaacagtgggaaaatatgactagctacattgttttatacaaaattgtctgttatatatgttttaaaatctccatttgatattttggaatcttaactatttcttgtaaaatacagctttaagaatgttttcttttgtccgtgagaatcattagtctccacatgcatgattttaaaaagcaactattcttaagtggagaccaaaccttatgaatttagaagaataaactaataagt

SEQ ID NO: 123623 - DNA, 1730 bp, Homo sapiens
cacttgaacccggggggcagaggttgcagtgagccaagatcgcgactctgcctcaaaaataaataaatacatgtataaagtgtctattttatatatatacatgtatacaatgtacatatttataatatttatacatatttatgaagaaagatgcatgtagaatacgctggaaggtggcctaccagccgtttaacagtggttatttctgaagaaagcagtaggtggatagggtgcaggaatgagaccttttaatagtttgatttttttcacagtgagcatttattaccttattactattaatttaagttgaactcttactctgtcacacaggctggagtgcagtggcatgatcatagctcaccgtagccttgaactcctgggctcaagtgatcctccctcctcggcctcccaaagtgttggaattataggcgcgagccactgtgcctggtctccatattgtttttgtaatattttctccaaacccaaacagtatgtgtcttagccattaggagaaaggtggagttagtctattttaatactgcttgaattaaatcacttagagaaagggagcttaagagtttgaagatccttaagccctattgaagacttaaaattcatgtttaaatgcagtttatttagctgttacttgatcatgcttaaataattcatgcttaaaattcatgtttaaatgcagtttatttaggtgttatttgatcagtagactcaaaagctttataatcttttgtttttaaagtcttcttggttattcgttggtgctactaaatggtgtgtcaccacagtcatccatcatctgattcagtgacgttgctagctagtgaactttttgttttgtttttggaaactgggctacatctgagtgcctaggtagtgagaagaactggatttgagacacagttccataactcacaagcagtttgattttagttaagtcacttaacctaattttatacgtttataaaacgagaatagtaaatatcaatcttatcaggccattctgaaagcaaaaacagttgtgatagtgtttaataattgacagtggacctcacagatgaaaagtatattactgtctttattgtttttctcatgcagctccctgtctctttcaaatttttgtgttggttagtctcatttctgaaatggttttatccttccttaggccttgtaggctcttcttctacttattctccctttgttatttagttttcagtatttattccttatcttttcaactattatctcttcagaaattacttgtattttttaattttctcttttgggattcagtctcatatcttcaaggtattttatgtacatgtgcatttgaaatcattgttgtcacctcatgtctaaacttgcctttcctccacaaacttacttttagacttctgtttatatcagtagtaaaatcatgttcataaatactcaaagttgaaaacttggaattattttagatgctactctttcatccatacttttgtcagtcatgaaagctaatgaattattttttaaaaaatgtatattctgcatccttctcattctttttattctcagtgttaacactttagctcttatcctcatcgcttctcctttggtttgttgcagtcagtttttaattggctcctaatttactatgctctttttctctagttcatatagtagaactaggtattttagattattagattattattatttttttagacagagtc

SEQ ID NO: 123624 - DNA, 1049 bp, Homo sapiens
aggatggggtcattagatagaggggattatatagggcttgtacagggtagaagtcttgggggccatcttagaattctgcctgccaaagctattctaaccaaaccaatgataattttgtagtatttccttttaatatttttttgtgagctaccatttttatttataatacaaatattttaccttgaggctttggaagtttcattactatcacttataaatatacccatattatttctgattataaaataagggattttatttgagagttcaagtatctgtagtgtagttttaattcttaacattttagttgtggtggttaccgtcatatcccaaaataataattttatattgctgtttctggaatggtcagttttagacattatttattgattttttgcagcagcaggtgatgcactagttcacttgtgtcattcctgccctgtaatacctctatttggggtggtgagactttggaattctccatgataaagtgttttcctccttggttgtattttcttgtgtgtattataacttatggttttcttcttatttcatcatttaccaatctttttatcacgtttccattttctggaagtttgtcacatctctgctgatttttctcccctcctcattctgcttttcattgtgaatttttatacctttttctttcttgagttctttattgtcctcccagtaagaggaagaaaagaaaaatatctggttagcatgctgtcttgaattcaaagtatgaagattgtgttggctgcagaaactttcatgaagtttctgatttctttgaagatttgggggattctaatcagtactctcaagggcttaaaggaccattgttaagaaagatggactgggttgattacatttagttattttaggttcactcttaaggttaattcctttgatcatagaaccagcaaccttgtacatgagcaaaatgttgatggttctctgggatgtaactcataataagctgtttgttgggccctttaaggtcatagtagaattcatttcatattgctgaaattgggaaaggc

SEQ ID NO: 123625 - DNA, 1087 bp, Homo sapiens
tttcagccctagacaaccaccaatagatttgccctttctggatattacatataaatggaattatataatatgctgcctttttcacctgacttctctagtttagcataatgttttcaaggttcattcaggttgtaacatgtatcagtactttttttctttttatggctcatatttcgtcgaatagatacatttgtttactcattagctgacagatatttgggtgtctgcttttttatgaattttaaatgaattttatgtgaatagggctacaatgaccacgtgtacaggttattattattttttctttctttttgaaccctcagacgggaaaaagtatcatgtacaagttctttgtgaatacatgttctcagttctcttgggtacatacctagaagtggaattggctgggtcttacgttaactgtgtttaatcttttgaggaactgtcaagctgttttccaaagctgctgcaacattttacgttcccaccagtattgtatgagggttccagtttctccacatccttgcttacacttgttactgtctttttgattataagcaagtaagtgtgaagtggtagctcattatagttttgatttgcatttgccttatgggcagtgatgttgagcttgatttgtaaaagaaaagcagtatgttggtttcattgagaatataaaaatgaacatgtttggtagtttcatgtaattgcttggagagttttgctgtatgtaaatttgttcttttttcatcagttgtattccctgaatgactataaaccacccatttcgaaagcgaaaatgacccaaattactaaggcagccatcaaagctattaaggtgagtaataaattttactcttctattttcaaaagaaaaaactatattaatagtttggatgggggataatttttttatggattatatgttctttttcactttacagtgttaacacatattgtggaaaaacacaaaaaagaaaatctgtcacctgtagactctcccacctagagataaacatttaatgtttattattactcttttttagagacaatgtcttattctgtcacccaggctggactgcagtgccac

SEQ ID NO: 123626 - DNA, 1079 bp, Homo sapiens
cagtcatttttcctcacctttcttagataatattttgcatatatccacattatggagaatgtgtttaacactgtcttttgccacactgtcttttgccacaaggttcttggcagaaccttgaaatttgagttggtaaaagtttctatatattgatatattcattttttcttattgattctattaatattatagatttgaaaataggccattaaggaaaacagttgtgactcattgtatcaggtatttgaactgtgggaaaaggccatagacatttaacctttgctctcataaagtaggttttgaacctatgttaactcatgaatagttctgaaaatctcaggaaaaggttggatcctctggagaaataaacatatgcgcaaaattttatagaaactttttggcaaaaggatcttttcaagctcagccatagatttttccccgagaagttcttgtcccctaggctaagattccctgaattagtaggcctcttaaaattgagaatgaatgagtacttatttctaattaagtaggtactaacctatgaatattcagtgatatgttttcctgccctgaattaaattattaaccgtaaccaaaagcaccaactatttaaattatcttttaaataacagcagtgtattaaatttaacagattcctatttactagtaattactactgggtgaaaattcagatgattcgttgattttgcagttttctagtggctaaagcttagttttcagacttgttagtatcttacatcaatagttaaaatcagtgtacttccatggcagaaaatcagagagaacgacagtaactataagcacattgaagccaggaaatgtttcaaagacatgattatttagaggatttgataggctcattgtggaataattttattctcttgtactttactctgcattatgtgatttttatgatcatgatcatttgaaagtgtggaaacgtgtatttttttctgtgaaaattagtaattgatgcacttttcataacttgttgagcagagtactttcttaatagagttaatgaggtataggtgcaaacagtattttctattttcaga

SEQ ID NO: 123627 - DNA, 1051 bp, Homo sapiens
aagtttaaaaatgttagtgattagaaaattttatttggtctaacgcttttaaaagcatttctcagagattgttctgattaaagatctttctttaaaagttttaatgtctggttttgttttgttttgttttggtttttttgtttttgtttttgagacggagtctcactctgtcgcccaagctggagtgcagtatcaagatttcggctcactgcaacctctgtctcccgagttcaagctattctcttgcctcagcctcccctgtagctgggattacagacatgcgccaccacgcccagctaatttttttgtatttttagtagagatgggggtttcaccatgttggccaggctggtcttgaactcctgacctcaaatgatccatgtgtcttggcctctcaaaagtgctgggattataggcgtgagccactgcgcccagccataaagttttaatgtcttacactatgcctcataaacttgatgaataggaatttacctagaattcttgttaaaaatgtggattctaattcaccgagtgtggagaggaacctgagattctgcatttgtaacagctcctagatgatgtttctttacaaaccacaatttgagtagtaaaggtttaaaaggtaaaagtgaatttatggataaatgcttgttgactgatttgatttgtggtagggtactttgaataaaatgtgtcagaatcttaggaagacctggaatgagcaaagttactctatcgtgagataattacagtcaatctgaagaagccaatcagtgtatggggaaaaacttaaatgctttgctattaccctgtttaaatcagagatccagcaacagatttgtgtaatggttaaaataaggtgtgtgtgtgtgtgtgtgtgtgtatatatatatatatatatacactttttttttatacttttgagctaattgtagattcacatgtcattaaatcagtaggaataaatcatgtagagatcccatgtgcccctcactcagtttccccctgtggtaacgttctgtagaattgtagtaaaatattacaatcagga

SEQ ID NO: 123628 - DNA, 1078 bp, Homo sapiens
tcagtattaaccatcatagatccctatatttgcattataaataactaacttaccttagttatcctgaatcctaaaggcaataaattttattttgagccagagacctcatgatttggtgacttttctaccatccatagctctgttctcatttgctggtttgaaatgcaaaaatgaaatcctcagctctgttccaaaaatatgtagagtttacccaactctttttgtctgtatgaaatcccttgcctttttttgcatgagtactacaagcaaatgtgtctactagattcagaataagatcgaatattatcattcagaactatttattttgataaaatctagatgctttgttacagtgaaatacattctatggtactgtggctactcttagatacggtgaggtcaggaataaatttcatctttctggctctgaaagtggtctgtagatgagttactattgccttaatctgtaagcttttggctatgattaccttcttcaaatttcctgctacatatttagtaagagcaggaaatgtggcttatttgtggtgattttcaagttacatttactttgtaaataataaatgaaaagatggtgctaaactgtctagagattatcatcatgaaagttttttgttttctagaaagttgatctggtagctgtatgtacatggttgttaatggtggttgatattttgcagtggatatgtatatatttttcaaagaagcgaaacatttattcttctctttgatatttttccagaggaaggattgagtccacattgaaagatggctgttagctaggtgcagtggctcacgcctataatcccagcactttgggaggccgaggtgggcagatcacttgagaggtcaggagtttgagaccagcctggccaaaatggtgaaatcccgtctctactaatacaaaaattaggcaggcgcggtagcacatgcctgtagtcccagctactcaggaggctgaggcaggagaattgcttgaacccacaaagcagaggttgcagtgagccgagatcatgccactgcactccagcctgggtgacagagcgagactccgtctcaa

SEQ ID NO: 123629 - DNA, 1050 bp, Homo sapiens
aaaaaacatacaggaattagctgggcatggtgctgtgcacctgtggtcacagctatttggaaggctgagatggaagatcatttgagcctgagaggtcggggttgtagtgagccatgatggcaccactgcactccaggctggatgacataggatagatccccaggattatagatgttatatttgagaaaaaaaatggaaactctggcctctgtatttaacaatgttataatttgccatttggcattgttcttttcatttgcgtaggaacccttttgttgtgtgttccagatgaagtctgaggcatgttggcagtgtgtttgctagagcccttctttcctgaatttgcttctttcttccatgtagcttttcacagtggttaaacaaattttaaaaattataatggtaccttatttatcactttgttttatgtcattgaagccagttacatagtactattttagaacttctgattgtatagagtagccaaagtagattctttaaaatgccattccagaaactgatgatattggagtagtcaatgtatgaatattcattaccatagcataggcaatgtctttgtatttacacaggatttttgatgatttttgtctatcaagaattttacctttccgtttcctttccttttcattcttctttttttcatcagtgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaaggtatgctactggttttttttttttgtttttttaaaagtagatacagtagcctcttggtcttaattagtcttcagattatcttagtacagtcatgtgccacataatgatgtttcaatgacagaccgcatatacagtggtggtctcctaagattgtaataccatatttttattttaccatttctcatttatgtacagaaataccactgtgttaaaattgccta

SEQ ID NO: 123630 - DNA, 1130 bp, Homo sapiens
ttaattaccttagtactttaataattctgtgcaggcaaaagaatgcttctaatttttttttttttttttttgagacggagtcttgctctttcacccaggctggagtgcagtggtgcgaccttggctctctgcaaactctgcctcccaggttcacgccattctcctgcctcagcctcctgagtagctgggactacaggcttatgccaccctgcccagctaatttgttgtatttttattggagacagggtttcaccgtgttagccaggatggtctcgatctcctgacctcgtgatccgcctgccttggcctcccaaagtgctgggattacaggcgtgagccaccgcgcctggcctagaatgcttcttttaaatgacctgtcataattgatttttaaaataggtaccttagactaccacttgaagtaatgtactaatctgaaattttatacatgcattttttagaagtcactttactgtgatttagaaatttcactagtttggacttggatttctgtcagttctggtgattaaatctttcttgaatgtgtagatttcataatataatatctcatactagggcttatggaatagggctttcttttaaccataggaggagagagtagattaacattgtaatctcaatcataaatgaaggacatcgtatgtagatatatggaatgatagttgttaggtgctggccagttttaaagtatatgatgggtggcttggaaacggaaagatttttatataaagcagaagaacataaggcattttccaagtgctcatgttttagagtggagaaatagtcaaatcagaaagtatgaagcagtctctaattttcttgtgcttcatttgaaatacacaaatttgcacattaatgtagtttggacatagtttaaaaatatgtcagtgtaatattatgagggatttaaagttgaaccagatctttattctgaaaattgctattttactttgtaaaacatatacatttaacagaatttttttttttttttttttttttttttttttttttttttgagacggagtctcgctctgttgcccaggctggagtgcagtggtgtaatctcggctcactgcaagctccgcctcctgggttcacgccattctctt

SEQ ID NO: 123631 - DNA, 1653 bp, Homo sapiens
tgagccactgcacctggcctcttttttcgtacttgattttagcctctgtctttttttttcctaatggaataagtggcatcacgatagtagtaactaggacttagtacttgtttgcagaatagttatgtgttaaacagttgtgaatcagattgtttggtgatagtaccaagaaaatagttattacataatcactctgcttttattagtgataatatgaattcaggatattgttactctgacataagtgttctctgggtgaaatgtttatttcaagaagcaaggtataatagatggaactgctgatacttcttacaaaatactgtaggacatcttgagacattattcttcattgggcatatttttctgcctattaagtttgaagctttcaggatctgtaaaactttaatacaaccaaggaagacatataagtaggaatttttctagttaccaagttttctctaaatactgctaattatgttactagatttcagaattacccaagaaatagaagtcactaataactagtcttttcaagtttataatacacagaatataacaagagacaggcaatagttaaatagaatttcccaactaaatagattttcatatgaaatgactgagattagggtataagtaattaaatagaagtacgttatagtatcgctataagaagagctgtaacaaggcatatatctccctcccaagatgctcaaaatttgagaatggctagacatttaaaatactagctggcttaaacagtctgatacagtttggaggttcagaaaagagacccgagaatccttctggtatactgtcttattttataaatgaggatgctaaagtttttttgtttttttaaaaaatgtgttgacatagttggcctgagaccaggatcagcagcaacgttatatagatcgtaaatatttcatgaattttatagcagctgccatatgactgactggaaccttacaaaaaatacaaagaactctgactatttgagtaatccagaaagaggttgagactaaaacaaaaatgtgatttatttggtggtaagatgattagagtgtgggttgggatgggcaatgttgagactctttatgaggaatataaaattggatgcagtgctgcagttcaggggcatatcaagaagagtaaatgagatggttcacagatgtcaaaagtctgcttgccagtggcaagcaggttttttattttttattattttttttaatttacaaaatggtaaaggattcaaattttaggaaatgaaataatgtagaacattattcatacagaggatgattcatcgttctgagggccagattaagtaatgccagtatgacattgacattctgcaaggggaaagggaatagtaaagaataaagaagagggaatgaagagagaagaaatggttacgcttcagattctgtctgtacagaagtttgtccatctctggttcaaagtgtcagtagggaattagcattcatggcaggatgctcaaaaaaggaagtaatttgattaaattcttacatgaggaaatgccctctcctcaagtagattgtaaaatgaaagttttaaaatgtcacattagataaggactttgtcctacaagttacgtatttgttcaaaagatagacattgtgtgagacaaag

SEQ ID NO: 123632 - DNA, 1050 bp, Homo sapiens
acattgatacatattggtaaatctggttgtaatattttccatattaggctttaagttatttaacttaattgtaagagtggttggaatactaggaatgaagcttgcttctagtgcttagaggccacttctagaaagcatatgaaattgtggaaacacatcaacctaatgagaattaaggattggagttatgaggatttttttttttgtaaagaaatgtgttgtatgtttttattaaatcagttacttttttttccctaaacaattctgcagtgcccaaggttctgtgagggtatgtgaatggactagtagggggaagatgttggaggaggcaggggtagaagttgggagaatggaagaaggatgaatggtgaaagtctgtgggtctcttgtttcaaacagaagttattagttgtatatattggggtaataaacaaaaacataattttagaatatgttagatacaaatgtatcattttagtaaaatgattccccttgacaaaatttaaaaactagtattttagattatgaattgcaaacttgcaagcagcatttgaaatcatgttgatcagtgtcctaaacaatgtaagaatctcctttaacagtcctgatgatacagtttatttatccagtattttaatgctttctgtaatgagaagttaactaattgttattattgtgtgttcttttgttgagctgaatcctgtttcctttattttctattaatatacactgacccatgttttgctttctgaagcaaggaatcaaatttactccgctatctttagagatgtagcttttcattatttgaagacaggtatcattcttccccttaggtttatttgcttcagatgaagtacacttttttccaactgtttcaagacttctcaccatcctgtttggctcttttgggatgccctttttattgttaatgtcttaccttgtggcacccagaatcccaggtgtattccaggtgtgaatttccaagaatatagttaaactattattttttcttatttaaacagtatctgtctctgttaacatacctaataa

SEQ ID NO: 123633 - DNA, 1038 bp, Homo sapiens
atatcagatcttcagcagagcatctctgacacgttatccatctattgatgtacaattgaagaatgtatttttcttttaataattaatgttctcaagtattctactttaagtattaaaattgcaaaagaaaacatgcagtagaatatgttttattgaattgacttttttgttttctttgaatactcagttattttcatagtatctttagtgggttttaaaatatgtttccacctgtttttccttttagttctcacgtttcagaatctgtgaacaattccatttttcatcagatagcagaacaactacaacagcaaaacctagaacatctcagacagcagctcttggagcagcaacagcctcaaaaggtttataaccccatcttgtggtctttagagttattactatttatattctataaattggcatttttgtgggttggctttttttttttttaattggtcttaatagaatattttctcaactatttagcttttaccagctactttatttctttctaaagtttgttatggtgatattttttcaactcttattagtaagaccatttttttcaggacctttatggttttttctgtaatcaaattgtgttctggtaacttatgaatgcacattgtagaaattaatttcagtgtactggaagtagagaacaggatggagggggtttcagaattaccacttaaaactaaacgtgtttttctctctgttccctatcaagcaagttgatgattatgttaatggtgacaatgatgatggccatgtagattgctatctttaatttttaaaacgtatttgctgttagcatgtagcaggagctttattaggtatgtggtaggcttgtatacatttaaccctcaggcgatgggcattatgactcccattttatcccagaggaagtggaagcttggtgagattaaacatctcatgcagcagtgtacagctagtgttatatattatctgactcaagatgtgcggttattttatgcatagctaagaattttaaaacatcgataactaaatgta

SEQ ID NO: 123634 - DNA, 1061 bp, Homo sapiens
cgcataaccaaatacaggcataccttgttttattgcacttcactccattgtgctttgaagatactgcctttttttttttttttttttttttaaataggttgaagggttgtgaccaccctatgttgagtacctctcttggcactatttttccaatagcaggtgcctactttgtctctatgtcagctttttttttttttttttttttgcaaaaagtattttaaaattagggtatgtacatttttgtttttagacataatgctgttgcacacttaataggttacagtgtagtgtaaacatatcttttgtgtgcactgggaagaacaacttatgtgccttaaccttactgtgatatctgctttattgtggtggtctggaaccaaagttgcagtagctccaaggtatgcctatacagtgaaaaataatctctgattgtttacctcacaactctccttattcaaaagcagtatcaatttcctgtggtttgtattctttcttaacacattttaaacatatggtagtgttttcatacgatttattggtctttagcatggattttagaacataaggttttcgtgaatagtctaggggatataaagcaccagtgaataataacattccaggaatcaagtgtcccttctgcatgggatgacaagaatcattaatgctttctggggaaaataatggagtttcctatgggaaaaatgtgtagagagataatattgaaagagatgggaaatacagaacagagttcagggagattaaggcagctggaatatgcagaaccagtaataaagaggaaaaagagaatgccaggtgcagcggctcacacctgtaatccaagctactttgggaggcacaggccagcagattgtttgaggccaggagtttaagaccagcctgagcaacaaagtgagatgccatcactaccgccaaaaaaaaaaaaaaaattagttcggcaaggtggttcacacttctgtagtcccagctactcaagaaagaggtgggagaatcacttgtgcctaggaggttgagaagctgcagtgggatatgattgtgccact

SEQ ID NO: 123635 - DNA, 1034 bp, Homo sapiens
gaaaacaggtgacatgtaagtggttgacttggcagagatgtgaattaatacttgtgattttagttgtttttaaacataacagatgcaagtgttcattgacaattatttttaaatatattatcttaaatttaattattatgtgtattactgctttttcctcaattacttttcaaagaagtaactatgtctaaatgatttaggtcatttgtctcttgtgtcttgacagtatgtagtactactctctgggttgggcaagtggacaagaaggcaacacagcaagacttaaccaacctgtttgaagagtttggacagattgaatccattaatgcaagtatcagttcttaataatttaaggttttaaaaaaggaggtttttattaatacaaagaatcacttctgttcctaattagcccagtaatgtctgccttaaataatacacatctttaaaaggattgctttactttgataatgtctgtgtttattttggtgctgtttctctccttaattatttttattttttagtggaattctaacaaaatgttcttgagttttatagcagtgtaccatgcttgattcctgacatcatcaaatgtttgagttagcaggaaccctatgtgtggtctggtttaattcctttttttaaaaaactgtctctgaggaaatggagagttccacagaattgtagtcacttgcacatgaccacagaagcagtcgtggagacacagctggacttaggatcccagtttcttttgcctttttcttctcactctctcaccctctcgtgctcttttactctcttttttatcaaacagagcaaatgttaggtaagaaaatcagtatggccagcgaattgctagtaagttgagcataactctttcactcttgattcttgcactagttttgcaccactcagtctcctcctttgagtctgtgttttattcttcatgaggcctgatgcttttccctgagggtcagacatctttggttagctattttaattgttcttttatttaaaaattacgtgctgtctttctt

SEQ ID NO: 123636 - DNA, 1030 bp, Homo sapiens
aagaatcctctttgcattactcagtataacatttggaaaaattgaagtaatattaggaataaattgttgccttcaaatattttggccatataatactactttccttttatctggtggtattatgtatacgaagttatacattttgttttgtttttaatagttctttttctgtattcagaaaatattgccatgtgatatttaagatttcacatttatcgtggcttatgatacctaattgagttctgaattttgggattttaaaaattgagttattaattgtacatgaattgtacctactaataaacagctggaggaagaaaggggaaaataagtcagtaatctatcagaattgaagtattagtaagtagtcaatgttttgtgtcatttaaaccataaaataccagaatgagtttctgttcttataccttttcttaaaacaattttttttattagatgattcctccccggggctgtgcttatgtctgcatggttcatcgacaagatgcatttcgagctcttcagaaactcagttctggatcatataaaattgggtccaaggtcattaaggtgagatttggtggattggaacttggggtaggggggcagtatttttaatgtctgttatgttaaagtctgagtttttcacaagagggtcacaagctcttcttttattggattattagaatgtctctgtattatattctttttaaatgttatggacaaacctcatcagaaacttattgtttcagttcgttgagttatagaattagatgtaggtaaaaataagtccaataacgagaactttagtcaattacttccttgaaattacacttgcacagctttctgagtcaactagggcaccattctatgagtacaacgtgttcattttatagtattgtctttcattcacttttcctcccagtactccttaactataccttctaattatattattgatttcttttttcttgacatctttttaaaatataaaccaggcccttgtgaagagattatctatcagaatattttt

SEQ ID NO: 123637 - DNA, 1390 bp, Homo sapiens
aggttgacatttttatggtgaaaagtggatttggattttctttggaactggactgcactattagagttacaaaaagaagtggaaatcctttattgtaaatactatgtctaatgtaagttttattttaaaaaacaaaactggtgaggcacagtggctcacacctgtccagcacttaaggacaacccctgtctctactaaaaaatacaaaaattagttgggcatggtgttgcctgcctgcagtcccagctgctgcagggctaaggcaggaatatcgatggcttgagcccggaaggtcaaggcagtgaaccatgatcatgccactgcactccagcctgggtgactgagtgagaccctgtctcagacaaagggaaacaactggaaaaaaattcttttggctactgttagtttttcagctttgcttttccagctgttttctaaaaccaattttaatgtgtttacattgtttaaataaaattttgaactttttaccttgtttttatagtatgtatgtataacctttcttttttcctcttcccatttacaatagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactggtaagaattctaaggtctttttattgttaaaaaaaagtatgcttagaaggttgtagctgaagtgaatttgggatgacagcgttaactgtgtatcctggattcatctcccaaaaaagagaaaagatacattactatgccctagtgtacatgcttaatgggacctattttaatagatgtcaaagtatagattagaaagtatagaagtctatataaatgtagcattttaaaatatatgtgtgtttttttcaatttgatacttgagagttatgtgtgggagggatttttgaaactaaatatttctaattgcttcagtttaagtgggaacttgagaaggttttttgaaacactttgcagattattttgagtagtatccatgttgaaaatagcagcaatagaatcgtagtttagggagttcagatgcatacaatgttatatactttctgggatgccttttacaataccaaataatcatcagcctgcttttttttaatccccaaaattatctttttattttaaaagatttcaattaaaaattgacaaaatgatttgcagttataaccaataggaaatctaaacatttgaaaaagaactgaaatagatgcatacaccttttttcttcacaccttagctcttttatcagagttagctaattttcagaatatttgtttctcagaccaaggtaaaat

SEQ ID NO: 123638 - DNA, 1013 bp, Homo sapiens
gtaaagctgtggtgcagatgaatacttgcgactttacctagagtgagtaaaaggtacttatgctaggattagaaaataaattatgagaaatttaggccattctaaagctgtcattgacatgtttcctaatggtggttaggttgcataacaggtattactgagtgggagatggcagtttaaaatggagcataatattcagtgttgaactaggtgaccattagtttacatcacttgaatgtaagatcaaattcataatctccaagtaaaaactatctgttgaataacattgccttgtttttaccctaagtaggttcacttgcaagtatacaaaaagggggcataaaaccctttttagtagtatttgttaccatcctgaaagagaaatagaataatttgcctttagttgttccaagatgcaggtgaataaactgatgagtgaacttttttgtctatccacaaaagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtaaggaatttttgttttaatatttgaactctatttagattatcatttaagttgtgtttcttccagatttaagtaccatagagcagtggttctgagaccttagcatgcatagccttgttaaagcgcagattgctgggcccagcctccactgtttttgctttactcagtctgtggtaggggccagagaattttattttctaacttgttctcaggatgcagattggtgggagaagcagcactgacagagaaatattgaatttctttagaataattgaaaaccatggccgggcatggtggctcacatctgtaatcccagcacttagggaggccaaggtgggcagatcacttgaggtcaggagtttgagaccagcctggccaacatggtgaaatcccatctgtactaaaa

SEQ ID NO: 123639 - DNA, 1202 bp, Homo sapiens
cttagtttgcattttgattcactcttggtgttttgttccccttttaatgatgttaagattgatcagaacatttagtggaacagtagaacctggtcattaaaaacatttcctttcatccattgatcattgtttcttagatctactttttattagttgcagagtggtgatctttctaaatgtataattccttccatgtttcttaacttaaatgaagaaaaagttttccttaatcaggtaatggtacttagttaccttgaagtgtggttggtacagcaaagtcagggtagatgctatttttttctttaattgccatttctcagagtcatgagatctataggtatttccagtgatacccagtgaccaaagagagatttctcatttctcttcatcttctcctcccttgtccctctctcccttttttttttctccttcagtttctttagtatttatggattaatggatttttacttctagtcagttgcatttttctttttttgaagtgtagattgtttcatctttggacggtgggagacctgtgttgcctccctgtcacattagttttgagagctacttagctttttggcccagtatatcccagacaaatcttgtgttttcctccctccaatctgagaatcagccatttttccagttggggtatggtatctagagaactcagtctgggtactagattctcattttgctcttgggttttcgtcgagtctaggaatttttagtggacaaaactagaaaatgtgcattttgaacagaaaaaaatgaatatgaagtattattaaagaaattagctactttgatttttatatttgcttgtgttctcatatactgaaaacagtaacgtgattgcttttcattttcatacaatatagacatacacatagtagtttgaaagtagtgttactgccaacaaggctaccagatgacactaagatttttctgccactttttttttatcccaaaggtgtataatcataactaggggtacatgtgcaggtatctataaatatttgtttgttacatgagtaacctatataacaaacacaagtttacctatatgacaaacctgcacatgtacccctgaacataaaagtttaataaataatgtataatcaaattattgtgtatcagggttacctgaaataaatcttttctttgtagatgtggtgccagtttcataagtgattttt

SEQ ID NO: 123640 - DNA, 1058 bp, Homo sapiens
tgggaggctgaggtgggtggatcactcgaggtcaggagtttcagaccagcctggccaacatggtgaaaccccgtctccactaaaaatacagaaattagccaggtgtggtggcgcacgcctgtaatcccagctactcaggaggctgaggcaggagaatcacttgaacccaggaggtggaggttgcagtgagccgagatcacgctactgcactctagcctggcaaccgagcgagagactgtctcaaaaaaaagataggtttaaaagtctttctttttgttattgttggttcattaggaagaattgtttattctttctgaaaattagacaaagtgttcagaagtcatttctgaattcactattcacagaggcttaccctagggccaacctcccaattttttcctagtccactaattttggaaaatctgcagttaattaatggaaaaagagaaatagttgtgtgccagatgctatccaaattgcctttgctgtctcatttaattctcttaattcttgtgcatgaccacaggtgtttttatttttgtagctctgttgtatgctaacagtttgttcaggtaatctagagttacatatgaagataaaacatttcctaagttctccaagtatgattttacggcattctaagtgacatattgggctaaaaattttaattgtgtaattattttgtattcctctggttgtgttttttaatatgtgtgacaaatgcacttagggatatttatacccattctttaagatggaaagtttatagcttcatatttgtagtccaccttatgtattctcaactgatgagtttctaacttcatctgacaaaaggtaatgttaaatgaatgttaggaccctagtacattgtaattgcagggggattgggcagattttcatactcatacatttcagtctgcactagtcatttctgtatgtttagacattcactttatctggcattcctagaaaattattaatttttttgttactagaatttactttttttgagtgctggtcctaacatctttggtgaaatatttctgaaaattgttagt

SEQ ID NO: 123641 - DNA, 1028 bp, Homo sapiens
ttctatggtcccactgttggtacattaagaattatggtttagaggcacttgaccttgatgcctgtttgggtctcttctaagcatacttttctttcctttctttcctgtcctaaagccttttaaacctccactcctgttcttaaaaaaaaaaaaaaaaaaaaaaaaaaaaaaaaaaaaaaagaattatggtttagaaaggcttttattaaaggtggaaaatcagtataatacctgacatttctgtttaacttaaaaagatgtcatgtagtagctaatgtaccttgattattgggggatacaagtagctgattaagctaaaattattggaaacttttgactgttattttgagttttttctctctctctttttttttagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgg

SEQ ID NO: 123642 - DNA, 1597 bp, Homo sapiens
gtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataacagtgttctaggaattgtatttttttaacctataaattcttaaaaccttgaattattattagcatgtgcttattttttgcaaaagctttctatcataacaacaatgaactatgtggtggaaaaagcatgtactttgatataaaaatcatgcagcctcctcagtatgtgtataatatctgtgtatgtttattgtggaagtcgtgtagtttttttctgtttctctgtatgtccgtcttcatgcacatacagagaaaatagaaagttgaaaaagtttagataataaaatattcttttaaatctggtagaat

SEQ ID NO: 123643 - DNA, 1967 bp, Homo sapiens
taaaagaaattatcatgtgctcgttctttgtccttgttttttgttgtatagaatttaagtgaaaagagattatcctcattcagaattttcaaaagtcataattgcatttgccattttttaaatgatggagagaaaagttaattatcttactttgataaatttggcataggacctatcacattttttatgcttttggtcacagttctgtcactagaatactagcaattagaaatgtgcaaggagtaacctaaccactttaatacattggtttgaagtgttgcaagcagtgataactagacaccaaatcatgtagtgttttaatttgtgacatgttagaatgatatgcctttctgcagtattagcgaacacctaatttttatctgtatttaaacatttcattaaacattagcttgtgttcttagcataaatgcatgcactgatagaaacttagtttacagcagagtaatctgcatcatatgttcctttattttaattttatttcaataaagggtagacaaataatttgaaagtattggaagatgaaaatactagaagtatgaaattacttaaaactctggaagtaactccatataatatttaatagataaaaatgcattcattatttaagctattgcattcttaccagaccagttccttttgtcctgagagtttagtttcttcattaaatttatttgccatttttcactcatataaaagattatagtttaaggagccacacatttagggttgtttgggggttaggggacgttttgtaaatttaaaaaggagaagtcatctttttaatttgaaaaagtgctttttaaataaacactgtatttcgtgggatataaggtgccattgattgtaagaaacaccattcagaaatagaaaatacttctaatatgacatgctagtgtttatagatacattcctaattcagagataaacgtgaagtttcctagtatcaaataaatacaatatttattattgaaatggactttcagtttagtgagaatatatgaacattactgttaatcagttaatttgaataaattttctaccagtctaaacattgttttttttttttttttttatttgagatggagtctcgctctgttgcctaggctggagtgcagtggcgtgatctccgctcactgcaagctctgcctcccaggttcaggccattctcctgcctcagcctcccaagtagctgggactacaggcacctgccaccacgccccgcctaattttttttgtatttttagtagagatggggtttcaccatgttggtcaggatggtcttgatctccagacctcgtgatctgcccgcctcagcctcccaaagtactgggattacaggtgtgagccacagcacccgtcccagtctaaactttcgtacgcacacacacacacacacatatcacctcaagtgatttagagaatattttgtttttcttcactattatgtctaatatatatatgatatctaataagctttctgttctgtgtatatatattagatatctaacaaatatatatctaacagattatattatatatatatatgatgggcacaacctttaatgaacaagaagattctcatattaaaactttgttataccttatgtgccttcatcatcattactttattgggtgctatattaataaaatacttggcttttaacttacaaagaaaactaacatatttctctttaaaaatattttacttacataatatatagaaaggcaagtatctttatattcattaggcaaaataaaggtctaaattattttaagtagtcatactatggtgtggcagagaattataaatcttaatattgttcatgctgtggtttcatatatgatatcttttaaactaacaaattgtagacactgaaaatttattacttctgaagagaaatattgattattataatttttaatggaagatttaaaaacaagatatc

SEQ ID NO: 123644 - DNA, 1049 bp, Homo sapiens
cctttctcagaattagcctccaaatccttctcatagagcactccaggctcctttttgaccccatcattccaggcagggaccatcaattggatttgttgtttgcattgaaagtcatttgctgccccttcactaagtgattatttctgacatcacttctagcatttaattacctcaagtctatgaaataagctttcttttctgtaaatgaccagttgaggaagaaaactaagaggaatggaaagacttaacattattggaacacttttaaaaatagcacaaattttattgcccttgggtttttaaaactgcctttaacaatagctagatgtgtggctttggacaagttactgagcctctaaacatcgtttgttattagctaatctgaaggggtaaattttcattattaaagataatattagctaatactaaatggacacatgctctgtgacaggaactggaataattgtattacctgcacaatataatccttacgacagtcctataaggtacttattacttcactatttttctgaagagaaacccaagacacagatttaagttactttgcagactcactgtagtgaagatttaaacactgtgtaccagattcaaaaattagtgtgtaccatcagataaagtgcctgacatgatagaggctcaccagatattaggcaatgtatatgcagaaaaacataacccaaccagccatatgtttatagccacagttaaccactaaattgtttccattgttacaaacatatatcgggctatctccttttcctatggctaaataattaagtttgattttcttagatctccctttcttctttttctttttcttttttgttttctttcttgagatgggatctcgctctgtcatccaggctggagtgcagtggtgcgatcatagctcactgcagccttgaactcttcctgggctcaagtgatcccttctgcctctgcctccgcctccacctcccaacatgctgggattataggtgtgagcccctataggcacctggcccgtatttgcatgattggtttttttt

SEQ ID NO: 123645 - DNA, 1009 bp, Homo sapiens
accattaaacaggatagtcagcactacctagttttttagctgaatttgtaatgtccatatgtttatgtttctttagtaatacttgaactaaaggaatttgcaaagaaaacccaataatattagtattacatcaaaaagttactgtgtatttttcttccatcaagaaataatgctgacttttaaaggtggaggagtttttagacttcagtaaacataggtaccctgaaaatgtgcactgttgtatcttttcacttttgtatgtcagtgctttgaaagaatggacaatgttatcattttgttttgtctgcttattaaaattttctccctagtgtgatgtgactatcattttgccatttcagtgtcatattagaaatggttgttttatttaccaaataaattaaccaattcgttcagtattttatatattattagacgtctaatactttttaaaattttctcacagtattaactagcaaaatctatttgattaagtaaaaaacagctttgggtctgactgaaatccaactatataagtatataggttcttactaagtaggtgccttataacaaggactccaaaagttttttttttttttttttttttttaagatggtctcactctgtctcccaggctggagtgcaatggctcaatctcggttccctgcaacctccgcctcctgggttcaagcaattcttctgcctcagtttcccaagtagctgggactacaggtgtgtgccaccatgtcccactaatatttgtatttttagtagggatgaagtttcaccatattggccaggctggtctcgaactcctgaccttgtgatctgcccacctcagcctcccaaagtgctgggattataggtgtgagctaccgcgcctggccccctataacttatatagaaatctgaatggagaattctggtttttgttttgtttttgaagagcaccaaagcaattaaaacactgcttggcacgtggaactatataggtattcactattgctttaat

SEQ ID NO: 123646 - DNA, 1039 bp, Homo sapiens
tacatctatgttattacctatggcagacacctacacatgctgacagacaattttaagtcagtcagtccatccttaaggttaccaaaagaccagaaagattatctactgactgctgctgggcagattttacactgagtttgaagtgttcagttatatataacattctggctcagttcgtcaagaactcatccataattcttcctggaagtgtcctcatgtgcaactgtcaggatctttccagagagacttttaaaaaaattctgtaaccctaaaaatgatgtttgctactttttgatttgttgcaatataaacaggtaatatttacagacaatataagtaaatactgagttccttttcatactatgaactacgttattgctatgttgacctgttgagttcactgtatactttatgaagccatattctcaacaatatatcatgatatcaatgatctttagtaattagtcttttattctgaaagattgggcaccagatcagagttgaagagaaagtgaataagcctttaatgttttaacaatatcttggagtttgaaaacaccatagagatcactggctgtattttttagaaaagaaaaaatttaaaagaaattgtgacttatagtcatgggcctacgtagcagttttcttttttaatgtatactttattccatataagttggtatataatgtttacaatttacacatctctatagaaatgcaatgaacaaatttgaattcagagagactcaaagagggccagttacttcatgtctcattgtctcagttttttttttttttaatgtaaaatgggccaattattgtgttgagcttaagtgtttgttttgaagacctaaagagtaatgcatggtactaacacatgccacagcatggttgaatcttgatgatactgtgctaagtaaaagaagccagacacaggctggacgcggtggctcacgcctgtaatcccagcactttgggaggctgaagtgggtggatcacttgaggtcaggagtttgagaccagcctgaccaacatggtg

SEQ ID NO: 123647 - DNA, 1144 bp, Homo sapiens
gttttagcttcgcttctcagctgtcatagtggtgccagtaacttatagagtagaaaatgctctggttaactcgcagaatctggaataaagagctgctatagatcttcgtgtgatgctagtagcagaaaaaagatagtttttgttttaagggcttacataaggtagttgaggacaaattgttttaagggcttacataagacagttgaggacaaagaattcactaaggatagccccagtgcctatgaatggctcttgatgtatgatggttgctcagatatttgtttaattaatttacaggtattcattgggatgcaatttgatgataattaaatgcataaattgtgataactatttgtcaagccaattttttacactagcattttgtttgagtgagagattgggtggggatggagataccaggaaattctgtaagtgttaccgccttcaaggaacttagaaaggtggtgggcgatggggaagatactaaagaatggtgtaaaaaatgcaaggttgaatatagccaagtgcttcagtacttggtgaaggtgcgaaatgctccatatgaagagaaaagaatgcagtagtgactagatttatggcggaaatgggatttggggttggcctcgaaggactatcttaaaggctgagacagggtgaaaggtatttccatgtagggatattgatcagttaggagacaaactagagcaaaggtataaagcctgagagtcagcccctcgaaagttgaagaaatgtgagctccatctgactggagctgggaaatccactttaggagaaagtgacagacttatgttatggttggattgattaagtgagatggggttatacagaatcttcagcgtcagaagcagagtagttcatagttcacatagacttcgagaggaggagtcagggtacttagtataggttctctaaccgaaaaatgaattgatgtttaaggagagattaatttggtagttttgtgtatggtgcgaaaatggggttggagagactcattaatgggtttgctccatagtgcccttgtgtggggtatacactttttttttctttgaggcacagtgcagtggcgcaatcccagctcactgcaacctccgcctcctgggctcaagcgattctcctgcctcag

SEQ ID NO: 123648 - DNA, 1007 bp, Homo sapiens
ccagcctgtggtgtatatgtttaatctgtcaaatctcattaaatttttcttctataagaatgctaatgataccaatttctagaattgaatgatttctactctgcctgttggactgcaaatttgaaatcccctataataattagacccctccttagagtatattataatgaccatcgaacctgtatctaaaaattctagtaacttaaccatccagtcttaaaaaaaaaaaattaaaacaggaattccaaaacaatttcagaagttagaataggtgaagttagcctattttagatgtgtgcagggatggcagtgggggggaaagatggattactaagtatcatttatttcttgctgggtaaaaattcaaacacaagaccttatagctgcctttttattacacttggcttccttttagctttattgggctttggttggtacatatgtgaataaacttagactattattgtatttgactgacaaacacttaaaaatgagtttgttcatattcattttaggtggagttagaaatggaacctaaattgtaaaatataatacagcatgctgcttttcgttctggttttatggtaacattgaaactaaaatgtttctttctaatgtgtccatcctgactgccatccttaaactagagcctcttgtctgctatctgaaaagagcaacagcaggaaggaagcaattgatttatacacatttgaattagtctgtaaagcccaaggcctgtgtttgttcaagaagagacagaggcagcagtaatgctctgtgcatcaggtggattagttggaaatgtgcaagctatcatctttctaagaaaagcattttaacaaggcaaatttgtgcctagctcttttttttctgtatatctgttgtgttgatttttaatttggattgttttccactggctttaaaaatgcaagtctttttcaaagaaaggagaaagcattttgtagctagtagtatttcaagattccgtcataatgtacattgattat

SEQ ID NO: 123649 - DNA, 1052 bp, Homo sapiens
cccgggttcaagtgattctcctgcctctgcctcccgagtagctgggattacaggcatgcaccaccactcctggctagtttttgtatttttagtagagttggggttttgccatgttggccaggctggtctcgaactcctgacctcaagtgatccacctgcttcgtcctcccaaaatggtgggattacaggtttgagccactatgcccggctggaatatttttactcaatattttccttctttaaaatgcttaaataatacagtaattttattgcatattaatagaagtatttgaaggcaaaaattaatttcttaaatttatgcttggggatgactggcatttcttctgggtatatggaagctctaagcttggaaaatactctgtatcattttaaaattctaaacttttaacctgattaagacttgaatgaatgtatcatccctacactgaatgcattcatttattcagcaaacacataggcaccaggcacacgctaaaagaaagcaaggtctctgcccttgaggaatccacaatgcagtcaggaaggtaattactggacagagtgattggcgccatggcagagatgtggcagcgtgctgtggaaatgcatccatgaaccgtggaaaggggtggagtagggaaggcgattagagaaattggcacttgacgggcgtcctgcagcttgctggaagtgaagtgcatttgcaggggttactggaaggcatgaaagggtatggagtgaatggagggcagggagtagctctgcttggcccctccggttgtgaggggccctcactgcccagctaagagcttgcagtttctcttgtaggcagtaggagtctatcagcagcaggtgccctggttcagattacagatacattcttacctccttaactagcagagtcatgtgaaacaggagtggtctcaggaaaaaggctgagaaagccagaaattgtctttcaattccccctctattttgggtcccagtacccctttctgcattttggaacatcatctccttaaccaccagagcctttatcacctccccagcct

SEQ ID NO: 123650 - DNA, 1057 bp, Homo sapiens
tgaaggcgttactgatcattgtggtggtgtcagtgatattgtataataattgtaataatttctacgtattgagtacttgctatactggatgctttacgtaaattaatttatccttataacaaccacatgagaataggcactattatttcacttcacagatgaggaaacaaccagtttagcccaagttacacagctaatttgggcaaaaggtgggttctaactgaggagtgtctgatggcaactcctgtgttcttaacatccgttctacatggtttggattaagagagtttgtagctgaccctatgatggaaattcattgagggcttgtgtcctttttcttcatgatctgtgatgtgaatttctcttcataaccagactgtgtgttcagatcccaggctctgccatttgtcttttcagattttgagttatttcactttgcctaaaataatacttcatcttgctaatgaagcctgtagatttcagcatgagatgcattcttaataacctggaaaagtatgtagggacgtacaaaatcctatgtgggtctggatccagcatttatctattgactatacacagattttgtaatgagttatatcaaattaaagaatggaaatccttgttgaaaaatattttatcaaccaaattatgtttaaagctatttttatgttctttcagctcactgacatgtaaccaacttctccatctgatttcacttctgccgtgttcttgaagattttaaaaaaggggacagttggttgactataaaacacagaatctatttgtattcaagatcatcgatttaagtttgacaaactaaaagaatgtaatgttctactcatttgtatggccagtgtctacccagtaagctttttcagtctggaacatttttagttttcctagtgattatagcttagatttcagctgtattgaatttctagagagatttttagtgcaactaaaactcatgttaaaactcatgtgtaccttgaccagctttcaccatgtgagccctcttctccccaaataattgtgtctcttggaccaagttcaaagc

SEQ ID NO: 123651 - DNA, 1149 bp, Homo sapiens
ctcacccaaggatagccttttgcatataaacatattctctttaattacctgcctcttctttctttctcaccaaaggaacgtaaagaacatcctgcccagccttctaggcattccttcaataattttcgggtgcctgtgcatgacactacactggttttatagtcgataaagtttggatacgacattagttctacattcataaagcttgtactctcacagacatgacaatttataaactaaaaactgtaagatgaagtagaaaatgtgtcagactataagagactttttctactcctttttttcattttcaaattaaaaatgcattcgtgtagaatttcagatgttctacattattatttgatatagtgtagaaaaaggaaatgttgaaactaaaaaatgagcacatgttggtcatcagttggggtgtaggctttgttcatttatttgttaacccagcaaataattgagtggccaagcattgtattggatgcttgagaagttaaggaaaagaccttgccctcctccagttgaaagctcgggtgcagtggtccaggaggcaggaaggcatggaaaccgcatgtgcgtggtatactgtctgcgactccctgggccccatctggtggctaagagggatccagctaaaaagcttcatcaggaaggttagtctcaaggcttttgaagatggtagggcatgtgattttacaaaaagatggctgtgaggggtggggaagcaagccaaggaaactaaatagacctctttgggagggtgaatgtttcctaagtctttgattcaaacttggctaagggcaaaggacaagggaaatcccataattttgagaaagggaatgatgtaaatataatgtgatggtagttttacatcttttaaatgactttatcttttaggctgggaaagagtaaatgcaggtcagccacctatttatgagtcccagttcatcttttttagaaagtcagataacacttttcaagacatactgcttattaatcctagacatgagagacttatgaaaggcaaaagatatggtgatgcttcacttaactaaatcccagaaaatgttggctccccttctaaaaatcttgaaatacagtgttttttggaacattaataagaagacagcttgctatcaccaa

SEQ ID NO: 123652 - DNA, 1690 bp, Homo sapiens
taattcaagaagaatgtggaagagaggtacagaactgtaaaggcaaatcaggaggctggaagttggtttgaggatgaagcttatgtaaaaacaagtgcctgtggcattatgttaataaatgacaaagccagaactccatgtcagaaggagctaaagcctaaaataggtgggaagatgatgaggttgtccctagttgttctcaaagttgctgttaccttgaaaaatgacttccctgggaaccagaacatccaggttggcctcaaacttgctgccaaacaggaactgtggcaagccggagaggattctgatgcttggaagtgggcgaatgttttgattttcaagcaaagaaaaagctagcttcctagaattacaggccagtgaacttgtcatcattcccagagagtgctgaaaagaattaattaaatgatttttcagctgttaaaaagggatcctctgccccagcagaactggcagagatccctaataacagttcctgccaaaaaaaaatgattgcagctttgaaaaagagggttacttcaatgatgaatgagaaagcgttgtagatgctgtctcaggattttggtaaggtatttgagaaaggcactacatttctttgtgaaaaggcaggagaaacagggcttggatggcagtgcagtcccacaggctcatacccaccatgctactcaaactaccgattaatggacctatgtctacctggggtggagggctgcaagggtggacctcagaccccaatctcataatgaggtagtgagtgaggcaagacacccccttacctggccatggcttaagagttgtagagcagagatcagaagccacagccttggtcagagggagggaaacaagcccagctggatgaaaaaaaaggagcatggagacaaaatggggggtggggagcaagggacactgaggacagctgagaaccaggggctgcaggtctgccctggggaggcaggcaggtgggtttcaaaggcggggcaccatcgcttgtggaggtttgtcattctcagtgcactcttgagattgtcacagatccatttaaaagggctgaaaggagacagagatttgtaacctcagacctgccctcctcaactgatttattaccagtgtgaatgaggacgtggatataagacatgttcattaagcctgcaggtgatgtgaaggtggaagagagaactaaaacgttggatgacttcggtacctaggtccaaaaaactcagttgttctgagtgtgtgataaaatgctatttagtcgtgacccgtgaggaggaggtagaggctggagagtcagtacagattaacgtggctacaaaagcgtaaggaagacttagacctctgtagcagaagaatatagttcaagctgagatgggtaacaagccttaccttaacaatatttctctgtcccccacaagtcagaccacatctgaaattttaaaatgagctccagtttccatcactgaagggcaaatcttgagtgtatccattggagaatgccgtagatactttgagatttcattcatatatatatatggattaatatgctcaccctggagagcatttgagggattttaaggccactggcttgaaataagcgacgtgcacctgagggattggatgtatctttggtaacaccatagggcgtaggtttgagcttcttagcctttggcgctgt

SEQ ID NO: 123653 - DNA, 1023 bp, Homo sapiens
gatgcttcagaagaaagcctcctttcattcattattagtgatttctccaaatccactatttctgcatctatgtatgaaaattgaagaacattccagactatggcggtggcatcaaatccaatcatttttatagcggggctttctcttggaggactctttaaaggttacagagagaggcagcttggcacagtgtgtagattggttcatagttactgttttatagatgtttactgtaccttttagtatctgtgaaaaatattccttttatttcttctgaggcacacatctctttcaaaacgttttttaatatcttagaaacatactctacctgtgagctataaggaaataaaatgatgctcattttcatccattcttatattattacaaaactaaatcatttctcaatcctataagatacaaatcaattgcctattattgtagatgacttaggaaagaagattgtaaactagaaaaaatatacatgcatttttagtccaaacttttaaaaatacaagtactgtattcagatatattttctaaaaagatatcattcataaaattaatgcaaattttaaaatccactaaaggatccatagtgctagaaataaatgtggctttcagatggctgcgactctcagcttgcacaactgggaaagaacctgaatatgcctcttttcaattttgtccacttgatcatggggtgggaacgatattattgagtggaagtaattgctactccaaagattttttcaaagctttatggagactgtggcaaatattattttgtatcttaaaggaccctgtatggagagttgcactgatatttaaaagttcccacacacggtgtcacacaggccacgagccacagcagtcagaaatggaagggggacctcactgcttcttactgcatcattcccatcctctcattacaacagaaaagaaaaaagctaatgaggaaaaggaagcaacttttgccagaaatgtccatgcaatcaagggctttcttttccctgtgtaatgtga

SEQ ID NO: 123654 - DNA, 1034 bp, Homo sapiens
tgaggtgggcggatcacgaggtcaggagttcgagaccagcctggccaacatggtgaaaccccgtctctactaaaaatacaaaacttagccaggcgtggtggcgcacgcctgtaattccagttactcggaaggctgaggcaggagaattgcttgaacttgggaggtggaggttgcagtgagccgagatgaagccattgcactccagcttgggcaacacagcaagactctgactcaaaacaaacaaacaaacaaacaaaaaaaccacacaaaacgaaagaaagaaagagagaggaagaacggaaagaaagaaagaggagaaaggaagggaagaaaagtcagtctcccagaaaatcccatctgttttctagcggcttctctaagcaaggcttagctcagcacaactttcccttccagcccccgcctcccactgtggccattggcaggggctgttgggatcaccacagagggcacatggggaaggtggtgcaagtgctggccttcttgtttctcctagacttttgctaaggcctgtgtggggaatacccctgttggttgccaagctaagcattttcataggctgagtcacatagacagagctttactttgtgaatacaaaacagggaaataaaggaacaaaacaccaatcctgaagggcaatgacatgatcattgctaagtgccattgaatgaactcaggataactctcaacctcactcttctgtggttctgttttgcatatgtataatgtgaacttctaatgagttggttaatattattccctcctccctgttttctttaaaccctgctttgaagcataatggtgtaaaccagtaagaagtttggaaagcctgtgcttgtcattggagtttaattaaaatacactaagccttgcagaaacttgtggtttcgagtaatggaaaattgggaattcagaagtatagactgatcctaggcagaagggccaaattttctctaaagcattggacttcttgccttccatttctgtgtagacaatgtagttgactcattcttaaa

SEQ ID NO: 123655 - DNA, 1046 bp, Homo sapiens
atagcgctgggcttggcagccatggacgtggataaagtgaattcctttttgtaaccatcttaggtttctcctttccggcttctgtttttgtagagaggttttttaaactagggcactgagagagaaggagggactcattttttgttctgttttttttttttttttttcccttggcaagtgaatttatttcatcttttttcttggcaaatgaatttatttcattttgaaatctgcaatcctttcctttttgttcaagatatctgagtttgacttggatttacttacagccacttcaggaaattgactttgaaggaaaatctgagccaggtgggaatctctgctctagaagttgcaggtacctggcacctggctccctttaggccaagtctcaggatgaagttaagtctagacggacaaaactctgccacgagggcggttgttgatgggtcaatgtgagagacctttgtgatttggggcaaaaagtgttcttattaaactttgcagtttaataacagagtttgtctttgcatattgaaccctggtccttttcggctgcgtctaaatttgtatgttctgtgaatgagaatgggatctagtgcctgaccgaactataccatgtctgtgcgtttgctcttgattttgcagccctgacaggttgggtagcagcctggcctggaaccagctgcaagtaaccaagcaatgatgagttatttgcagttggataaaggcagattttacccattatcctctggaggtcttctcttgcggggaaaggtcagcaataatgagatttagtcagctttccttgcaggcggagcctccaaggaaatactcattgaacttgagtatttttgtgcttttgttcatcgtatatagaagtcctaattgaaaccttaaattgtgcgctccgtaaaccacttgttgagccgcagatggttggtttgtacattacttaatttatcgggtccttactcgtctttgcctgcaagatgaagggattggagagagtatttccaagactctgttttatcatcagcaacatcatc

SEQ ID NO: 123656 - DNA, 1030 bp, Homo sapiens
aaaccctttgccctacacagaggcccctctgagatccctgctgagcacagacggagacacttggtgcccttgggggcagcggatactatcagggagaggcccgtgcattattttccacctcttgtcctctctcagagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggtaagggaagagctggcatttatgcattcgtgcctctttgatgatggcaagtggtatgctggcagaggtccccagatcacctctgcccaggacacctgccactccccagggggggacacctgctccttgaatcagtgaattgctcaaggaagggaggggaagagtgagagggtggaagagctgaggagactcagaaaaaaattagatccttggcttattttgttaccaaggtagctttcactatggaaacagatgttctggtttgtcatttgcaatctgtgggaagggagtctgtactggtttagtataaggggagagagatcactttaggtgatgaggaacttgggaacaatctgtacatacgtgacggctgatccaggccccacagtcttggcggtggcccgggccagccctgcctggtggttgtcatcgtgtagaactgggacgcacacactggggagtggtcagcacgtgggaatatccttgcaccattatgaaggggcagttgccgagtatcttgagtacccgaagaattcatttatccatctcataagcccccagtcagtggtttgagaaagattttatgaagaatactggagcctggggagcagagttcttttgctttgtttcctggagctttggtaccatttgaagctcgcttcatttgtcagttactgaagcagcgcggcacggtgcggtgggctgagggtccagg

SEQ ID NO: 123657 - DNA, 1118 bp, Homo sapiens
gctgttgtggctcctcaggcttaagaagattaacaaggaaaaaaaaaaaaacaccatagcatgcatttctttctactcccatctagggtttggggttgcaagtttttagagaaaggaatttggcaagaaaagaatccagatgtaactgacagcaaagtgacacatggcaaagcaacatctctgctcttaggcatacttgttcccagctactaattaactgacagaaacagaaacctttccctttaatatttgccactgtcaaggtcaaggatggaccttaatacatcaaaattgtacttactctctacttgttaaatacagatttaccctttactaacagttaaaaatgcaaaaaaaaaaaaaaactataaaaggcataagcaacttacctcgctccagaaccttctgtactttgatatggttagcacagaatccactgtacagtttaaagtggtccgcgtaataaaggaaagagcctccaagggaaaacagtaatttctagaagggcagaggggaaagtcaaatcagacatggtttaatcaatgcgtgctggcttatggcatttgacggccccatggcttctgtcagattccatagcactaatgccttggagaagttcaaacctgctccatccacacaggaggtggggaacagcccaggcgctcccctggcaggtatctagcttgactgcaaagtttccagcggcagagcctactgacagtgtgcaatccaaggacaagaaacaaagaaagttctacaaaaatacagctgacaaggtgggatataaacaatctgagagaggttcactaataaagccgactctgcattgcttggggagagtgatgctgtctgtatggttccaggtccccttggaggggcttcctgccacactgcggcttacacggatgctatggagcactggtgcttcatagaagagagggcttgagcccagcaattagaaacctattctcttaatcccagatccacatgaccacggggaagaaggattgggcacagggtaggagctctggtttcagaagcaaccaccttggatatccttcacagcagctgagaaaagagcacgtacgtggtcaacaaccaggcgggaggtgctgctg

SEQ ID NO: 123658 - DNA, 1069 bp, Homo sapiens
tctgtctgtctgtcttcccctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtacaagctttcttttaatatatactgtatagatagttatgacatgtttagtataaacagcatctattacaatctatcttacaaaaatgaagtatctgcacattttgcccctaaaccacattaaaataacttaaatatgctttaaataaagcaaaaactaacaaacagctgaaagaaaatgcccagaggattttaaaaaatggccctttgaaaactattaatcacgacttccccagccttactttttccacataacttaattattagaatgtaattttaaggatcctaaatcatttgatacctgctcaaagtggatataaactaagtaatttacagattctgaccagtttcatctaggtttctgatccacaataaattaaaataacttaaatctttacaaccattttgtgggaaaatgtatactgcacaaaacccaggaatgaacagtttttttttttttttttttttgcaatttccactttaccaccagtttaaaagtaaaatgaggaatttaacccatatctggattgaatcatactatgattttccgtggctctctgtttcataaaaacactcctcactgacaacagatgttaaactctggacactgaattctcgctc

SEQ ID NO: 123659 - DNA, 1052 bp, Homo sapiens
cattgcctatatttaaagtataaactttgcatagctacaaacattgattctctaagacattagatcctagactatctggattgtgctgttctgtttttgttcataatctgaaaatgtaaatcttaccattttagaaaaggatttccctaggattttaagttcttaagagtcagacttatctgtagacatcagtgtgcctaggattcacctgctatcatacagtttcttttctgttttccaaacttagaccaaaatagaacaaaagttaaagtttctagaaaaaaaatcaagcacatgtttacagttttgtaatagctgctttcaagtttaggttttagcatttcggactccagccagcttgctaaattactgcctctggaccattttcagcttagggattcttcaagtgtggggttgctggaacattttctaacagcatctgcttgctcacttttctctctccctctctctttctttctactttgactgaataacctttgttgtcaatctatgttcagcttaccaattataatccttttcttcccattaactgatatattttataactttcagtatatttcagacatgaagacagtttgttcatcatgattaacaagtactggcagtgatcaattacagacagccaaaatcagtgtaaacaatatgacgtgtcatttaattagcatagtgcttgcttactgttgaatattggattcaaatgcttttttttctgcatagagaacttatgtagaaagaatttgttctccaaatgaaggtcactttctgctcatacaaatatactggcattttagctgcattgcgctttaccctccagccacgagtataataccgtttgtggcctgttctctcaaaatttctatctcgtagagaataaaggcacactttgttccagcagctgtggtggtggtggtagagaaatactgtgaaggcaagcagaagcagaggggaggggtcgcatgtaaacacttacatggtctacagtgaaaactctctcatggtcccaaaacacagtgcacacagaacagaaccca

SEQ ID NO: 123660 - DNA, 1032 bp, Homo sapiens
gaactgtcagatccagaaagtttgctatgatctcctttgtgtaccacactgtcgagattaaactagagattcctgcagacatgaaacagactcctccagcaaaggaagcatggctcttggtttctctgtcccctcctaagcgagtacatttcattcctactgtggaagtgcagatccccaaagcagacagaacacacgccaggaccatggtggctctcgcagcctgcacgtggatggggagggacagaatggagtgtttcagggcacagctgaacatcccagtgctgtaccacgtacagtccatccagagcccgtgcagctgtacaatggctgttatgatgttggagtccacatccacattcaccttccagttgggcagcagagtggctgtgagcactccagagaccccagataaggccaggatgaaagcaaggagctggagtcctgctgaggccatgatgttactgttaagtctgtcctcttagaaaatcctgatgtttaacaatgatggctgtcagaattctatctatttctgtgcagtagagaaccaaataacaaagcctaaggaaaaaaggcaaaaccaggattgagcgaaagaaagtaagtaaacaaaaggcttccctttagagtaggagccaagaacacatctgagtatcccccttctccagcccccaagcagatgaggatgctgtaggctggaggagaaaagctcccaccaggccttgaagactggtctgagtgatatgcatgggtggtgttgatacagggcataaagaaagcagttgcccacttaattctttttaaaactcaacatatgctgaaactgtagcgtggacatgtacgttgttaggagatttagacatttgaaattccagctatagtatctgataaagaattttaatagcattataggtttttcaaatgattttattttttatttttattttttttgagatggagtctcactctgtcacccaggctggagtgcagtggagcgatcttggctcactgcaagctccacctcctgggttc

SEQ ID NO: 123661 - DNA, 1028 bp, Homo sapiens
gcttgctgagaatgatggtttccagcttcgtccatgtccctacaaagtagttttgtttttaaaagaacattccctctgaaatactcattaattttcttttacagtcagtgattagagattttgccaaaatgtttttcaatgtctttgctcatcattgcatattgcattccactaattgtctttcctccttccttaaatatatccttttgtaattattttggtgaagtagttacatttctgttttcttttgtttggagatatctgtattttgccttcacctttgaataataatttcactacggacaaaattctcaatggatacttatggttccccagcacttcgaagatattatttcattatcatctggtttctgtggatgcttttgagaaggcagctgccagatatacttctgtttatttgcaggtaattgaccttttcctctctggttgctttaagttcttttatttaacaatgatgcttctggatttgaaattttccttcctccccctccccactccccaccgccttgcttcctttcttttcctttctgttctttttgttttctcttctttctctcctctcttctcttcttcttttcttttccacattttttttggcatctctctttctcagatattattctagataaactttaggatatttacccttccaaaaaatctacagagaatttaaaatttgactggaatttcacttgactgttaattaattagggacaaatttgtaactttagtatgtttaatatttctatttagaaacgtgctatttctatccatttaataatgtctgcctatgaattgcatgtttatttatcaaatcgtgttgcataattcttgttaaatgaacttacaggtttgccagatttttgtttctgttttgaagaactatttcattttttaaattccacattttctatttggtcattgctgcattaaagaaacctattgacttctgtatttttttgtgtctggataggtttgattctacatagtatgcagggaagtagcat

SEQ ID NO: 123662 - DNA, 1052 bp, Homo sapiens
gtgaagagaattttttttttttttttttttttgagaatgaaatgtttcccatcgtagtgatcttatccacgttctcccacatatggggcatattagccggatgtcttttggcacaattgttacacgtttggcatagacagcacacaagttaatgtcttcagcaaggcatcgcttgactcctgcaaagcaccaatagttgcggtctggaagcgcagatctgttttaaagtcctgagcaatttctcacaccagatgctgggaaggaagtttgtgaaacaggaattcctggacttcagatgacgtctgatttcccggagtgccacagtaccggacctgggacgatgaggttccttcacccctccggtagagggcgcactctgcgagcggcttttgcagccagtggcttcctgggcgctttacatcggtggccttgtgggcagtccgctttgtgggagagcaggtgtggagacctcctggctctagccccatctccttcatggagtgcacagaggtagaggaggcactggtattagcgaaggtggggcgagagaggctccttttgcagttttaattaagcattttatatgattccattttctttcctttttctgcatatcaattataccttttttaaaaaattgggttgcctggccgggcgcggtggctcatgcttgtaatcccagcactttgggaggccgaggcgggtggatcacgaggtcaggagatggagaccacggtgaaaccccatctctactaaaaatacaaaaaaaattggtcgggcgtggtggcgggcgcctgtagtcccagctactagagaggctgaggcaggagaatggcgtgaacctgggaggtggagcttgcagtgagccgagatcgcgccactgcactccagcctgggcgacagagccagactccatgtcaaaaaaaaaaaaaaaaaatttggttgcctgagagctcacaatgtacgtatacaattaatctaagttcactttcaaataacactatattgcatcaggagtaatgcaaatatctttttaaaaatttatttatgta

SEQ ID NO: 123663 - DNA, 1025 bp, Homo sapiens
gcacccgccccaaagagaatgtttacataactctttttgaaggcaccttaaacacgtatgtaggtttgtcagtgtatttccaaaggaatatgtccacgtattcccaaaggagcatttttcttacatgcacttggatgtcctctgtggagtatgtacagtggtgttttctgcgccaactttcacatgaacatttaactcttggtgccagaacagcgacagctatgggttagctcgtatcttcataaatctatatgacacctttcatcatgtttcagagcttcgtgtgcacagttaaccctctcgatatacattcatttcaaagagatgtggaacgaaactaaaatattatagacattatatttaataaatataacttcaataataatataaaacagtcaactctagtcctaatgtagaaatgttccatactttgttctcttaaaaattggtgtctattaacattttataatgtttttaatatttgcattgttattaatgttttcaatatgtgcattgtcccctagtaacattttaaaaagcaagacttcttaaccttaggcaatgacccacttgtactagtgtggactcagttttcattgagagaaagcatttaaaacctggcagaaacaatacttacggttttggtagagtatagttttccaaaattatttcattcttcagctttccataaaaactattttagttcatttccactgcagcagtggttatttgtttgaccaagtgtaaatatgttacatgactaaatagaaaaggattgatgggaaaactggtgactaattggggtcggggggagggaatcaggtgcacacccaagggtcattatagagtgtagaaacaacaaattgcaattctacgcaaacaactggaaaacgggatatatcatcgtgtgttagagagaataacagaaccataagatgaattcgtgccaaatcattcatcagtttttgccaagagaatactacatctttgttagtgtgcctttttgacattttttcctggatttt

SEQ ID NO: 123664 - DNA, 1924 bp, Homo sapiens
ctgaatttaacaaataatcttgtgaatcctaggctgaacactgctgtccactgctttcagatctttagttattggagttttgcttttaaggataatagatttttctattcttaatagaaaacttgtgatttcaacttgtttttgattcacacgaggaaaaacattatagagaagaatcatggaaataaacccacgtaattaattttaaaaaggtttgctttgtcagcctgcttttaaaggagcagtttaaaattcacatcttcgtaaactagagacgaatgaagttagaggcagatgtaggaccatgttactttagagtatttttttcttaatggtaccaatcattttcagtattttgttttcttgtaatgagaatgaatccattatgtccctatgacccttgggaataggctttttttttttttttttttttttttttttgttgaggttgggggaaatatggacatgcgacctagattcaggaatttcttttaagtaccttaccgtgtaacatgtggaatgtgtcttttttacaatccttttttttcttttctttttggaagttagtattatttagtattagttgttgtaattatactaagaaacagtcatttgtccaaaatattaaattactgcctgactgtaggtcatgaaatgctattaaatcacattgttaaatgatgaaatattttggcttttaatatgtttttagtttcatttttgatttcaggaaatagtttctattgggtggcaaatgttttcgtaattgggacaaaacgtgtatatattataggagaagggtctttttaaaaagtgaaataagccatttgacgattcagtttattactagatttttgtaagatgagtattcagatggagcagtctcaaaaggaatattgaggtctactcacgcacataggttttatgatgtccacatttctactgaattccataaatgcagttttaacttttagttttataaaacgtagtacaatgtattaagaaaagggccttatttaccattagaagaaaagtgattagctagcatgcgaagcaggaagctacaaactggttcctgattaccttaaaatgtgtgtgagatacattatttgataaaatcactcccagttaaattttagggtgtctgatattttaaatcttgtaaacaaatttttgtggcctaaatttatatatttgccaaagtatggatggctgtgtatagttagaaaaggtggacttagtaactgtggctaatggaaagggcctatcatttaaaaaacaggaaaagaaaatataacaaatgtctgcagttttgttttctgaatcatctgggatgaaattatgcatggcttaaaatcgttttcattgggagtcctgatttttgtggtacatacttttgacaatattttggtagttttttttttttagtggtagccactctttaagacagctatcacttaggtttatgtttatattaatactacatcagtaagtatatgctagggactagcacatccttaccttgaatctataatgaggaaccttaacccctctttgctttggctctgcttgtctatatttagtcatgaatttttggcaaggctttttatacttgttccatttttctcaatgtcatagtgtatcagaagtgtgttatggatgtggaaataatgcagatcacacttggacacttttactaatatacttaacctctgaatgtcattttcctttactgaaattgaagaaaataacgtctttattctgatatttaaaaaaaaaaaacattaattctgatttgagaactgattttaaaaatgtaagacaatgtagaggaagacttaatataagctcatttgatcgttttattagacacagataccttttaaagagaataggtgtaatagaatgcggttgagttttcagt

SEQ ID NO: 123665 - DNA, 1984 bp, Homo sapiens
ttgtattttctcatgaataaggaattaaaatgagttagaggcaattctctattagttaatttaacaagttacttagcagcctatcggtctttcagagcaaataggtttatatttgaagcttagttctaatccataccatggcagttttcaaatttcctgatatgtttttaccttgtccagtgttaggaaaagtaagttattgagcaattctaaaatgtttactgtagtttgcctgttttttaagcagtcatatttttaactggtgaggaaataaattcagaagatttataattgaagaatttaattttcctaccatcagtaaacatttagtgacgttggtgtaggggcactgtaccacagaagtagatatccagaaaatatttgtaaattgttaaacattgtattaattgttgagcatagagtgatgtccttagattactgagtaaacagtggtgattaaattaattaagatagtttgtggggtgtttaaattttacttagtattccatttaattagaaatacagacaataactctggcctcataagcaatctgaattttgagttgaaggaaatgggtgtctggcagacaatttccaaattggtaaaatggatcttttgcttctactttattttcttcatgtattaaacaagtatttattattgttgactgttggaaaattttaaaaattacagtcatactttttatgactttgctgggtgtggaaatcatccctttccccccatcttagtgccaactgcctttaacctgaattggctgatgcagaacgcatttcaggaaggcgccatgcatacaggaggcagagacatgccctctgcaatcctgacttttcctctttcacccatgtctattgtatatggcaagactctgtccttcctcctccactctgatattggtcggagacacaagcacttagaagcaccagtgttttattctacaattaattactgaagagggaaattgaaaggtaagcagttttgtgttttatcttttattatgcattaagtttctgtaattttccatattgctatattattagtgagaaagagaagaatagagaaagatggagaagatgaattttatttaagacagttatatttggataacttaaaagaatatgcttttttagtctaaataccctttcccagtctaagtagtttcatgcttcatggaaaaactaatgcaaagaagttgtaatcagctgttaagatatttgagccagctggctgtcaatatgttgaagttttattcttggtgcatccacaaattccatataaatgtattttatgaagaggaaggtgtactagcatggctaaactggtaaagctgaaatctggatttgatttgcatatgtggtatttttcagggactctcaaactttcacacatgaaataaacgaggtaatgtgtatggcatcacatgatcaaaatatttttccccttgctgctgccagagctatctattgcttttcaacagtctcacttgttgggcatcatgccaagatgtttaagacaaccccttacgtgagctgttccattcttaacctctttgactgaagtgccgtgaccttcacatatgtagattagccatgtgctctgtgaattgaaacttgctgcctcaggaagaaaagggtttttctttttattccactgggaatttgacggccattcatccctgacctgggcagaggtaatgcaaggaaattggattcaaacggaacacggacagataacacagggaggcagtcagcgtgtacaggcaggcaagctttctacctggtccagggtgaaaatacccaccgtctgttcacaatgtgctgatgtgcaggatccgaagagcaactgacagatggagatagagagataaatgtaggaattctggaaccgtgtccttttaaaaaaggacattgttattatgggcattgctaattcgttttgactctcctctttctcttcctttccaaa

SEQ ID NO: 123666 - DNA, 1032 bp, Homo sapiens
gccatgttacatgatggtaccaggagtcagccctgaggcagatgaactccaaagcctgtgctgccctcgctccttgttgagggtggagaatatttcactacctttgtagactgaggggaagattatttacaaatatttccagaagattagttttgtaatatattgaactaccagtatattttggatgcctttgatctctttggtaaactggattgtcaccttgatgtagtgagtcagctggcttggtggaggcatctctgagtgtctggagaaacttcatagagattattgcatttggggagttagttttggtcattgccacttgtgtggcgaaaatcttgggttaaagcatggtcagcatgagtaaatgttgttaattgtacattttctctttaccccctctgaaaccttatgtttgagagctgtcattcaggattggatactaaaaaacttggcagttgtgaaatagttttctctctgtgtgtataggttattctctgatgttaaaatggctaatgctgcacaggtgtgtatttcctaccatatatttataaaaaaaccactctttaaatttcaactcgtgtacatgtcccatctcaagtctcaagtattacagactgtaggtcagattccctcatgatatgtggaacctcaaagggaaatcaattgttttgctgttgtagtgaaatactaagtattgaataattaataatataaaataattcatcaaataatttctaggtgccaagcactgtgctaagaactctatatgcattttctgtgaggtaggttctattactgtactcatttgaggcacacatctagcgagtggcacagctgcagtttgcactcaggcattctgaccccattgccttttcatatatgctgtattgcctctcaggagggactggaatgagtagagttggacaagtggtctgaatttacattgtgaaaggtggcgttatgatagattttttttattgcttgcttgcgcattcacatcagttgatatatatatatttggacacggag

SEQ ID NO: 123667 - DNA, 1047 bp, Homo sapiens
aattctctgcctcagccttctgagtagctaggattataggtgcccgccaccaggtctgggtaattttttgtatttttagtagggacggggtttcatcatcttggctgggctggtcttgaaactcctgacttcatgatcacccacctcgccctcccaaagtgctgggattacaggtgtgagccaccgcacccggcctcatcattgtttttgaaactatctttgatagtacaaatgtattgcagttatctaaactttaaaaataatgaaaaaccattaaaaccacattataaacaaggaaagattttttcctctgcttgaagcatctatccaggttctgccatattgtctaaggatggtaagagcagggtggggtctgtgtttttgctttttttttagtagtagagaaaaggctgtttggaaccaaacatgtggaaggctgttttacttcactttgttttatatccactgaaaataaatgtaagtttagttagtgttttttttcttccacgatgtttgaaggaaagtccttgatttctgtctgtgttgcagtttgaactttaacctgtggcctggtagttgaaatggattgtgcattttggtgtggaaaaaaaatcgaattgctttctcgaaattgactaaaatgttttaactcttcatagcaaatgaggcgtgaaacaaattgtcaaaagcatggagacaaaattattgcagtactgaatgtttaactggttggtgctgttctatcgaaggtgtgagccaagcagataaatgtgtaaacggcacctttctccttctctcctacccaatttttcacagcttgtcttcacgaggagacctccatctatgtcagaaaaatcacagcccttctgaaagtgttagattatagtgttgctatgaggaataattaggaagtcctgtaggctatggattagaagaaataaacttcctgtttgcaaacattttatttcacatcatcattagatgaagcaaaaatacattttttagtgtctctgaaagcttgatgatatgtaaaggatgttagttatt

SEQ ID NO: 123668 - DNA, 1079 bp, Homo sapiens
ttgttcgcattggttgtgctgtgtgtaaatcacctatagtgtgccgagggcacaggaggtgctcattaaatgttgtctgttgttgctgtatttgtgccttgatatttctgcatctctctctctctcttatttgaaacagggtcttcctttgtcgctcaggctggtgtgtggtggcatgatcacagctcattgcagcctcaacctcccaggctcaagtgatcctctgtcctcagcctcatgagtagctgggactacaggcatgtgccaccacacctggctaatttttgtattttttggttttgctatgttgcccaggctgatttctttttttaattattatctaccttaaatgaagaattccccatgaatccttccatttcttcaagaaagaagtggttactctcccctgaactcataggacagtggcatttataagcctctgtcctatagtatttataagcttatttttgcagtgtattatttgtatacatcttttgtttcttctgtttcttaaagtcaaggaccttcttatacctctgcttatctttttcatagtgccttgtacattaatattttttcagtttaaacaatgttgaatgaacaaataaatgaatgggcatggcctctgaggtaatgtgtttcctctttcatctaaatctttgtttctcaatcctttctaactcatgccttcttttgaaaatgtaagtttccttacaccccttccacctttcagtatctcctcccaaaagaccaggcccgcagcccccatctcccttgatgggacaagctcgacttttcctacagatcctcaacagttgagattattttatcaagctccactttcatgtggtatgttataaaaaaaaaaaaaaaagctttcctcctttcttttccaaatagaaaattataatcctgggtgtgtgtgtgtgtgtgtgtgtgtgtgtgtgtgtgtgtgtgtgtatgtatatacatacgtatgtatatacatatatatacacatacgtatgtatatacatatatatatacacatacgtatgtatatacatatatatatacacacatacgtatgtatatacata

SEQ ID NO: 123669 - DNA, 1477 bp, Homo sapiens
gcctgggtaacagtgaaaatggaatgcatttttacatttttatgtcatcctggttcatgttttcctgtgttctgctttaaaaaacattgcccaggcaggtttgagttcaaccaagttaagtaagttttttctatataggacattttagacttttctcatgttaatatatgttatgaatcttgaagaatggtgtgcgctttatacacatttaccattcttaattacaataacatctattcatatactttgggaaatactgtttttagaatactagaaatagtgacattatagtatggaaattaaaaaatgcctatgtttggagcattatagtttgaattcagaagtcacttggaataggagatggatgtctttccagcagtcacataccaaacatttattaaatgcctgttataagtcagacagcatatcgattttcataattttattacttatacttgacacagctaggaagacagtacaatattgtttagaaaaggatggcttggagagaggtaagggttaaaagatgcacttgggtttctttaattttgtttttttattaaagaaataatagcaataatggttgtccattgggtgtcagaagttggggctataaggaaaattagggtgaggaaaaaacatatctggccttaaagaacttactgtctgataaaggaggcagagataaacaatgagttgcagttgatggtgataaattgagtatctgttaaataagagagctgtggggaacggtggagccttgtgaaggcaggctgctggactcactggtatttccccaggctggaagtgcgtcttccgtttacagggcagccacagctgtgctgggtacagagtgttctagaaatgggtttggagttgtgtgctcaggcatcggcttggtggtgcataagagggctgtccaggtacagggcgggctgaggcctgataggtcgctgggcctgtcaccttgaggctaaccttgtttgtttgaatttgtccttctggagtttggatttttcggacccctttatgtcctctttcttacttttgatcttcaaggaagtttattgataagatttctgatcaaagaatggggcagaaaggagaagtgtctctaacagtccacattctttttgataccacagcataatcagaaggtctggcagggagggagaagggaagattctagaattatcgcacgttagaacaataaggaacttcatcccatttgccctttaattaaaaaaaaaaaagaaaaaaaaaggccgggcatggtgccttacacctgtaattccagcactttgggaggctgaggtgggtggatcacctgaggtcaagagttcagaccagcctgggcaaaaccctgtctctactaaaaatacaaaaaaaaattagccaggcgtggtgggcaggagaatcacttgaatccgggaggtggagattgcagtgatctgagattgcatcactgcactccagc

SEQ ID NO: 123670 - DNA, 1153 bp, Homo sapiens
tttgcggttgaaggaattgggctgaaaaaagtagtaaaatatgatatgcataaagatgtatctaataaactgtgttcttaatttgatatttaggagcaaatacaattagatatcttttactataaatgcatgtgtagggatactctgaaagcctgataacagagtatctaaatataaaaaggataaagtatatttaaagtatactaaaagtatataagcaagttgtcctttaacttggatcatcttgaaaaggacagttggattcccagcccagcctctgaaagcctatctgacatgtaatatagctgaattgtgctacccaatatgcttagaagaatctatatacaaacatttcttaaaaatagacaatgtatttcttccttagagagagagagaataactcctacttacatgtacatccaaaagtttactttgaataaggaggaggaaagtcttatcaagtaaaaaaattgcattaaaagccaagtaactaaaaccagactggttaggttaagagctctttgaaaatggtggtgtatatattgtggccttcacagcacttgtcttattttctggaattgaaactcaagctacagcagttgtggaatgccatctagaaatgaaaacatgctcggacaatctatttagagaagttgttgagggctgttttcgatgtggatgataaccctgatagagcataaactttcagtgagaaatgaaaatggtcatacccggatagatgttaaaaaaacataaaattggccaggcgcagcggctcacgcctgtaatcccagcactttgggaggtcgaggcaggcgaatcacttgaggtcaggagttcgagaccagccttgccaacaaggcaaaatcctgtctctacaaaaaatacaaaaataagctgggtgtggtggtatgtgcctgtaatcccagctacttgggaggctgagacatgagaatcacttgaacccgggaggtggaggttgcagtgagctgagattgtgccactgcactccagtctgggtgacagagcgagaccctgtctcagaaaacaaaacaaaacaaaaaacataaaattgcttcaggttagatgtgcgtatgagaagcagcttggcccttttgttttccagaagtcttagatttgatttttttttttt

SEQ ID NO: 123671 - DNA, 1061 bp, Homo sapiens
ggcagacccagtgagacaccctcttctcaccttgccttggtgctttgtcccttcaggacatctgctgtgttgcactgtgacctgtttagtctgtctccttcagtgaatctccaggacatggaggctcgttcatccttctgcttccagtgttgggcacaacgcacatagtaggtgcttagtaaatgtgtggtgaatggattcaccaaatctttaaagtgaacaccagagtattgaggaaggcagagaaggggaaggacccgtgcagccttggagtgggagtgccagtggaagagaggactggcagttctcggggtctgtgctcctgccttccatcttcacctcccctccgtccctcctcttccagcctcagccctcacctctgcagcgagactgtccttgccgagcacagcagtggcctccttgtcaagtatagcagaagcctttacccttcacctgactgcattcctgggctgcatttggcacacctgtttcgttgctacacctgactcccttccctcctgtaagagcacactctccagagtgtctacattttctggccattcttccagcttgtctgtgggttcattttcccttttcccttaagcggtgatattctctaggattctgttcgctacccattgttttcctttcatatattcctcctaaataaagttcatgggttttattgcttcctattgattaattcatcaattaatgtgctgggtacactgttcaacttatgccctggagatataatagtgaataaaatagagaaaatccctgccctctgggagtggatgtcctctctgctgacttctctacctatttttccaggtcaggccttactccccaagctgcagctcattatgtctcttccttctgggcattttcacctggatttcatatcagagcctcaagtttcctatgtaaaccactgaaggctcccactcctggggatatggtgattggcttctccctctgcacactccatctcatttggctgctggcttccatcactcatttggtctccaaatcctgccgcatttcccttctaactgtgc

SEQ ID NO: 123672 - DNA, 1014 bp, Homo sapiens
caccatgttggtcaggctggtctcaaattcctgacctcaactgatctgcccgtcttggcctcccaaagtgctgggattacaggcatgagtcaccatgcccggcctctttttttttttttttttcaagagacagggtcccactgtgttacccagactggagtggagtggtgtgatcatagctcactgcagcctcgaactcctggggtcaagtgatcttcttgccttagcctgaacagctcggactataggtgcctgccaccacgcctggctaagtttttaatttgttgtagagacagggtcttgtgatgttgccaggatggtcttgaatttaccctgctaattcttaagccttcctgaaagtccccatgtacttacctcagtgtgaacgcagcatctggcacacagttgggatcagtatgtggttttggaaggacagaggagggaaggaaggagctgctgggtgaatgctgcctgctactgtagcaccgggtgagggcctttctacctattgctttgttcctttgacgtcccaggacatgaagggctgaggctccacgcctagccctcctgtatgacctcggccctgaagcccagggcctgactcaccaaaccaaaaataaaattcaacatctacttgtgaactggttgtgtttggtaagatgctgacttacatggggagaggtgctgtgactcatagtctgagtgctcatccctacacactgctggtctctgaacaaaatctttaccctggacatatgcatgatctaaaatctatcttttcactttttaatgaacactcggttgcactaaggtttgatcaagacttgcagactcagttctaaaataaaatcattgttctaagaatactttgaaggcagaaaatgttaatcactcaataccctctgctcttattactagtaagctaaaaggaggtgggtgagcttaactatcatgctcttttcctgtacgcataatagaattttagatgcaaatgttttctctctgcttatggtc

SEQ ID NO: 123673 - DNA, 1052 bp, Homo sapiens
tttattaactggaactagatttgtggtctttcacttgccagttctcccacatcatcaggcaaatacatggctaaacagattagttttgcacggtgccctaaaaactagtctacttgggtttttgttgagttcaggggggaaatgaattttctatgcctctgtggagaatattctgcctccaggcttctggaattcagacatggggttggttaacagaagtacattggttgatttcatctattagacagctacacagaagaggcataatttttaaggttactagaatctgactctgagtttttcagattaaaaaaaaaacaaaccttaaagacaccaagatattctttgctggatcaggaatgcaggttttgtttcatttttcttatccttcgtgatcataaatgtacacctaggcctttaccaacttgttttaaataagattttaatataaaacggcacccaggagaaatagcttacagaagctgagttatttatttgtgtcaagcagatttcaattatgtagactgagatttttcctgagtttttttttgtaattgggttgatattttaactattcttgcaggtgtttgataatatgatgcctgttggaattataaaacagggcaaaaggaaaaaaagcaaaatgagagattgaagttcatgagtgcttttatgatgggaaaacatgacttttttagtttttaaaggcatacatgtattgcgaagaactttatagcaggaacatagaatatgatcattgttttgaaatagaaaatggcaaaattaaatataaactaattatttttgttaaggtgattcatctgaacttattacttcatattgaagtaaaaacaattcaaaacaggtttccttgaagagggcttgaaaaagatttgtattctaattttgctgcatgttttttgagtaaaatatttatttcagaacataagcattttatttggtaccctcttaacagccaaaacacttcttccaatgcaaatgtttattttggcagcagatgtttctaaaaaggagacaaacattacaattgt

SEQ ID NO: 123674 - DNA, 1962 bp, Homo sapiens
ccaaagaaacattaagcatggtatttatgttaaaacgttaataattcaaataaaggtaacagtcgacgtcagtaaaatgaaccaaccatatcccttcagcgctccttggaaaacaaacactgaacaacaacggaaatcccacaagataaatggaaagttaaagtgattaagtgacgtatcttagacaagtggttctcaaactttgctgaatgttagagtctcccggggcattaagaaaatccccccacggatgcccaaggatgcccatatcaatgacacctgactgtgaaggccctaatctcccgtgactgccctgtgagtcagggtattagagggaggctacgtgggcaagcgggggcagctcacaccttctggagacttggtagtgatgctggttcttggcccactcggtgaatcagaaactcaccactgacccaaaggaatgaaatgggcccagaaccaggagctgggatggttgagtccttgcctgttaaagtctaatctgtgtgtgatactgggaaaatctggatctcactgtgctcctctgccagatgagggggttggactataagacctctcagcttggatttcccctttaaagtaatattaagtgaatgtcttttcatttcagtattagatttttgtttgtttgtttgacatggggtcctgctgtgtcacccaggatggagtgcagtggcacgatcacggctcactgcagccttgacctcctgggctcaggtgattctctcacctcagcctcctgagtagctgggactacaggtacatgccaccacacccagctaatttttaatatttttgtagagacagggttttgccatgtagcccaggctggttttgaacttcaggactcaagcgatccacttgccttggcctccaaagtgctaggattacaggcatgagccaccatacccagcctcagcattagattttaaagtcttgttatttcagcagtcttgtgaaatgtatgggttgatgcttgacaaattgtattaagataactactgacccacattctttttaaaagagaaagaggtgtttctttcttcttcaaagattagcaaattgttggtatcagtctaataaattattttctaattcttaattttattgttttttaaatgaatgtattctcatgtaagtctttgttctgcaagaacctggtatgtgttagatgtgtagagtgcagtctgtcctttttgataagtagaaaatcttaaggttgacattcttggaatcacaaaaggaagcaaagagagatctagcaattactcatttttaagacattgctactttctaagtagttctgaaaacaagtatatattgaacaacattgggacagattatataaagtgaagtccggatggaaacacgtttcaagatttatgttctgtgcattaccttaactctttaactctcatgaggtaggctagatggctttgtttttgtattttaaaaaggttttttttctaaaggtaaaaagtttttcttttatgttaatagccagccaatagttaaattcttaatggcaaaaaattctttatggcagtttgattatttttacatgtaataaatttattaaagctatttgcccttattataattttgaaaaggaactttaaaagttaaatctgtagttgtgaatgaaattaagaaaactcttaagctgagagggtgcagaggaagaagatgggtgggagcatgtgaggcaagtaggggattataaagaagcagcagctttataatctggctctcctccgcagagccagagagccttgcttaatccaggcttcctcaggcctcgagagcaactctgcagttggactcaagtttagaaatgtttgggacgtcctggatttgagatctgaatgtgggtagtgtgcgtgtataacacaaacatcccttgcctgcttaaatagccccaatccaaaattttggtcacta

SEQ ID NO: 123675 - DNA, 1029 bp, Homo sapiens
ctgaaagcaagagctcttaaaacgctctaagtcaccgaagcctgtcggtgggaatgggaggatgggggagggatagcattaggagaaatacctaatgtaaatgatgagttgatgggtgcagcaaaccaacatggcacatgtatacctatgtaacaaacctgcatgttgtacacaggtaccctagaacttaaagtataataataataataataataataaacaaaaaaaaccgctctaagtaaggattagatgtttctttataatcagtatcataatcattgtttccaaagagaactgggaaaaggtaaagcccagaataattattggcctatgggatctgtgacctcagatactctcttaaaagggtcagccaacaaggaggcttccctttttttcaattagtatattaccttgagatttccagtaggatcttcaggcatcccaatagtcattttccagacatcttaaggatttacatctctggaggttctcctcagtgtcctgggcttcatggagaaatagggcctgccttcttttcttcctacttgtgggtcctgtgccattcgttaggggtcatggagatgacaaggtcttactcttcagtaattggccaaaatttgatggttagtgtcttagtttcttttctgttgctgtaaaaaaaatcacagactgggtaatttataaagaaaggaaatttatttcttatagttctgaaggctgagaagttcaaaggcatggtgttggcctctggtgagggccttttgctgcttcacaacgtggtggaaggcatcacagggtgagagggtagtagcgtgctggctcagatctctcttcctcttcttataaagccttgagtcccattgtagggaacctcattctgatgaccttatctaattaattcctgaagtccctacctccagtcaacatatgaatttggagattaaattttcaacacatgaaatttaggggatacattcaaatcactgagcagttggggagaggaggaaagactagaatccccttcagctg

SEQ ID NO: 123676 - DNA, 1052 bp, Homo sapiens
acatggttatgagcatagaatcaagctttctccccttcttgcttccaaattttcctttcatctttgttctgctttggtgcttcgatggatcagttcagaaagccacagggctgccgcttacaggctggctggatcttgtttgattttttgttttgttttgtttaagaagagaaactgtttcttcatacttggagcaagcgctcaggcttccagagtgaagaaaattcctactctgtctgtgtatccagagaggatggaagtgcagtatgtctctaaacattgttttgataagtagactttttaaaattggtatatgatttctattaaccttactttcttctgtatcagagtgcatcatgcaattatagcacctctatggcagttaagtttatatataaagaattaacattttgctttgcagtctacattgctggtgacttttgcctttggaaataggaacttgccaaaaatctaaagtaatgttcaggcaatatactcaacactctgagtgtttgttctggtgtgtttaacctggtgaaggatgatagggaaataagtaaagaagtgaagttttgaataaaaactgactgccttgccctgtatttccttttccctctatcatctttccatattataacttttggttaaatcaactttcagtgtttatgttaatgtaactataaaataactgtctgtagttgagtcatggactgcaagtatatttccttactgtacaactttctgttatccaggagttgataactgcccattattttacgttttaagaaatgtatacatcaccagtttatcctcaagctctgatagaacggtgcacttcctctcaagatggtggaacccattagttacttagactctgagtgaacaatttttcatgttcatggatgaccatcatcttttgaatagccttcccgtgtctggggagatgtccacatgtaaaaagctctgtctccgtaatttaggagacatcttcagccggggatgcattcaggtggcttaagttcttttaattagaccagccatactggactttt

SEQ ID NO: 123677 - DNA, 1051 bp, Homo sapiens
ggattaaaaatgcatgaaagcacctttttgacaccgggctttctgaaacccagtgctgtctttttttgtaatactcctgtggatgtttttgcacaaagtggcacctgttagagctggaagtgttcttgcacggctgtctttgatctagtagccctggacaactttaagcacatagttactagatgcaggcccgcccagccccgggagagcatatctggcttgcacgtatttaaggtgatgtgcagaagagaactggaccaattgacaggctgcactgtacacaattactgtgtttcccatttgaattatcacttcatttctgaaaatggaaaagatgggacggaatgataggaagttttgagaatgctacaatatatgattaaattggagactctttttgactggacaatatgaatctgtatttttattattgcattttgggtgattttggacgccagtattcttatttaggattgaattctcacatgaaattgtgtaaatatttttctttttgaggacctatttctaaaattaagcggcttttttgaatttgtattttgaattcctaattttgtaggctatgccacttttaagacataagtgcctaaaaggatgaaaagtaatagaaagtagaatggggaagtggaaacactggaatcaccccttgcactgaacgcatagtaatttttaatgatcacagagtggctcttcgttgtaattagtgtaatttctcaaacaagcatttaatgtataggcagtttaagcatttttttctttctgaaaatatgttagactaatattctttcagaatttcttctgggaagaaagaattgtctatttaaattttactaaggttaccttttgaagaccactaacctggttgaagcagttaaacttgctatccgttctttgaaaccacattgagtgagaaaattaaaaaggaaaatggcttaaatattttccccttgacaggagaaatgataagtatttactgtaaagtgtccagataatgtaaaggaatatgaaagtcacaaaaattcccccatcatct

SEQ ID NO: 123678 - DNA, 1186 bp, Homo sapiens
gataacaagtggttgtatgaagggaacgaggtgcttcattaatctttgaaccttgcgtatttgtcccgtatttattaacagcattgggcagtgtttttgaatgttctgtgtggttatattatttattaccgtgggggaatgagccaggtctggctctttgaacactgctaatttacatgaagaaaatgtccccaaggaggagacttaactagggaaagactcagttaccttggcctctctctgtgtgtgccagagcccccctgcaagcactaggggctgcttctagaaaggggacccagatcttaagacttcgaggaggaagataccctatttgttctccaagaccattcagtcgtgaagggttcaacttgttccgggttatttatttagcattctctattttctgctttgcttttgacactccaatgtttaattgtatatttaggaaataacaatgaagagtacgtttttaaaaagaagaatgttttctggaagggatttccccccacttttggacagtgagttagactccttctgaagcctctggatctaggttattacagggtttgtcttcttgaagctggaactgtccaactgttgtgctatttcagacctggcctgtctttcactttcaagctccagaaataatttatagctgtagggtgtcaggagtgggtttgaactgggcctgcccaacgtaacatggaattgtgcacagattgttaaaattactatttctgcattcaaatgactaagtacagtaaactttttactggcacagttaatttatttgaatatttattggtcgagtgcttcacgtagaagactaacataatgaaaaagcccagcacatactcagagctgatttggctttttaaaagattctaggcttgaatatagctagctaaatggtctttagcaaattgactggcagtaaattgatccctgtggactgtggcttgaatcagcctctcattctttaaaggtattatggagatattgttatctcagcgcaaggctggtctagaaaagggatgctttcagtacaaatacttgttacttacatatttccttcctaactgggtaaagttatatttctattctttacctctcgcaagagcatatagggacttcgaatcagaatattttgttcaattgtaatagccttcacaaatttagtttgttt

SEQ ID NO: 123679 - DNA, 1637 bp, Homo sapiens
tattgaaatgtgttgtgagactagatgaaagtctatgtaaaaatgaatttgaaatatttggatatattctttaaaacaatcttattgtgtgtttttattcagagccctagagttgtcctgaggatgagtattttcccaccgcgggcatgaaaatggatcctaatggtagacccagtcctctagggtggtcagtttgaggcccaagcttcctttccagggaggcagtggcttaacctgggtcaccctgtaggagcagtagctggaggctgcaggacaggtgcttttttctcctcccacgtgtgctttttgtggtggaagagggggcaaggtgtagaaatgtctgactctgattcctccatctgccagcacagcttctcttgttctctgtggtctcacctttatggcacagtactctttcctatttgtctttgagctctgaggctcagccctaacctcgaagagatggcttctgcatctgtcagatgggtctcatagtattacctgcctccatacgttttgtttttagttttgttttaagataaggccttgttctgttgcccggactggagtacagtggcacgaccacggctcactgcagcctaggactcctgtgttcaagtgatcctcccacctcagcctcctgaggagctgggaccacaggcatgtaccaccatgctggctaatttcattttttgtggagatggggtctcactatgttgcccagtctggtctcgaactcctgggctccagtgatcccccactttggcttctcacagtgctgggattacaggtatgagccacactgtgcccagccctccataaatttttgtgaggttaaatgaggtgatacttgtaaataatttaatgttttcactcactaaaaaacaaactttttttggtgagaacgttatgaatgttttcataaaacatgtcgttcttcagggagttgtgaattgtgacattaacaatttccttttatcaaccaaagctagctactagtacctgttcctaccccctcctctttctgtttttctggcagggggcactaaggaacgaacggaattgccagggtgagctggaatgagcttgaaaggctgttttccttggttttgagtgattattgacttgtacttggggactttctgtggaattcagaaaattaaggtttcttatgacccataacctgaggcagttcaggaagccctttggggctgtgaagcaggggtaggggcttgtcctggagcagagcacggaagattcaggtgtctgcttggttcctccaggctctgggatgttaagcttattaaatagcctctctagacccagggaacatgttgggtcagctttcaaaattgacaaaattgtctcaggactgaggaagtgtggcctgttccacagtgcttacagcctgctgctgtaaaccgtcgcggtgtgcccccgcacccatcccggccatcctgccacgcggaattgtgtccacctctagataccagctaacactgtgctatttgcttgttgtgtttgaatatatagggcacagatgaaacagtgaaagatttaggaaggttttattgagagttcatttcttttgcaaaaatgttacagcacattaactgctgtaattaccataaataatt

SEQ ID NO: 123680 - DNA, 1192 bp, Homo sapiens
tacttgatgtttagattttagttctttaaaaaaaaaaattctagtgtttacaggtgtgctgtagtgcacctgtgtaaaggaaacttaaagttgaattattttataatttatacaccagccttttatacagagcaatgcttatggcagcttctttctctgtgttaactggtattaaagcttttctagattaaaagccgtaggttgcaaaacatggttttttgcatgtgcagttatttctttaccactgagttgtccttccaagcctggtctaaatgtgcttgaaaatcaccatctgctccctgcagtttggagagggcacagaaagactaaggtgaaaagctgtcacttctaatgttttcattcagactttcacacccttcttgtctagttacataattgtatgcagcaggagttgtttcaaccatttggtcttgtccttattttgagagagagagagagattaattttaagagagttgggtcacagtactgaggcagatttgagaatctgataaaccatgaaagtgttcagaatggaatcttcctgctcagtcagtttgttagtggataagtccattgcataaatgacatgaatatgaacaaaagcacctatacttatgcatatatctccctttgcagaatatgctttaaattttgcagaatatgcttacaaatttttaatgccgtatgcttagattttactttttgaagtcagtatagcacagagttgatgatataatagtgctttacaattttatttgatgttcagaatttattatagataatatagaggaaggattttgaattgttcacataacttattttttcagtgtcttctttttttttttcttaaaaattgatctattttggttttgattggaatgaatggccacaataggatttgaaaatgaaacaggacagaagcctgttagtgtaaactggcaataatttctaatagtcaggaacaagaagaccattaaatcgtgggatttatgccattgaaaaggtagtaagataaaataagaatattactatactctagaactgtaaattttgatctttctgcgagttaattatctaacatccataccaagctggagacaatagctgactctttcatttacttggaggtgattgtaggagaagaaaaggatttcagtcttcagttggcaaaatgatggttctaacttgca

SEQ ID NO: 123681 - DNA, 1049 bp, Homo sapiens
tggtggtggggaggggggacaggcatgttcttgacaggggaaacagtttatccattgctttataatcctagactggcatggtgtgctgacgaagagtaacctggagaatgtgatagaagtctgggttaagaaactagaccaggccaggcgtggtggttcatgcctctaatcctagcactttgggaggctgatgccggtgaattgctggacacaggatttcgaggaattcgagagcagcctgggcaacatggcaaaaccctgtctctacaaaaaatacaaaaaaattagccaggcatggtggtgctagcctgtggtctcagctactcgggaggctgaggtaggaggattgcctgaaccctggaggcggaggttgcagtgagctgtgattgtactactgcactcaagcctgggtttcagagtgagaccctgtctcaaaaaataaaaaaataaaaaattaataaataaataagaaaccagaccagagacaggttgtgaatgtgaatggtcttatacaccttcccacggaacctgaactttatcatgctgaaatgggagccctttctctttgcttacaaagctttaataaggaggcagctatgaagtctgtactctagaaggctcattgctggtggtatggaaagtgggctagacagggagcctgaaaggaaggtgagtgacaagggagtgaccctgtagaccttgagatgtgcagaagcagtggggccaaaagggaggtaggactgacccaaagggcatttgtgagtttgaagtcaggcaaaggagggtttctgagatgattttccagtgtgcagcgtgggcatccaagtaggtgtcagtatagagttcaaggaatccaggaggaacaggtctaagggaagacagtgacgttgcttttgaacataatttgatttatggtaggtgtcttgaggaaacagaaatgttcagtggacagctggaaatatgggtcaggggagttgtggatggtgaagagagacatttgaggtttgggtctacagttactgtgtggctcagtggttctgttctgggct

SEQ ID NO: 123682 - DNA, 1027 bp, Homo sapiens
ttggttggatgaaagatgaattcttccctgtatgatgctgcacacagcttctgggcattttggatgggtgctgggcctctttgagtccttggcaaaatccatgtgcaaaattggatgtgtggagtgtggagagggaaggagagattccgttacttcttgggcctcactagttcgaacattccgtttccagacttgcaataccatcatctcaaaattgttctttgaaataactaaacaataattttcaacctataacagatgatttgttttgtatccttttttttcttcaagtagaaaatggaaaaattatgtctgtagaacacagtagactggaaatgacttgtgagaactagttttatattttcttaaaactaatcttctccctcatagcaaagccttatgtacttaaagtaattgaatggactgcagggtatactgggaattgtagttttccacttctttgtattctgaagattaataatcttgcagccctctgagtgggataaggagaggatgctctctgacaaattgttatcttgtctttcagaggtgtgcttcgggcagtgagtataccttccatgtctcccctgggctcttggcttgattctaagtaatggtaatatataggatggctttaaaattgtttttggcttatgatattttactttccactagctatctgtaatcttttcttttagcctagtttttaaaaagttgttatttgtatcaaggttatatgtgtaaatggtttacagagtccatgcttgtgtaagctgtgctgtcagtaacagtaggtactgcccgccttagcccatgcccacgtccccagaggcgtccactttcaacccttgtagctgctctttgaggataccttcatgtctagaatcacattcttacattgctccttgaagttttaggctttgtctgttgctgtccccgctggaagatgatgatttagtactcccttctcacttggccctcaccacaagcatgaccctttatcctctctcatcctcctagtgtagac

SEQ ID NO: 123683 - DNA, 1001 bp, Homo sapiens
gagcacccaccctcctgcaccctcagagagtgggcttttgactcgtggtaacaatgcaaccgcataatctcacctcacccccaattctttcatttgaaaaaaaaagaagaaacaatttcaaaggctgtatttaaaacctacacacgaatgagtaatttatatgcatttatcatgcaagtatacgatccccagggtggaaagtggcctgcagtgaatggtctcgctcctcctgttcccctacaaggctccccttccaaattggaagataccagttgcttgtctttttgttgactcttttaaaattctagtcctcttctggtaaatcctattttctgtaccctgtccccaccccatagttatctcaaagagaacagtcttttcaatcaagcattcactgcacatgtcccagtcatgcggttacaaagttgacattgcagcctcagcaaaggttatctctttaaaattttctgaaattcccctttggcacattcattttggcagctgggtttatataggaaagtggtaaagctcttggctcctctttttgtgctttataaaaatagaaatctctggccagaagggcagataagcaagaagctcctctgtaattcccatcacttctgcttcccgagtgttttctgttttacactgtagtaaatggtgtcctcaccatgtgcttgtggaccaagtgggtggtttttagaaacacgaacatactgtagcctgacacttattttaaagtcttattagaaaaccctgctgttctaacatgtgtgtgaagtactgttagactgtgttgacttttgattttgtaatccttttgcattaaaaacaatggaaaatctcaaagatgacattcacgaattcaaaattaccagttacagtctgggcaataatataacaagaaagagggaaaatccaaattgctttgtagtgagatgtactcattactaaataaatgataccacgagtgtgcttttcctgggacagcatttttggga

SEQ ID NO: 123684 - DNA, 1098 bp, Homo sapiens
actgcaaagatgcttgtgtgaaatatagtattagatatcaaatcaaacatatgggtgttgaacggaaggatgtgtgttgtagtggtatatggtattctagcatgtggagttgtattttatggaaattcgttggcttggcttatggcagggacataacattcattatgagatatcaagctgtaaaataaataaaagcaaaaaattcaactgtgctgttaaatggcttgcaatgcagacttttctgctccaacaacttaggctctgtgtgatgagaggcattgtgagccgttatggtcacatttaatctcatcctctttggtagatcttgaaaataatctggattggattgaaagaaatataggaactttaactttttcattttttccccttttaccccattgtatatgttaggaattactgtgctgatttttcttagaggctaaatgttttactcttttcatcttttaccatttcatctttttcctcattcagtatttctatagtggatttgggttttaagtgtgtatctggcactcattaatttcttaagtgtgtgtgcttatggggctcaagttcttgaagttctccagtggaccatattgtggtatgaaacaaaatgactttgccattcttgtctctagagtgctttttgctgtcctgatatcttgtttttcttttcctttcctgctctctcttgaaattacagaaaaaggcaatagatttctcattaagaaaatattcaaaaatactatccatggtatatttattgcatgaggaaggattttcctgtaaacaatgctttcaggcatttttaggctgatgtaaattagagatggagaagattgattgaggccatttttgtctatacctctggtatttgcactgtagtacaccttgctttacattgttacctgttttatcaactaagaaaatgccatccttagcaaaaatagtaaataaaattgataatttaactggtatatatgtgctgtaaatgccgttggtatattctgactttttcattctgaacttagaaacaaacatacacaagaaagcacccaaaccacaggccttctgtaaagtattagtgagttaatt

SEQ ID NO: 123685 - DNA, 1044 bp, Homo sapiens
acacacacacacagatttattataaggaattggctcatatgcttatggagttttgcatttccgaaacctgcagtatgggctggcaggtggtaagccgatggtctgatgaagtcaaagacagcttgctggagaattccttcttgcttaggtggggctggtcttttgattatagttaggacttcaaactaaatggataaggcccacccacattatggaaaacaatctgttattctcagagtctccgttgaaattgttaattccatttacagtaccttccaagatcacatgtaaaatcaaccattgcagctacctttccctgatgccactaaaatcattaactgaatttccttaggtatatggtgtttggggtcattttgggatttctgttattctccattggctcttctatgaatgcattagtattgtactgtttctctattatcttttagtatctgatggggtagtatatcctcattatccttctttttcagttgttggttttctttttccttttgctattcgtatgtgcttattttttcctataaactttttctttttttatcacgctattttctaagaattttatcttttgttattgttataatgggatcttctgtgaaacagggtacttagaaaagaataaagataagacacacagaagcactttacttgaatagctttttcctttttggagcccactgaccaaagatgagaaatatccctgtaataaaaagatgtgtttgtttagcttaggtggctgcaggccagggaggatgcagtcctgaggagccccaggagcactgtggaaagggggaggtggggctgtagtagggttggggtgtgtgttagatgactcttaagagggagtggcatcatgaggaggggtggtcctcaactggctgctctcaagaagctgggggtacttttgtgattaggtattttaatttttatctaggagacaggaggattgaagtggggcagggttgtcattggtaaagaagcaccagccacctcatgcctgtaatcccagcactttgggaggcc

SEQ ID NO: 123686 - DNA, 1032 bp, Homo sapiens
cccttttttaatttactgaaagaatttgtgttgttatctgttctctgaatgtttagtaaaactgtttataaagctataaagggttgtatagctctttatctttaccttttgtcttacccctgatttttcaacttttttagtagagatgttgaggtcttgctctactgcccaggctggtctctaactcttggcctcaagtgatcctcctaccttggcctcccaaagtgctgggattacaggcatgaactactgtgcccagccatttaaaatttttgatttcatttcttttgtcaatataggcatattcaagttaaaaatttcttcttgtgtgagtattgctatatatatattcctatgtataggaatttgtccatttcatataatttttcaactttattaacataaagttcgtaatagcctttattactttaatctctgtaccatccagagttaaggcattttaattcataatggtttttcttcttttattcttgataaaaccatttccaaagtgacttggtctttattgtctgtattgtgtgtccttgtaaacaaacttaatgaaattcttctctcaccttgattacgtcttgctttctactttattgatgtttattttgctgttcttcccccccgcccccactcaagtgaatgcttactttatttgaacattttttgtttgatgaagctaaatatgagactaaaattttttctcttaagtactgctttggctgaatctttcaacttttgatatgtatcatttttgttctcttttagttctaagaaatttcttgtttttctaaattgcttatttttttttgaagacatttttattgaggcctgggtttgcattctgtttcctcagaaggattgattggtctttgcttttgccaggtgcctatgggtaccagttatcttgaacaatgttttgtgtttgattttgtgaaagttttattacaagaagaatatacagatacacagaatgacataatgagcactcctatgccctcacgtagttttaatattaccaat

SEQ ID NO: 123687 - DNA, 1077 bp, Homo sapiens
gtttctcctccccaaaatttgtgccttgacctcttgaaaaacctgggtcaactgtcctgtggaatggctttatctgccagttttctcttgatgtggcttaacttgctcatctgtttcctgtacattgcaagttagatccacaggcttgaagataaacattttatttgcagtcgttgaaaatcatgttcccaacatcttaggcctgcccttgttcacaggatgggtctgtgatcctccttttgagcgaagagcctctaggtggttctagcccccacctttcttgtgaccatcagctacagctgaggctgaagagacattgtgatggacagataaagcttccctttgtaccctctccaaattgctcactaactacattggtgagcacaacacatgctggtgaccctaggccactgagtttggggtggttgttacccgtcatttctgactgacttggtctggatgcttcataggcgatgctgtgcgtttattgtatcagattgagcgtaatgtttggttgtcccacaacagtgaagttaagattaattagagggtttaggtgatgatggtctctggggctgttctaaatgaagtatcttcttgaggttttgtagaccacaccattaagtgttaattttgaccagataccctggtgatggttagcttgtggttgctatttcttaaaggagccacttattcctgctacctctgcatatcaagttcaagacaggtatttctcttttctgtttagtggggttgcaagctcttaaatgatgggtatagcccttcttggtccttaatttaactgagaggtgttgtcttgtattttactcccttttggcaggccctggacttcctctccttttccctgttctcgaatagttgtcaaagggaaagttagaatctatagcaaaagttggcttctattgctctcttggtttctctgttctcggtctgctctctgggtgttcttcatgttactcacatttatggcaagtctgggattcatttaaaaaggattagaaaacgcattttatccagtattttgggtttttcaatcaatagctatttagagcatct

SEQ ID NO: 123688 - DNA, 1045 bp, Homo sapiens
agatcatttagaacatacagataataccttctcattgtttgaatcaaacttttctagtgtctcctttattcttttaaaataaagttcttaggtaatatgagctctccccacacaaaattttaaacaaaattagaataaggcactaactatatatggaaaatgaaaagaaagaagtatataataaagtattgtatgcttaattaaacaaatatttaggcatactactttagaagacttgtgaaatagatgcttgatgtatatgtgtgatcactgtgaacttgacagctacaaaatgagattgatataggaatgttgcattggcaactcagatgtctccagcagggttgtcagtggtgatgtcatcttttgaaatgatgagcaactgttggcaaagttctgagcaaaacaaagtataatcttccctcaatatacgtgatggttttgtttctggaaaatttattatgtcataagatgattttaagaacaccttgttcttccttgcaaaatggagttgggttctagactcagctaaataattagtttttttttttttttttttttgctttgtttttaaatatacccaaactttggcacttttgaaagtagtgtcggctgtggcatggtgatcttttccatcagtcactcttacacattgcaggataatctagcattcctaccctatagccactgtttaaatgcatttctgtgtccttgtgacaactaactactccgttgaaattttgtcactacatgtgttatatatgtccttaattttcctgaaattcatatgtaaagtgagttccctatgtataaaatttcaaacatgagtatgattccctgaatgtaatggaaagaggtaggaaaggacagaaagctgcctataacacatttgtgtttctcttaagtaaatgctcaggcacttctccattagaaggcttgtgagagagtcagaggcttgtgcctgggtctgtgggagccatggactccacaggtgcaaacgaggctgctacagatgtgtgggatgaacagctcaaaaccacgagca

SEQ ID NO: 123689 - DNA, 1066 bp, Homo sapiens
ctgccagcgccaccccagcctgtggtgcccccattccactctactccccagctcccagcccttcccagcccgtggtgcccccattccactctccacttctgagattacctttcctagaggccacatttgagtgagatcatgcggtatgaaacagctcttttcaaagcctccagtgttctgttattcagcctgatgggtgatagtcattccttccatccttcgcctgtcattaggattccatgcagctgacggtatcttcctcctcggagcacctgtcttgcttggttcctgggacgccaccctctcctggctctcttcctactttgtggccgctccttgcctttccttgctagattttctttatctttctggcctccaaatactggcccatgaccagggctcagtgttggcccctctttttttgtggctctacccaccttacctgtatgatttcttttactttcaaagctttacgtatctggagacttgtgactttcatatgtacttttgcaacttggatctgtcttgtcctttctacatctatgtatgtccagctcctgcaggtaatcactaatttgaatgcccaacaggctttggaaaatcaacatatccaaagcgggcctctggccacccagccctttatccacaaacctgccctgtctatattttcccccatcccaacaatatgtatgtcaatccatcctttctgaccctttgaaatctttggctcttctctatcaagcccactttttttttctttttttccaaataatgtgtgtggtttcaccttaagaaaataagatttatgagtggaaggactttgttttgtcattatgtccccagcacctaggtcaatgcctgcacaaagtagaaacttagtaaacatggtgaaaattgttgatttaatcattcaaaaaatcttttttatttgctgaaacatagtaaaacatactttacagtgttgaagaaggtaaatgtttactgctgggtatttaaattttgtgatttcttttggaattgcagatagtgctttgtggaatgcttttatagctggttcctttgtgca

SEQ ID NO: 123690 - DNA, 1588 bp, Homo sapiens
gcttttcatggtatttattatgtcctattcagtaaatattttcctcaaaaatttctataaaaattattttaaaataaattatttcctcattttcagaattttcttttaattgctaagggatctgttaggtggcattgaatggctctcggggcacctgtgctctctgtgctggtgctgctgagtgattaaatgggtggatgtctgcatcgccaggtgggtgttattcttaaaatgattctattttaccaagtgacatttggatttactttggtaaccatagctttaggaaaagaagtggacactttggataattaagctaaaaataccctaaaagcattctgttcttagtaatacatcttttttacttataaaaaattaattgacagaaatggtaatcataagttcagtaattatattacagatgggtagttaataaaatattcgtaaacatgtataaagggaagtaaacatgaaaaaggaaaaagttttattttcttataaaacactatataagcactttcttatagtgcttttccctccagggatctgaagagttgttaatattcctcagtttaaaaataactaatttgttttattcttcagagaggcatgctgctagctttgtatttcagataggaggttcattattctgtttacctaagatatagaatacaatcagtttggaatacaatcagtttggcagtcatactctaagagcgtttgaaaatggactgctttgttaggactttgtgaaatatttctataaatattggctgttctagaaggctcatcaggtcattaaaaacctctttgtgaccctttcttccttaaataggaaatatctaaagaggttggcatgaaaacggtttgatctttctgagttaactaaaaatccctgaatgtgttgaatagtgcttatggcacttttgttgagtttgcaattagacggaaatattgggctttagataaaacatatgttttttggctctttgtgaaaggaaggaggtagtaaatgctggtcgttctttgaaatagagggtgttaaacaggatattggaagcctgaaagagaatggttggaaaacttttattaccaagaatattcttggggcttggctattagccgcagagcatgcagcgttctgcctttaattcaagaagaatactctgtttgtgttggtttttgtttcttaatctttaatgacacttacgttggttagtggcaaaaggtcatgtgttttggaagcatgtttgaatattgctgacattcatatggatgttctaagcatgtagatttgataatactgtgaatgattggaaactaccgggaaaagctttttaactgggttcagctttttgctagttctcagtccaacccagctagaaatgtaaattgctaagaccatctgaacctgtgagctggcaggttttggcaaaagttaaaatctaccaggtaagaattaggtgtatggctattgaatgaagtattttgaaacctttttatttgaggttgatttaaatggttgtcattaaaaggttaagagtggagctgtcttccgttgattgatccttctcaaatccttatgaac

SEQ ID NO: 123691 - DNA, 1048 bp, Homo sapiens
ggatattttcatgatattgatagtcattttgaaaatagaggataatgcttgaacttgaacaaggtaggaagcaggaaggtatgtctgtctccttctttcaaaacaatcttccatttaaatatttgttctgtaaatgaaaattcaataaaaccttaacagtttggaattcttccaggaaaaaacaggctaaatataatggaaagtctgaataaattaatattgagaaagaactatagtttgcttttaaataattcagatgtttgtgtgcaaagtgtttctaagttgacatactcagttcccgttaaaataaaattctgaattcgtcatagctgagatatttgcttagtggtaatgttttaattttaagaatttgtttaattttttaaaatacatttcaactaagcatgcccctgaaaactttttcatatagtattctgaagatttccatttaaaatatgggggaaatgaatttcaacccattttataggagtgtcaattagttcctaaaaaattaatgaaggagtatgaaggagtactataaaaaaatagacactagacaaaattggagattaagagaggctgaagcataactgatttgcaggatattggttttgataatagaaggataaggatgatctatagttgataaatgaggctcattaagtaagagatgataaatgcagatattcctggctaatagaaaagtcagcatacaaattttgccataacaagtgagggatgggcaggctttgaccagcttgcagctcttccagtgacctctgtgaggccacggagctcttctgtggtctggatgcctgggccacagaggcagcgtggaccccatgggcctcaggccagcagaagggggagccagagtgggtctcagggagtctagagccacctagagcagagcttacaaggagctccacaatggtgcagaggccagggcaggactgcagctcctgcaagtgtaactttttattttttatgctaaaaagaaaaaaaaaaaaacacatgactctaatgttctgaggtccctcttctcacc

SEQ ID NO: 123692 - DNA, 1005 bp, Homo sapiens
ttcaggaacatgccgtgcgtgcattctattttaaaatatagactgtaatttaaaacaggcattttgatgccccactgaactttgtttaagcctggaataaaagaggagaaaaaagctgtaagccacaaaaaagtgactaagctttctcaactacttttcttcataatgcattctttaaaaaaaaaaaaaaagcatgttggtacgattgtctctttccacaggaccgaaattgtacccaattttagatcatggtgtgcacatctttctacttggttcgtgattgagataccatttacatttttcagtgcacaggtttgtatttgttgctgtctgtatgcatgcatctgtgcatatggtacgtgttcattgcatgtgagaatattctaaaattacgtatatcatttttagcactcacttactaatagctaattttttagagctcttgatttaacctgattattagactgaaatgaaataaatatttaactacaattttatttaccatcgggtcattgtaaaaattgtgatttgaaagtagtttatattacttgccttttttcctcctcacaaaaatgaaaataaacagcttataatgacttgtatggaagaaacaattgctttactgtttttataaaataatatgttttggctgggagacctattctaatcgccacactgaatgccaacagggcagactctcagctaaggttctggccttgagcaatacacgtcatttctcagagcttctgtttctttgaaaaatgagtaagttagatttaggaaactctagcaccttctagctccaaaattttacattaaaagccatctttgttagtgtatgagaaaaagcactgataaaaacgggccctttgcatttgggaaaaagtcagtggagtgagtaaagtgcgggtacattgaaatcttcagaaacggctcctgtgtgctgcttggtggcctctcttccattctccgatgccatttgcttttgtagcagggacacttgaa

SEQ ID NO: 123693 - DNA, 1036 bp, Homo sapiens
agcagactgtgtataaacaactccacacatcatcccagagtgtctctaactgtaactgggactagggcaagagcacagtcccaagataaaaattgaaactctgtagttcagttgggactcaggctagtcttattttctttgcttttaggatagtgcagtaaatttctatccaaataggttcctttccttgggtaaagacaagttactttgtatttctttgtttgatatatacttttgaatgatttgggctacattcttactttagttcattttggaggaatatttcttagtttaatttgtctcattattaattcctccttctctgaaactttttggggatataggtatgtatggcatagtctacaaatttaatgcctttacttgtttttttcttttttgcagatgtagggcgtgtgagtatggggcgatggtgcagggaaccttgctttaacatgctattttgaaagatatccccttttattttgtagaaatgggttaccacgttgagcaccaggagtttcttgtacatttggatcctagcagaggaaatgggactttagaaagattactctgaactctgaagggctaatttaaaaaaaaaaaaaaaatcaagcccctccccctattttttcttcatttttaaaaaggcctgtcattttactccaggaaatgacaaagaaaagagcaaaggttttgctttagggatgaagggaaaaacttttggcttaatttgtttaaaaaattctttttgtataagctaaagatgaaacatattacagttgccaagggcaattaatgaaacaagaaaaattaaaattaatgatttcttaacatgcatgtatttttatatatttaatttgatttggattatttttgagctgtaatttccagctacgaaaacagagactccagaatggcaggacagctgaacagtggtggaatagtggtctgtctggagcttgttccagtcatgacagcagctccttcaggcacctgctcctgagcatggtgccaccatggtgtcctgtgagctttt

SEQ ID NO: 123694 - DNA, 1033 bp, Homo sapiens
tggtgttgaactcctggcctcatgtggtcctcccacctctgccgcccgcccaagtgctggaattgcagatgtgagccacagtgcccagccccatagttgctgcatttatgcctttctttagccagcatgcctaaatgttgacatcctcaattaagacacagtatcttgtcttttccacatctcaatgatgcagaaaaattcagttatgtttagtaatcatttattgtgtctaatgtctaagattttatattagatgtaaagaaaaataaataaaaaatcaaattatttcactggcttattaatgtctgttctttcccataacacattcaggaataagaaaagaaatcctcaacagaaaatatctacttttgggatactggttactgaaaatactttaacatcttttttcattttatcttcagagaaccacgtacctatagttgcagaattcatactttcagcacatataatttcacagaagtgttttgccatcttgtggaagtcttgactatttgaaagtttaagagcagcaatggctatgacacaactgtggtcagagctttttatacaagacattcaggtggcattgagtcacgtcttatcagtgctggtgatttcagaggaagagaacactgccttccaagtctcccaacccttttgtgaacacctggtgtagaagagtaatgtttatgctggctttcttgagtggcttcatgaggattttattatttttactactttttttgctgacttaattggcattttctatgttttatagggataaaaacatctttcatataattctggcctgttttaggggtatcagatatatatatctaaatatgcacgttgttgtttgacaaagaacatttcacacctaattgagcttttcagccgggatactccacctagagtactttgcacatacatgagatctaaggttcataaaccactttggcagtgcctgccacattcacaagtgtccactgaatgtcaatttcttgccttttctttgccctcctccttttgtgaa

SEQ ID NO: 123695 - DNA, 1137 bp, Homo sapiens
ggccaggtggtattttgcgggggggtaacaacctgaaagttgtcctggttttttagcgctgctctttccgagtcttatttattgaagtttaaactattcataagatctagtggtaactgctgtaaaggtaactggggaagttatagaggaaatgactatgactttaccgttgcaaatagattaatgcactttacttttccccaacatttttattgactgtcctgtcatatcccttcttaaatcatacttactgttaccagttttacctttgaatttacctacaaacctaatttctcattaaaacaataaaaatgtatgaagtataatataattgatgcaattttagcctccctaatgaattttttaaaatactctggtattttaatataaagtattacccagatactctataacttaatgatcaaaatttaagaattaatttctttataaaagtgtttaaaaatagcttggatgaggtattctttcaacatgtatccctgaaaattataaataaatggttatttttaaatataccagtggccacttttaactgaaagagtcctggtgtgacagaatgtttcatatcctatgatgtttttatatagaatttataacccttgtgcttccagaaaggatttgagctgacttacagtaaaacgtttgtataaacaaagactgctccaagcggattacaaattcttaaaaaagtttgaaaaagagagaagcaaacaaaccatgataatgcagttactgatgaataatgattaaatttaaggctacattcctgactagcaaagtaaaggggaaaaattgggattacctaattattaaagtaaaacacttcatttattttctttctttttcttttttttttgaaatggagtctcgctctgtcatccaggctggagtgcagtggtgccatctcggctcactgcaagctccacctcctgggtttacgccattcttctgcctcagcctcctgagtagctgggactacaggcgcccgccaccacgcccaactaattttttgtgtttttagtagagatggggtttcactgtattagccaggatggtctcaatctcctgacctcgtgatccgcccgcctcagccttccaaagtgttgggattacaggtgt

SEQ ID NO: 123696 - DNA, 1658 bp, Homo sapiens
ttgcaagtcccttggaacattcatgcaggtctgcagtcactcttaatttgaatgagaaagaagatggtagaaactatttttattttctcctgggagcaagagaaaaggaaggctagaactctgtactatgtaattttaaaaaaagaaaaaaatcggactccattgagattctttcttgtttactttttgttttactctctctgtctcctagtatgtttgactaatgtaagtcttcccccaggaatatgagaatatgtggtaccgtccgcctcataaccttcctggatatttttataatttatcatcagctgacactgcttgggtagaatattcttaccactccctctggctgctggaagtctgaaattacatctttgtctttgaagtcaggcatactgttagcgttgctatggtgacagggtgggtaatggcctccgcagacaggagattggtatttagcgtttaaacactgctgtacacaaggccttgatttttagagtggttactgaactatccccttttagtaaatgtttaaaaattacatttttacatggtcttactagattaatagtcatggtttatttcattttaactgcaaggataaaagcattattccattaaatgggcagcttttttttctcttttggtttatgcattattaacacaggctttcctgttttgcttgtaacattttataggctttttcaaacacgcagtcagatttgctctgttgctcctttattttttggacttagcccattatctgcttgatcttggacaatttcagaggagacaaagttctaaggaactaagcttttaaaatattaaaaatgaagttcttttttttttttaatgtatgagtgataatattgatcaagatgtctctttggtttcaagtttctagttagcccctttcctgaactataccctcacatgagatagtaaaggaaggacagtttatggttctggagaactgttggacattttgaaaatgctttagttgatgtaactttcgaagcaatatgctctgacatagtcagcctgtgtggaatgaggccgtttgcacacacatacatatgatttttttttatctgtgagtattttgtctttagaataaagatgaatcttaatagtttgtatggtatatacaagtccctgtctacctgatacataaactgctactaaaacatcatttttaatgtcttgtgatacagaatttattactttatgaggtattttatttgtggtaatttaaattgtttaggaagtttttccttacattagctcgaactgttttttttgtttgtttttttaaatcctggttctacttctgccttcttaaaccacacaaggtaaatctaaatccttcttctatatgacggctgttcacgtatttgaagatagttttcatttactaggatttcttctgggctattaatagttactttaactatttcccccactgtgtggtctcaagttcccctgcaccctattcttaattccttaatgagcttcatttttgtataagcacctctaaatgtgatatccacaaccaaagggcaggctccaaaggcatggctggcggaggccacctggcccgctttgtgttggaccgtcacgctgccgtgtatcggaggcgtcagggtctgcagggcttt

SEQ ID NO: 123697 - DNA, 1009 bp, Homo sapiens
agtccaatccatgccttctggctccatttcctgacatcaggaggttaaagactaacttgttttctcctagtcacagctccacacctaggaacagctttttcacttttaaacagtttatctctgttccccctaccccctttaaaaagaaagaaaaacactaggaatgagtaatactgatttctcagtatttgtttgattctgtggcatactgtacacttcagcagcaaaagtagatggttgagttatattgctagttcttactcagtctataaacctaattcgttttatttatgatgggagaaggagaatttatgaattcattttgttaagcaattcttgagcctttgtagtgtgctattatgatggatacactcctggtttgaagaaatacagagtccctgagatcgtgaagcacttttcagcaaatacattttgttgcagtatgcatttacccatcttgttgaagggcatttaaatgttgtccaaatgtcttaagtatttcttttgaataatcattatttttaattatagtctggatttctctttcctcttttgtgaaataatcgtcttcctccttccttttggaaaagtcagtaatctgggtaatttctgctaaaaaaaagctctattaaaaccaaggggtgattgtagtccagttaatgaagcaaagcaaaaaaagatgaggccaggaatcatacggagttagtttactaatgaagcaaggtacttttaaaaggtaaggaaaaataaaggagcccctttcttttctttcgatctggtcattacctgggattttcagttaagtgaaatcattaactactcatatgtgcctcaacctaaacaccaaaccccaaagactatttaattatcatactttggttaataagattacaggaaggttattaaatgagtctgtgggacttgcctagaaaagatgaaatgcaaaatgaaatgttttcctctattgggaagaccacttggcttgtgttctttttaatggttgagcgta

SEQ ID NO: 123698 - DNA, 1125 bp, Homo sapiens
ccacagaaaaggaaagaaatcaccctcttgggaaacaaagaaacaaaccccaaacctctaacccaaatccctgagcttttgcggagacagacacagcttactccagaaagaagggtgcagctcagcatccctaaacactcccaggtgcgtgctctgcgacagagtgcgcaggacacggagctgcttaatggaaaccaatcctgcaacactgtacgtttagtcagctttctctgtcagataacaggcctccgtgcagactgttcaaatgatattttgaaaatatggtgttattccacacaactttgaggtgtgtaattttggagagtaaaatgaaatcaccggtcaggctgttaaggaggtggggaaatgccaactttgcctcttccgggcagtgctgtggtgatgcagccttgggccccgccagcagcggcttgctggctggcgcggggtcctctcccgggtccgctgcgttgcgcgggcaggacagtcaggtgagcacaggtggctccgttcacctgatcttcagccctgtctccactcaagtgtcttcttggtggaagcctggtggtccttagcagtactgggagtatttgaagactaggccagaagggcagggtcgctgtgtgagctgcgcttaccacctgttgaatgtgaaattgatacagaggtgggatgtgctggttgtttcttgaagtacaaataaatgggcacacggggctgggagcaactcgtgtctgatcttgtttatgattagtgttttgtttactgaggaatgtatttttaaaaagaaaatttgtattctttgtatttcaaaataaacataatgttggggtggggagcagcctgccacttctaatctcttctaagtcaatttcaccataacactgaccctatttttactagggtcagtaaatggactgatttctctgatagaataattttacatatacacaaatactcttaaaaatactatagaaaggccgggcgcggtggctcacacctgtaatcctagcactttgggaggccgaggtgggtggatcacgaggtcaggagatcgagaccatcctggctaacacggtgaaacctcgtctctactaaaaatacaaaaaattagccgggcgtggt

SEQ ID NO: 123699 - DNA, 2242 bp, Homo sapiens
tacaggtgtgagccaccgcgcccggcctcaatttctttagaagtattatgtagttagttatagtttattttggtaggttctgtttgttttagagggcttaaaagtcactctgttttgcctgcaccgactgtgtttgtgttgcatttttgcatcaagtaatgaatttagatttagattagggagtaacaaagaagtctgttcagtgatgttaagttttctctttctaaaaatcgctctactggttatcctaatcacatagttaatattttcattataaagttgagaagattactattttctctttctttctctgtgtgtattcgtggataatttcttttagaagaacagtcgtattctatgtactgtttttattatctacttggaaattgtaatttcttgtcaaatacagttagttgcgtaggtcattttaaatgattgcatagtattcatatggaataagcctgtttaagaaaatattaaagaatctaaatagactgtgtaactaagtgttgcttaatttagttgtcttttttgttatattaatctttagtgttcagaatgatacttaagcgtttaaaaaattctaagtagtatttatgaaaatggatcaaatgctacataaaatcaaaaccatggaagagtttgtttgttttgtaatcaaataaatctcctgaaaccaaaacaaacttctcctctcagtatatttatttgaaattcttcttgtttacagaaattgtgtaatatttatcttgcacaacagaaattttaaatgtgcttatgaggtagcagtccgagaggcaggacatacaataatctctagcatgaactatgcccacgtggcttaagtttggattctggaaacggttttctgttcccttttctttagtatgaatatgtgcttgccaattgtggaaaggagctgattaatcgcacttgaaggagaaattcttctccactgctcgtttgtttcagtttcagaatctctctgtcacccttggaagcagtcacaaggattctgccccttggcctgcagttgtgggggatgttgtccccagccttccccaaagcctgtcatcatggactcagctgcatgccttattaactcatcttgcaacctttggcttgtcaagacgatgagctgtcaaagctcgcagtgacatcagtagtatgtgacttgaatggatataccacatatgctgaatcagctctttttcattctctttgacatcagaaaagcaggtgctaagtctcattttgaaaatttattggtatctgttgcagacactttagagaccactctgtttatcagactaatagccaaagggaagctaatagagtgttttggcatttaaagcctaaaattctgctaatttcttctggaaaaaaagtcccgtcatccctcatgtgctgtgagaccacagaaaggctaatttaatattctatgtagggaaaatcaggataggattatttgagaaatttgtggttttaaattcttttatgatggcgtaattttatgcgtatactcaaggccatagaatgttatgtatgtgtataaaagttgaaagtttggaatcattgattttacaaaaaagaatatagattttaaaaccatctttttttgacagcttaacctcagttgaagtatggattctcttaatggaaaaaatttattttcattaatattttagcatgatttaacactaaggttattatataagtcttatatatgtgatctgtaaaggttttgtttgagatatttgggggagaatcagccttggttcttttctattttagcttgtaggaaatgaaaaatatataaacagtccaagtatcaatgtagatgaggtgctaaataaattgtaatgagcaccagaggacataagaatgtgttaatctcaaagccgcatgatggtttttgtgttgtgaaaggttagcttttcaattgtaagacttaattacctttcaaatgaatatttcatagagttactttgtcattgaatatacagctacataagtattctcttccctatgtcctgtatgttgtttatcagtagtttgaaatttagttatttcctctacttttcttttgcatagagcagctgggatcaagagtttcttatttttattttttaaacacagttttttaaagcttcaaaggaataacataattctgcagtgctttccctgtcattactttgttgatgcctatctggaatgtggttgcacagtttatttcattttc

SEQ ID NO: 123700 - DNA, 1163 bp, Homo sapiens
aagatacgtgttgctgaatacaagttagtttcatacacacacatacacatggccacatacatacacatatccacacatacaaattcacatgcagtcttttcagataaaaatatttagcgatattaagacacaaatcaccataggaaatgtcattaaatagatatgaaaaagtcatgaagataaattagctgtcaccaatgaagttaatgattaatttggaaatgggtttttttcctcctgatgcttttgtcttttgactgattttcaatgctctgtaaatgatgagtgagagaagaggaggagggagagaatgtgtgtatgtttgtacatttggtacgtaagatttgtttcagtgcttttaagacagaagaatattaatttgccctatatattcaatttgaaataaaaatttccaatctgttatggtttaccttatatattatattcattgttattatcatgaaaatttaagctttagacttttctgaatgtatttaaagttatttgatcttattaatgaggtcaaattattattttttataacgtagacttatatttgaaacatagatgctgtatgaacctccttttgggggtttctgtgtatattgaaattggtgataagatttgcaaggaactttggttcattcagtagggagcccagttttaaattttacttttctttcagttaagtgaatttttgtcattgatatatgcaaagttcagatttgtgtagactttcggggtactgaatttgtttcctgttcattcagtcctaggaaggaatgtccttttctcctcttaggtcacacgtgacctttcccggtccctgtctgcagtctctttcctgcagggagctgtctccccttcatgtagccactgtccttgagctttaaccaagcatctgtaagcacctcacctggactcttaacgcctcacctgggaaatgattattgtaaactgttgttttggtaatactgtttggtagccagcattttaattttagtctattgtaaattgacacaaatatttgaatattttgttcattttgccattttacaaaaaatgagaaaggggaaattgagaggaacaatattagtgatgaaaatatctatatctgaaaaatgtaatgtaaagatatgaaacacttggggaagatgaatgca

SEQ ID NO: 123701 - DNA, 1042 bp, Homo sapiens
ttatttcatagtttctatggctcaggaatctgggcaggcatactgaattctctgcccagaatctcctaaggctgatatcggggtgtcagccggggctgtgatctcatctagggcttgtgggggttcctcttccaagctcctgtggttgctggcataattcatttccttgcagctgtggagctcatggcaccttgcttcctcaaggccagccagagagtctctctgatccctctttaaggagctctcctgcttagaacgggcctacccacgataatttccttttcgattaactaattaggggccttaattatatcctcagagtcccttgacctttgctgtataacatggtttaatggtaggattgctatcccaacacatttacgggtccttcctgcacttgaggctcgagcgccctagtgtttgtacccagagccaggaatcctgggggacatcacagaattctgcctacacacagagtgagcatgggctgggaaggacataggtttcttagttcatatagttctgtatttaaactttttaaaaatggtataatacataaaggttaaaatagttctttttattttacttggtatgagattcccccagaattctcaaatgaaaattacaagacataattctggaaggaattttagttaatgtatacttagtcacaatagtcgttctcaaacagtgtcaggagtggacaatcagaaataaagcaaatggtctaggcttgtgaccttatttagctgtggggcagggattggggccagccaaaggcccaggggtgtccagtggttgcatggtggcacctgtgctgagggctggacgagctgtccactttatcccttcccctgtgcccacagcttttgcttttctgagtgtaaaattgcacagatctactttattaagaatatttattttaattggattgtgtcacgttgatgaaggatttttctttagttaccagtggaagatgaacatttagtaagcatgtgaacataaatttggatagcatggtttgaaatcagaaccataagca

SEQ ID NO: 123702 - DNA, 1047 bp, Homo sapiens
tttcaagttccattacatccttcacatgcagtatatgaactttacagcagcacacactgtctctcccttctctgcctttttgctgttgttgtcatacattcagtatctcaatattttataaacaccactacacatatttattttatctaccatttgatggccatttgggttctttccacttttcagctattttgaatagttctgccaggaacagtcatgtgtaggtctttctgtagacatattttcagttctcttcagtagatacttagaagtggaatctgctgggggtgtgtgatttttgtgtaacatttgaagaaactgccacactgttttccaaatgactgaaccattttacattcttataagcggtgttcctctccacacctcaccagcacttatcttttgtcttttgcatcgtggccatttttgtggatgtgactggggttttaatttgcattttcctagtaatcaatgatgtgcatcttttaatgtgtgcattggccatttatacaccctttttggtgaaatgtctattcaaatattttgcccattttaaaattggaggagttttgtcttgagttttaagggttctttatatatcatggatatgcatcttttatcatatatatgatttgcagatattttctcacaggctgtggtttatcttttcacttgcttaaaaggtgtcttttgaagcaaaaaaatacctttaattttgctgaagtccaactttaccatttttaaaaatcacttgtgcttttggtgcgaaactgcctcattttcaaaagacatttttttccaccggatatagaattttagtttgactgtattttttttttctttttttttttttttttcagttccttaaagatactggtccactgtcttctggctttcattgttttggcaagaagtctttttaattttattgttcttgatgtaatgtgtttttttctgactccttttaagatttttctcctcttccccccatctttccatgccaccacagtggtgcatgtcacgagcgtccatgtgaagagaccacca

SEQ ID NO: 123703 - DNA, 1074 bp, Homo sapiens
gcagtcatggcacactgcagcctcaacctccctgggctcaggtgatcctcccacctcagcctcatgagtagttgggactacgggcatgcatgcaccaccacatctggctaattgttttgtattttttgttgagacggggttttgccctgttgcccaagctggtcttgaactcctggactcaagcaatccactcatgtcagcctcccaaagtattgggattacaagtgagagccactgcacctggccagtactttattttcatacagagactgagagtaagacttcatttccaaataaaagtaggttattaaatattgctttatatatttttaaagttcttacagaaagaaagcttccatatactctagaccattttgagattctttcaggctgtgactcttaaggtcagctacatttttattgacagcaatcctggaagaaaagtaaagagaagtgagaatataatgttgtgattctgttaaaatcactcaaaatgcttgaaattgataatactttttggcatgtttctttctaaaatcaatgtgataatatccgctgcattgataaacatagttagcaagcatttttgtacttagcgtttgtgtataaaatgtaaaggaaggttttttaattcagagaaggtgctcatgtttgaaagacaatatatggatctggaagaagtaaaagtaaatctttaaactctaattgcaaggctgtctgctcatatttaattgacacacgtttaaacattggttgtaatggattgtttgccatttaactgacattaacgacctcagttaactcatgtttttatattacattggctgtttattttttgttaatttccctttagtgttcagcttcccatacattaaaagttttgctttttataaacaactactgtgtcttgaatctctttttattattaaaactttcacacatgtattgggtttaattgcatatactttttgtagcctgaaaatgtgaaccatatgataataaaacttaaacgtctgcacattgctacaaaacacagctctgtaagggaacacatatctaaatatcatcatcctg

SEQ ID NO: 123704 - DNA, 1587 bp, Homo sapiens
gtccgctcactgcaagctctgcctcccgggttcgcgccattctcctggctcagcctcccaagtagctgagactacaggcgcccgctactgcacccggctaattttttatattttcagtagagatggggtttcaccgtgttagccaggatggtttcgatctcctgaccttgtgatccgcccgcctcggcctcccaaagtgctgggattacaggcgtgagccaccacgcccggcccagtgctagttttgtgcctgtattttctgcttttttcatttgacatcacttgaatttccttagcttgtggaatcttttgttttgttttgcaaacttaatatattctcatacttgatagttatagtaatacataagctttagtcattgacaggccccattagcccttgtttatgttatttacccttcagagtatcttgctcgaatctagaatcgtggcctgttgagactttattcctttgagttgaatagtacctttctgtactttctgtaatatgtttttgaatatacatatgaaatacaatgcaagtaattaatctatagcagataataagtgtgtgcatgatggtgatgttggggataatggaatatcgtggaaatggtcaatatcttagtctttctttcattctagatgcttactgttggtacatataggcaaaacactctaaaaaaatctgatctattggaattcagatttgtcacaactagttttagggtgaaggtagagggattattgttcaaggatttagctggagacgcacttagtagttacaaaccgggagcttgaagggtgagaagggagtttaaggggataggataaaaaacagaccagtaatatgctaaataatgtaaacttttgggccagtgacttaatttacatatgcccaatttgtgtggtgtttcaaaggaacacttctgttttaagtgaggtgactcacattttgtactgtcttcattcatgcatgtgtggtgcctgcagcctgccactgttttttgtgcttatctcaggggattcgctgcaaaccatggtgagggggaggggaggaacggctagtgcatccatggagtccttctctggcttctcctggccactccttccatagtttaaatgggggcagcacatcctcttgcttctactaggaagtgaaaagtcttactagcaaggagttaaggactgccagaggagctttcttacctgccagctctggacatctcatttcctgtttgtctgaatgcatgtgcaagcttaggaacttgcccactgcagcatccaacacagctggtttgcctgtgtttcaggagagtggggaagtgcgcttcaatcacttccgacacacttcagcatgttgagccatctgatagggagggacattggtgcgttttactgccttcttcctatgcacctggagcttttgttatctcaactgaccagttccttacctgtaacctggattagggaatggcagccagtattcatgacagttgcatatgtgcgttcttacaatcagagaaatgtgccataaaaataatttctcattttttgcctctgtgtattctgctcctgtagcttggaccc

SEQ ID NO: 123705 - DNA, 1001 bp, Homo sapiens
aggaagtggggctgtgccctcttctcccgggcttaggactccaggtgtacctgaagacagacggtaggaagcctgaggtgacgtacgaatgagcccctgaaaagtgaatttcattttcttttcttattcactgcttctcactgaaaagaactctgtttacctgaaaggtacaaaaggagccaaagagaaggtagcaattttaaatagctgacctgaaccttatttttacaaaggacctgtacagtgtcctgacttaggaacctgctgattagaattctttatggacagagattgtcttgaataagtaggagagttttggtaactcttctgagcaggctgccttccaaggattaagtatttgttgctgaaaaccatgtggtcatatagtgtattctaagtatctgttttgctccaagcccagggtactgtactaggaactgaacaatttgggactagatcctcaagcctgctacttagtaacctttttgagcttctagacttcactgacatggacaagtgcaagtgagaagatgtgcttagtgacagagtgcccaaatattcaattatcgtcagtgctgtaccagctgctattaagctatcaccagatgagatggagaatctgcagcctagtaacgtgtttcatgtcattgatgtggaagtagaattaccagataaaatacaggacgcacggttaaatttgaatttcagataaacaaggaataatttcctagcttaaatgcgtcttatatattacatggaacatattacataggacatgttactcaatctggcaaccctatagaaaaagaattcacttgagtgatgagaagagtcctctctccctgtgatataagctgcggaaaaacctcaggaccccacacaaaattggaatgcttatattttagctcccctaaatctttaaactcttcaacagtaagggctaaatcctttgactctgtagcaaattcaagcactgtgtgaataatagaaatatcttctat

SEQ ID NO: 123706 - DNA, 1002 bp, Homo sapiens
agatgggacggagtattctgaaatgtccccagtccctctgaaagggaatcttgtaaaggcatcctcaacaacctaccaccttcatggtgtgcctggttagagataggatgataacatggaaagaaattgtactgaaccagaaggtgagtcatggctctgtctctgggcctccatttgtttctcttcaaaatgggataatatataccctcaatgcattgttatggaaaccaaaaataagtaatagatcaaaatatgtaaaagtattttgtagattgtggagtactttagagacagagggtattaagcctactaatactactcttgtgctgcattttgggtttttttggaagttttatcaagttttataaaaaaagaatgtgaattttaacccatattaatacctcatattaaattagatttttgctgtataacaattaataaatgttgggaattggaattgcagttttacaattgcgttaatgtccaaattaaaatcagcagcctgactgattgaatgttttgttttttaaatcacacatttgcctgaattgttcatgttagtagatagccatgataatcttttaatctacgacttaaaagtttctgagaaaatatgatatttgatgttgagaagggaaaaaaacgtgtgttattcatagagagtatggtatgcagtctggtgaatttgtcctagtaaacctgatttttagcattacttaagacataaattctcaatctccaaggaattatttttaaacatattattttcacaagtacccgtgaatggatgtggtctatgggaaacaccaaaatagatataaaattgatggtcttaaaatttgtgatttaccatgcatgttacattagttatttgtataaacatgatgttgttcctctttgacagaatttagaggttggatacttgatgcatctgaagaaaccatagaagtttgcgattatattacagaattcctctcatgtctgtgcaaaaaccctgcactc

SEQ ID NO: 123707 - DNA, 1010 bp, Homo sapiens
ctttttactttagtattgaaataacaattctttatatcgtcactgtcatgaattcttacctttgaatagcactttatagctttcgggatgttttctcttattatcttattaaatatttacaattaccaagaggtaaacatggtaggcatgtttatcctctctatgtaagaagtaacagatgtagagaaattcttatttacaaagttcaggtgggaagtagtagagctgagatttaaacacttgcattttaacttgtttttttttttttttgctgttatttccaccataccatactgttttccacaagaaccatcatttctagaactttatatttaagtttacattagcataaaggaatgcatttgaatatctaaagattctcctattaagaattggcgtgaaactctgtatacatatattatttctgaaagatttactggaagactgcaattacacaaaataaactataagcataaagacatcattatcccagggaattgtttatctgcaaatgtgaatactagaaaagtgtttataaatgttagaagaatgggtgcaaataaattcttatgggacaataatatggggtctattttacctctttccgtttaacgcttaagaggaacctcgtcatcgtgactactccagagcatggattatgggtgctgtgcgggcttgcagtccttgcatctgtgcttcttggtatggatagaaagcaactctgaagatgttcgtgatatgacagtagagtgtgcctagatctagcttttctgttttgctcccctctcccaatcttgatctctctctcttttttttttttttttggtgggcgggggtcagagtttccactctgtcacccaggctggagtgcagtggcgcgatcttggctcactgcaacctctgcctcccaggttcaagcgattctcctgcctcagcctcctgagtagctgggactacaggtgtgtgccaccatgcccggctaattttttcttgtatttttagtagagaca

SEQ ID NO: 123708 - DNA, 1284 bp, Homo sapiens
gtagagacggggtttcaccatgttggccaggctgttttttgttgttgttgttgttgttgttgttgttgttgtttggagagatggagtctcgctctgtcgcccaggctggaattcagtggtgggatcttggctcattgctaccttcacctcctgggttcaagcagttgtcctgcctcagcctcctgagtagctgggattacaggcatgggccaccatgcctagctaatgtttttgtatttttagtagagatggggtttcaccatattggccgggctgttctcgaactcctgaccttgtgatctgcctgcctcagcctcccaaagtgctgggattacaggcgtgagtcaccgtgccaggcccttatgtagtggcatttctaacacaaaagatttatttttacctaaaatgacaatacttactgggttgccaaggagaatagttaagttgtagctaaagatgaaaagcccagagtaggcaagtaagaaaaccgaattggtaaaacttctttctccacaggacttctgttagtgatttgttcatgaactttgaaaggagcaatggcagttcctccccgatctccgttctactcaccacatcccaataccgtaaagtttatgagcagaggaatttaacataatgcattttaagttcataaactaacaaaataacttcagatcttttaaaaatgctttttagaagtttggcctgcatttctacctttttcaccatattctgtctcctcagctacctcctaactccctgaacttaaaactctctggggtcgctttccattaatagcttttgactttgtttcttatgctttggaaatgtatgccatagcgacattgctattttaagaggcttttatatattcacgttttctccctcttttctctctgtcttcccttgcccttccttctattccccttcttattcttgccaccccacaacaccccccattgagagatccaggcaagatagactcctttgcccttggtattccgtggaagttcagtgctatctgatctcactgttagggaaacagacagcacatattcttacctcagggaactaagatctagagaccatctggaaccatctctgagctctgtcattgatgggcagtttcacacaatctgttgattgataatgttatatcagagcttcagtgtattgcaagccattttatggaaatactggtgataagagtaacctgatgtgacatggtgcatgtggaatactgtgttaggtcctcccccacctccctcctggggcaacaaaatg

SEQ ID NO: 123709 - DNA, 1038 bp, Homo sapiens
caccatgcctggctaattttgtatttttagtagggacggggtttctccatgttggtcaggctggtcccgaactcctgacctcaggtggtccgcccgcctcggcctcccaaagtgctgggattacaggcgtgagccacggcgccctgccggcatgaagttttgaacttgccattttgccgctctagtgctgcctaaggcactttgaaggcagtaattgcagaggcatttcgtgccttcaaagctcagtcccaacctaagttccttaccctctgagatgatcccaggagtggcctcctctgttgcatgacatttagatccagggctctctgaagcctatggacttagtaccattcatgtgagatggagtgatggcaggaaaagaattctgtgttgcaactgctgtgccctgaagttgagacctcagttgaaggtaatgataaaaaaagaaatgctaggtgcattattactgcttcatctctacttccttgggttagttaaaaggcatttaccagattagttaacactgaaaacaggatctgtcacgagccaagtatttcagtgtgtgttttgtgttttgctcaaaataaccctggtatccaacactcacattaaacaccacaggaagattttggttgaatgtgtactgaaggttgaggggtgcctgcaacgcaatctcatggacttacctttttttctgtactgactagaaactgattgcactatagccaaattacataccagcacaaagggaattcagcggcaggcctgaacagaatagaagtgacaagcaagaatcaattaaaggagtcagccccctgggtctgttcagtaacacaggctagcactgtgggaatcttatactcggtgctttgctcaagatcagtgccttgactttgtacattgctaatgcacacacaaaacctttgggtatcatgaaatttttgatgacattattgaatatttgaatattgctgggtgttttttgttttgtttttggtgactcagcgtataaacctgctttctttgggggacaaaaga

SEQ ID NO: 123710 - DNA, 1052 bp, Homo sapiens
gtattatgccaggaataaaaaaaaaaaaaggatagcacaataatatgccactctccatcttatagaaacatgcaggctaaagtaaaaaacaaataatcagattattataactcagtattttgaagagcagctggctaatctgactcgagggcatcagactgggaaagacgagatgacatttgatgccacgtgtcttttaatccagcatttttcacacaatgccctgcacgtcgtagctactgagaaaatatttggggagtaagtttgaacggaactgtgacttgaagaataaagagttgatgagagcctgatggagatataaagaaacaccagggatatgatttctgattggagcaatacaaggagaaatggataagtcccggagttttgagcttgggcagattgggaaatagtttgtcaataactgacaatacagaagttagttagggatcagcagaatgatgagagaaaattaatttagtttttgacatgttaaattcaaggtttttgaaggacatcctcatgggactgtttagtgtgcagttggagaggtctggtcagtcctggagcttgggtggaggaaactaagacacagatttgggattcaccacaatatttgatatttgaagccatatctgatattctcctgggtgtgaatgagattgctcaagaaaagtgcgaagactgtctctgatagatccatgaggaagataatacttttaaatttgacacttctagagctgatcagagttattctaaaggggacccactgtagttagaacacttctgtagcctgtttctattgggagcagttggttctcctgacttcagagtttcccaggtgctgacttaccgtataaccctgcgtttgctgtcattctgtcttcacttcactgctttcattcctggcacgatagtaaaattgtagatgttctcctgtcctcattgtgccaatcacagcattactccgaccccactgctacatacatcccccaaccctcagaaagaaacacaaagctgtgatgtgaatcctgcatcttcattgccttcaa

SEQ ID NO: 123711 - DNA, 1053 bp, Homo sapiens
actgtatctcattaattttgtattgcttaaaggttgaaatgataaaatttggggtatgttgggtcaaataaaacatgttatcaaaataattccacctgtttccctttgcttagtgtggctgctaggaaatggtaaattacaaatgtagttggattgtatttctgttggacagggttgctctagacaaacctacaccaaacacaacttctgcgccccagggaatggaccttccctgtggacttgttatagtggtggattgcccttgtttcaaatgtcattgcccagtgtagaaacctctggtaatccatcaacaattctggtaaattttaaagccacattattgattagggagagttttgggaaggcagattgggaaataattcatactcactgagctactcaagagtaatacttccaatcagtaaaacatctattggggaccacaggaagatgttctttttgtttgtttgttgtggctaatagatgactattagattttataaaatatgtttgttttggctattaaatgactattagattttataaaatatatgtttacttactaccttgttcccaaagggatttaaggcatttagttagcatctttctttaggaattcatcagtagtaacaaatgagcagtgctagttgaaattctaaaataaaaactcatattcctctaggtaattgctttttaacctttttaggggtctttcctgagaccagactgcattcatctgaaaacaaacctgtagttaggacaatccatgagtaaagaaggcctcatatttagaatgtcatagcttctcagaatctgctttgaaattgaaagtcaacatagctccttctgctgtggtgcaaatgtctagagcctaaacatctctaaaatggaaactgggctgggtgtggtggctcatgcctgaaatcccagcactttgggaagctgaggcagacagaaggattgcttgagcccaggagttggagaccagcctgggcaacatgagacaccatctctacaaaaaaaaaaaaaaaaaaattagctgggcatggtgtc

SEQ ID NO: 123712 - DNA, 1115 bp, Homo sapiens
tggaaagagcctggtgtcaaggaaaccagtttcacagtattctaggcttaggaggagagatgcgagtctcagttaaggcattggtaatgggaatggaggctagtctgtatttcaggaatggtcagatgatgtttatagccagcatctggtaagtgctgatttcattctcataacaaccatcagagcagactgtcgtcatatacatgaagaagctgaggcccagagatgctaagaaacttgtctaacttctccaaagccactgcttggaggagttaaatttagttctgtttagtgttacctgagtccatgtttcacttcctatttctctctagatttggaggaaaaagcagttctgaaattgtaaaatttctagcctggtggcttttgctttcattaaggaaggagggaagaacttgtccattaaatgttggtactcctgaaggttctgttttaggctctatcgtcctttgtgatgcctttttatgataaaactcagtcatccacgctcactcaactgtcatctaattgcctgcgaatccatgttctttagtctcctgcaacttgtgccatgacctgtatttcctgctgccagcgggtcacctccgcggatataccacaagcatgtcaaattgccgaggacacaaccatgccattcattcttcccaccaagccaaaagaaaatctgggtgtatctggacgactcctgtcttccccttcatatgcagccattatgtttctagagctagaaccatctgaaaatcttaagtcctttagggttttttcgccccctgcctttctcttttagcaaagataaataaaaagtgaaacaaattggcacaacttggaggatgaagaagtagcaaaagacaaagctgttagagggataggagaaagtcatttcaggaaggagggaatagacataacaagcaaatttgccgttcaggaaatgttttatttaagaaaattaataatatttagaaaataaattggatggaaataaatttttaacattccttctctgatgaagaactgacctaaaatgtagttagttctttattcttgctttttaaccttgtagataacatcatgttagtcatttacccccatacaagttg

SEQ ID NO: 123713 - DNA, 1528 bp, Homo sapiens
atacagtttacataaagatctaaagggaaagcattgcttttattgaaagtactacctgttttcaaaatgtttgatacatacacatgtgttgcattggaaaggccaaatgaaataatgaatagataactatattttggtctatattgttcatgatctcatagccatgttttttgataaacgctggaagtatggaaatgatgaactttgatacatgtgatttccttaggtatagtgttcttaatgcccccaaatctacaaataatgtcatcatgtaactgacagggttacactattccactgtctcaagaaaattatttatggaaaaggtatggtactgtgaccacataagccttctgagtgccgctattcttctgtagaatttgggcctgtcagtctcctttacaatcatgccctgtagcataggcagatattcttaccatccactgtgttgtggtcagccaacctaaattggaaagctcaaaattactttttaaaattgtttggaaggattgcgaactgtatgtatttttataaaatatttactgtagtctaactggagttatttattggtatgattcaagtctagaagtcattacctcttaactcaggatggatagaaaagatctatctttgagcaacatacatactcattttattgccatcagtttataagaactaatcctttttaaggaatttaaggtctactcttggctagagagacaaatgcatcaaatgcatatatatgtattcaatatagcaaaattggtttttggtttgatttttagtaacagtcatgtgtaatgcatgcaagcatgtatcaccaaccacacatatgacttctacttatatagttatattaggtagagcatattttaaaccttgttatatccccacctgtgtcataatgagctgtgtcaaatttgggttcatacacatgtatttatatttttattgttttgttatagtctttagcgcattcattcatatacatttattcaacaaatatttagtgagctcctactctgtgtctggcactcttccaggtaagagacatgcaacagtgaatgagctagcctgctcttgtgaagttgacatttcagtaaagggagaaaggtgatacacaaatgaataaacaagaaaatctcaggtgattatacaaaagaaggagagggattctcttgaggagtgattggtacgacaggactggccatgggatgatctggtagcacagtaattcaggaggagggagcagccagtgcaaaggccctcaggtgaacagtggccatttggaggaacagaaggcaagccagtgcagcgggaacattgtgaagagcagcgggtggcaggaccgaggacctgcaaggcaggcgggagccacgtggtttagcttcttgtggaccatggtaagcagctcggcttaattttacggtcttggaagacttcgaaggttttaaggagggagtggagatgaaagaagcaattggctgcgtggatgctttcagaacttcctttagtgtcatggtgttct

SEQ ID NO: 123714 - DNA, 1048 bp, Homo sapiens
gaacgaggagaattaataagtaaaagaggaatgctggcagtggcttatggttggtttttttttttcttaagagttctatgtttttaatggattaaaatcccaaaaagttaataaaataataataaagaaaaacacggaacaacttctttgtttgataaaattaaaactttgcaacccatatgcttctcctgcagtttaaattgtcataaatcctggaacatggttttggagagcagtttatttattagtgtctacttttccttaatgtaggtaaaagtatgattaatggaataggttgtagttggtgtattggacttgttggcccaatcaagggagatacagcaaacattgtaaggagagtatttttatcccctggacaccaatgtaggcaaaaattattctttccaagagcatctaaattcttggtaatacccttgcagataaatattattgtgactggaaatttaatcaatttcttgttgattgttactagcctcctctcctcacctttattcccctttgggcagaacagctcacttgtgtaattttgcctttcccatccttgcctggaattggaggcaaaatctatatcattttaatgtttaattatggtaaaggtatgatatctataatcactggaaaaaataaaggaatattcttcatcacagttattcaaatggaaaattaaaatggagtcaccccctcctcttgttatttcacaataaattacagtttgatcaaatatttaaatgtaaaaaagtcaaatatattaaaagaaaacaaatgaaattttttttttttttgagatggtgcctcactctgttgcccaggctggatggagtgcaatggtgcgatctcacggcaacctccgcctccctggttctagctgttctcctgcctcagcctcagcctcccaagtagctgggactaccggcatgcgccaccacgctcagctaatttttgtgtctttagtagagacagggtttcaccatgttggccaggctggtctcgaactcctgacctcaggtgatcctcctgcctcggcctg

SEQ ID NO: 123715 - DNA, 1009 bp, Homo sapiens
ttctctctcccattgaagtgaaacatgggtctcatcagagtattcaaatttgtctctgtatttgttacagtgtctgtgtggaggaggagaacgttggctattatgtcctaattttacatttgattaaacctgtgactttttttttcttactgctaatttttaagtctccccacatcaaagttaaaaagaaaaataacacaatgaataatcttatcttttcatttatgaattagaatttatttttgactgtataatggatacttaaatacatttcacttagatatttatacctaagctaaactcattttcttatgacattaggcacaaaacattgcatttaataaatatctgcacagtatttattatgaatgagtgatggtctttttgagattagagcagataaatgcagattataggcaaagaattagtattttagcatcaatgctgtgtcttcccagtacagtatccagtctttccattgagaatttcccaaatttttcagttgtatattcttgttttaatcggattaacacagatctacttctaatttatgtataagaatgatgggtggttttgtcttatgaaatatagttattgacttttctgttattgttgttcaaatttatgacaaaaggaacaaaaaagcttagctgatttcggccggtaagtttaatgactactacctggaaattaagtgtgaaagttgaaatactcctttgctcccactagagggggattccttccaacttaggtaaaaatgctcttagactcagcgtgaaaaccttgtgtgacattgatattccctttgtattaaattgaggataacctcatgtttttaaaatcagctgattttctgtagttgctgatattaaaatcttacagaaatagaggatgtaaaggatacttgaactagggtacatatatatgtaaacaatagtgcttttgaacaaaacataaatacttttgtagagttgctgtaattaaattcgtttaaaggtatattaagagt

SEQ ID NO: 123716 - DNA, 1070 bp, Homo sapiens
aatttaaaaaatagttgaggttagtaacctagcattgtgaaagtcagggcttgggaaattcaaacatgtaatcttttttccttttcttaaatgaaaagtctataataaggccttgtttctaaatctaacagccttggaaattaaaatgtaaacagaaatgctgtcagtgaaacttacaatgattttttctactataattgatccaacatttcagtctttagcctaaaatcatatttggtatcagcaacatatggttttctatgaaaacgaggctgctcatctccatccctaatggtagtatctttcttttgctttccgcaccaggctctgccagtgccagggggtggtcagtgagcctggctttcagtgaagcagttggagaagacaatttgcttccttgtttcttcttttgacccttttaactttcatactggatgaaagtcttattgtcatggccttcctttctatattttctgtccacaagggaagaatacaattttgttttatagcaggatacattagataggcctatgtgccttctacttaaacacctgccacacatgcctagttttaaaaggtttaaaactgacagtgaagcctgttacagtctgatattgcccacccaccccgtcttcctctttaaaaatactcagatgtgttctgttgccttctttccttgttcttttccatcgtgtattggtactttgcaatagtcaaagttaaaagctttacacacgacactgaataattatgtttaaaaaacagtaattatcaatacacgttttgttcctcgcagctttttaaaattcatgttaatgagctctgtcttctatgcatgagactgacaggcagtcttgaagttttgccatcatttcacaacttgttgcttagacactgcctgccttttccagagtattgctttcaggaactcttgctctgcaacattccagagatccagcgctgcccactctgatctgagcaggacaagaatctactggtagcacacatgcatagtgagattgctctacaaagggcagcttcccctcactgtctgtcagtaaaagaccaaa

SEQ ID NO: 123717 - DNA, 1081 bp, Homo sapiens
ggtgagaaggatgattctactcactccctggattgtttttgaggaacttcaaccactacgtccacatgatggcagatggattcatttgataggagctcccgccgtcttatagaactgaaacccagacggtgactgggatttcagcccagctcttgaagatactcacagatctctctttcttgacaactgacataaatggaatgccagttttctcagaactctcaattctaggccatgcctgtgtctggtttctgtggctagactcaaagaggtttttgatagtgcctaaattatgtttttccttatgatttcaggttgaagtcttggcctcggaggatgcagcctttggactcaaggtgtgtagtctggtgtagttcattgtggaggtttttgtcagttcctcctaggtggatttgaaggttcaacagaggggacttattttttttttaatcataatcaaaacactgaggtttaaaaatcttcacaagtttaagatttctcttattgtgattaagattagactgtggtagtattttcattaccttctttgttgtgtagaaagaaacaatacaggaaaacaagagtttcgtttagcagtaattgacttttaaatttcaattcggcatagcacaagatttgcttaaattttgccccagtttggggctactgaaatgtaagatgttatcagagtgctgtatttagttcatagctccagtgttattcattgatttattaaacgtccccgcttcagacagaacccctaccgtccagttacaaccggattgaaaacccagctccttcccgtgaggacctcatgaccagctgacagatctaagcctataagcagataaatcatcccacagggtagctgtatccatgcaagaaacatgccagaggctgcgagtcgggtggagtggagaatgggaaggctttctaggaggtggatccctgggctgagttttgagggcttaggttatactgaggcaagaaaggagggcaggagaaatgagagctattttcgggtagaacagccaccatgaaaaatatctgaggaagctaaaagtagttaagtttctgtctg

SEQ ID NO: 123718 - DNA, 1027 bp, Homo sapiens
attgactccatgtatctctggggacattattttggcactagtttttgaggacttaattttctagtaataataaaaatgcatatattctcttatccccaccctcaaacacctgttcatttgggacatgcacatgtaattagaggcgtgtttcaggacttgcctgtaaaattcctttgcatgcagttactgtgatcatattagtaatcatcaagctacttgagattttgttgggaagaagcaaagaaaatatcctagggaagatgggggtgattttgattgcgtgtgttttaggttctctgcactgccaagttttaaagcagattctgtttcttcagatggtgaaagccctcctccttccctcctcctgccttaaatttggcttcttcccaagccatgtcaatttttgcaagtcagttgagaatgtcaacgtggctggtgttgaaagagccaatatgttggaatatgcttaaagccaagtagaacatttatgtgaattaaagaatatatcagggatgatttttaaaaatcagatttggattaagaaacctgttgaattaatacttgcataacagatgtatcactgataaatacttgtaaaagatattcccaaataagcaataaaagtaccattttacaaccgaagtaatgcatcctgtgggtccatttgcaaagatatgccaacagaaatgcatgcagagctctggaagtgataatgcaaataaaacatttcacattataacttaaaataacaagtttggaaggaataaaaagtctgggagactatttgttttgtctaaattctgcttttactctggtcttttaacagttggcttttgataatgtattactgccttagtgtgttcctgtgtattgaaggaatacattgtctgacagaattgtggttgaaaatattacaagttctaaataataagagtaataaatatcatatcttgtttgctttgttgtcatagtcgcctgatctcatgcttccctgaattcggctggtgtcttgattacgatggaatca

SEQ ID NO: 123719 - DNA, 1103 bp, Homo sapiens
aggcagcttgaggctcacagcgtcttcctgcctcactcacccgtgctgggtgctgaggacactagcggtggcagacgtggttctggccctcatcatttgcaatgcagttggagagatggggctgggtagcacctgaccagcgatatgtggttaataagacatagaagagggaaaataccacgtggtctggggtgatcaggcattgaaggagatttgacttagctctttgcagaggagggtagcctcacagacaggcaggaatgaataggcagatctagctggggctgcggattttggtaggaaagatttggaggccccaaaacaccttgcctagatgtttcaatgagatgagttatagccaaaggtacttcagcttggaaattgtgtttttgttttttttttttgataaaaatatattcatttatcgacagtgtgtggtatctgttggcatgagaaaagatttaagagacgatatattgattagttgtgtatctttagaatcaaatgagaaaatgtgaaagtgcttggaaaatagtaaattgatgtataaatgaaagttttacattatcatgtgtaacagtttgttatataatagagttgtgtgatgtcaggaataaaagaagctggtgaaattactccattcgctagaaaatggtttacagaatcagctaagcccttgctttttagagagataaagttacttatcgtgttttcctttcttacctgaaatcttcattacatagtgaattgtttgtaaatatttgatagtatactgcagaatatgaggttaaaagagtctgattcatgtaatggaaattaatctattggtaagtcaaataaatgtttattcttatattttaccaaaaggtttctgagattagagtattgacaaagaggttctgagactagtttactcaacatttattaattgttttcagtgggccaggccctgtggaaagctctggggttaaacaatgattagcaagatacaagtgaccctaaatttccttagcacgccccttctactgcctgggagacctggtgggctctaaagctcctgcctggcctgggaaacattttgtgagggagagagagcaagcttt

SEQ ID NO: 123720 - DNA, 1073 bp, Homo sapiens
actagtagtttttcttaaataatacttttcaataacaacaatttcacacacaaccacaaagtttcaatctggttaacatatagatttaaacttattttgaaagcattttaatatatgtgaagcaaaatctgaacttttttttttttttttttttttttttactattctttcattgtctcatcacattcaagagcccgaccatgctgtcttggcacagattcacaatcctgagatggtaataaatatctgctgatggtttactttacacatttttgattcagtccttaaccccctgctattttttccttctcagcttctctgagctgtccttcctttccatctcaacaaattccttgtccacaccaaggttaattttgccccatctgtggttagttaactcacaaatgatcttttacagcttcttccccctggagctgctggtgttttttattttcagcctttaaaaaaatgttacagagtggagtgctctgcccactccccaccccacaacctgctgtggcacctctggatgggcagagggtcttgtgtggtctgtctcacctcctgtggactcgtgactcaggctgtcccctcaactgatcaaccaagacaatctttttttcctgtcaaagtttaattccttctaattctttaattgtaatatatcctatttgtgtctttcttatacattttatcatatatttatttttactgcattaaattgagagcctggctgcatttgaatttacatttgttagctgtttgcataatggcaattataatagtaaaattttaaatgggagcaataatagtaaatatctcaaagcggtgaagatagagttacattacttatctgcagcacttagaatggtacggagcacatggaagtgctccacatgtcaaccctgcaaggtatggcaggtgatgtcccatttcatagagaatggaacagaagaaccaagaggtgaggtcacctgcttgacatctcgcagttgtggggaggagttcgggcagtgggcgtgggtattttaactcctggttattattgcctttaccatctcagggttgtcaga

SEQ ID NO: 123721 - DNA, 1006 bp, Homo sapiens
gttaattgctgtagacacgagtttgatttttaaattttcccttgtatattcatagaaggtatgaggacagggtaccataagaaactgatgacggtggtccgatgagcactcgctacttgccttcctcctgtgatgtttgttgtttcatacaaagtgtctgttaatctggtatgttttaaaatatatatatatatattttttttttttttgagatggagttttgtttttgttgcccaagctggaatgcaatgacgcgatctcagctcactgcaacccctgcctcctgggttcaagctattctcctgcctcagcctcccgagcagctgggattataggtgcgcaccagcacacctgcctaattttttgtatttttagtagaaatgggatttcaccatgttagctaggctggtctcggactcctgacctcaggtgatccacccgcctcagcctcccaaagtgctgggattacagccgtgagccaccgtgcccagcctaaaatatattttaaagaaataagttacatttcagaatgagaatggatgggtcctactgaccatcctcatcttggatttgaagaatgtagagaatctttaatgtggtggcttttccctttttttttttcttttaaacatttttgaatcttagattactatcaagttccaagggagagaggacagtttccaggacaggtgaatgagccaccagccattttttcatgccagtgtgaaatgttgagtaagggaagaaggggtggcagctggggggctaacatttactgagcagcaagcaaataccaggtgctttgcatttcttttaacacaccaccttaagaggcaggtgctctcatgcccctttgacaaaggaggaaacagcctcacaggttaggtagctgatactgtgaggcatgcggctaataaaaagccagtgccttttccacaccaagatgcttatcattaggggccctttcctcctctgttagatttttttttagatagttgtgctatta

SEQ ID NO: 123722 - DNA, 1010 bp, Homo sapiens
gttccagtggaagatctgggaggtaattattgcagtgggagagatttcattttccatcaaagcaaaaataatacttgttttgctaggagaggaaggagatgcacttgaattattaaatgattttaatttcagaaaaaccgtgaacctcctggaaaacactgatagagtacagttttttaaaatttctttctctggcttgtttttttttcctttggtgtgggagtagaaaggagaaaaacatgtattagaggagtggactttagaacactgaaaatgggctttgaagacagagagctggattgaaatcatggcccaaccacctcaccctctgaatctgtttcctgtgtatgaaatgcagttgtctctacttactgagtgggctgtcaggataaaaaaaacaagaagtgctatcatttattctcactgtttgccaagcagattccaagactttcttctgtctcattataaacaaagattttagcagtatttgtactagtttgtcaatgaagaaattgaggtctcagagctaagtcaagtgtttaaggctgaatggctagtaaccagtagaagtaaggagtgaaccaagttcgagtcacaaagcccatgctcctaaccacgaagctttgctcgtttttctgggaagtacaggccatctactggtgccaggcagggtcactgtgacagtgcatccagggttaatttcctgagaacaaatggggtttgaaactggcctggtgctaagacagagtctccctgctcccctcattcctgagaatggggtacagtttccttccacagaggaaccgtggttttacggggctgcatcttgcccatagggccactttttttttgcttctcgcgaaggttcctcctgctcaaatgtgcatgtatagagagtttcctatatcatttagcttagcagtgataggttaagattttcaataatatttattatttgctggatctgcccgacactttgtctgctttccttgcatttttccgcatgtgtg

SEQ ID NO: 123723 - DNA, 1038 bp, Homo sapiens
aagtccagctttacttgtttggatatataatttacttggataaagaggaattaggcaatatgatgggctagtgagtcaagttcttttggtctctcccttgttcaaaggtattacagtgcaaaggaaatgtgaattttattcttgtgcctttgggagtcccatgtcttattttatgctgtctttgagactctttatagtggagtgaagtgatcatcagaggaaactttttatcctactctagggtctgggaacgtgctccagggaacagggtaattatttataaaggtgaggtatagtaacatcatggcgtggtgtaagaatggctcttgtggagaggtagtatggttgagtgtaaaacacactgggtgtccagtgctcattcaagtccttattgatactattttctttatcatcatggttattattattggcattggaagtttctttctgagaccctgaataggttgatgaccacctccttttgagtagtttttgaagtaacatattataaagtggttatatgctcttggaaaaaattattatgtaaaattgcacttgagtgctagcacttgaggtattaagtgaccagctgcccctgtacaaaaatgaaaactcattttggaaacctcttatctaagtgagtctatgaatcataacagaaaataagaaaaatgcatggttttaagtttgacttttgcgggagtactgcatttgttgaatttgattttaaaatataaaaatagtctccataaaacatttccatctgtaatctagttaagctaatcatgtaaaaagtttctgaattctctacttttctaaagcattcagaagtcttaaaaatgattttaatgaaaatatgaaaattttctactaggatacttgcataatttcatatatatcacccaaaatgtttattcttgtctggtttttacatacatccacaaaatttttgatattcttttactaggaggtggagcttaattcccctcccatgagtgtgggctggacttagtgactcccttcatgagtagagtatgg

SEQ ID NO: 123724 - DNA, 1005 bp, Homo sapiens
tctatagtatgtagtcttcagttatcaggacaagtatcttttatgctgtaactcagccttgagaactcgttggcacattgctcggtcagtgatctgggagtccagtcattgcaacggggatgcactgagcacctgctgatgggggcctccatgggagccatggggggcacaccagtgatgcaggctgaagtaaaggctttgtctgcgtcctcttctgctgagggagcagaagacagtttcttcttcctcctctctcatcttccccttttcgtctttagcacctacagtctgtcctcagtaacgtaaccttcaacagtaacttggactctctgagcttccattgttttgtatctgtatcaatggggtttttaatcactgcctcagagagtatggtgataaaatatagatggcattgacggtgaaaaactggtattaaaaagtaagatataacattaggacccatttctgccaacataacttcaaagacatttattttcacaatatcatatataaatacacacattattattttcttttaatggcactttattgtaagaatttctcggccaggcacagtggctcatgccagtaatcccagcactttgggaggctgcggcaggcagattgcctgaggtcaggagttcgagaccagcctggccaacatggtgaaaccccgtctctattaaaaatacaaaaattagccaggtgtggtggcaggtgcctgtaatcccagctactagggaggctgaggcaggagaatcgcttgaacccaggatgcagagcttgcagtgagccaagatcgcgccattacactccagcctgggcgacaagagtgagacttcatcacctcccccccaaaaaaaaaaaaactttctcatcacaaagtttggtcaaaattgtgactgctattacattacaatatcctagtttgaaattcacgtagtccaccagtgtcaaattctgaaaaaaaggactcaaagcctgtagttttttactttatgaagt

SEQ ID NO: 123725 - DNA, 1940 bp, Homo sapiens
ccacatattaagagtataactgaattctcaccaaggcatacgagagtcccagttcctaaagatattcaacaggtgattataactacccctttaataaaatgaccaattactttgataatttcaatttgcatatttaccttaacttatgccagaaacagggtattatttatcctcttagcatatgttttgtaatgattctgttacatcagagcttctgttgatgagtgccactaaagtgagattgttgatgaggattggccttatttttttgtggttctattcaatacttgccacagcatttattttctaaaacatttctacagtctatacttatcagtgtctgatcacatgcaggcactggtcaaggtggagcatggtcgaggcgttcttactgatacaaactcgtgccttctcttggacacaaggagcccatgttctggttaactctgtgttcatttatttcacttgtcatgcatcgcctctatcttctccctttattatgttctcgaggttatttatttggttatttatttgtcagttacttcatcctcatccagctttcttatatcagacttcatccattcaagtctaccgtacaactagctttcctttatcaccaaaccagataattcattctatccttccaaaatcatgggcgttagttttggtgctttttaacgtttcacctcttttatattaaaaaaaaaaagtgtattgtggaatgtttagaatattacacatatatatctctaaataaaagaacatacatagcacactaattatgaaacatcaactatcaaataaacattcatgaattcaccatccggtttaagaattagagtatcataatgccattgtatctacctgtatatttcttccttatcccaagctctatacctcttcctcacttcaaatatccttttaatcttttttaaaatattgttcttttggtttttgggtttttttctaagaattttattacaaacattcatagagtatatattgttttattaagttcttagctttatggaaatgtattatatttggaatgactataatttatcatccaatatgagacacttttgtgcatgcaaagggctactattaacaattacagtaggatagcggcataagccagaaggtcttgggcaggtcagataatatggtcaacccacttgtagtgtaggctaaaatttgctttttttaactaaacgttacatttctaagattcatctgtaatttgatataggtatacgctcagtgcattttgattaaagcatttcgatgttatctttctttcaaagatatatgtttgtcctcatagtgtttgtaataacctggacttatctgctgcttttaactttttaatgctatgaatactctgtagtctagagtttttaagacagtttttggtgttgagatggtttgtgagatgtcacctacctaaatgttggaaagttatatgtaaaatattgcgttactcaaagagcttactctttcattctaaattgagtcaaaaggactttttctaaaaacctaaatgaaaactttcttgaggtataaagatataatgcttttaaattttaaattcctgacatgagtagttaaccatctgaagactttccacatgtctgtccttccaaatggggatttctaaacttgtatattcattgtttggatttgatgcaatacagaagataaaacccaacagaaaagctcacttcgggcatgtgatcctgggtatcaggtgttacattatatagtattttacagaggaagtagctcagcaaatttaactggcctcagagtctgtggttcagttggtttgcacagggtaaaagctggtgagtgggttatacaccatcacaaaggatgcccattcttcgcagtgactgcagatgcgtgcggacggagagcacaaggatctcactatcatttct

SEQ ID NO: 123726 - DNA, 1031 bp, Homo sapiens
ttcactttggcgttaggagggctgctgggttttggatgtgtattgaacaggtcttgggtcttacgctgggcctgattgcccctaatgcatggtggaagctgactcagcacggcatctgaatgcaccgctgttgccagaagattctgcggatgttaatttcacttgtcttgcctccagagccagccattccagtttactaacaaagcaaaaatgtaaataagccaaacttaaaaattttttattttattggccagaggcttttgtcagcttttcctccatgtgctgtaagcagcggcagtgtttaaatattgagaggagggagctcaccgtgggggtgaggaatggacaggcaggtgttaactgttcatagcctggctacttttgtttataaaactaagctcatctgttttattaatgaagatctaaggatagtaactgaaaattcctgaatagatttttccgcattcttttttaggcattaggcatttggtatttgtactaagtccagtgtaagtagagttaactcactttgatctggcagcagaaggccactgattataatagattagggtcaaaaacacaaaattaggtcttcacgctagcacataatgagtagctgtttgtttcatggctattgttcttcttgcttggtattaggtaagactaatcaaaggcaacatcatcttagctatcatagacagaaacaaaatagagttgcatcaaatatgaaagtagaaccctttttcttttcacatttcgtgcttcgctgtttgaggcgctcacctgccacctggcctctcggcagactacctgctggctggctgggcatgagggatgggtcagggtgccttcagagctgagactgtgaagccgggaggcacaggtcaggaggaatctcactcacattccaggagccaccttcactgctcccatctttttctactgatacctcccctccccttctccctctccagccagctgcgcttcaccctactccagtgatcacctctgcacgtgtgcctcctgcctgg

SEQ ID NO: 123727 - DNA, 1030 bp, Homo sapiens
tatcattggagaatacagaagtgtgcaatgatggaacttactctaattcatagtatagtgttttccagttgtatttttttccattatgcttacatcataatagacattgctgaggaaagaacacgggggctctctttatttatttttttaagctattttaatgttaaagtgccttcataaagtgggttggttcactgtgcccagcagtatgcgctttaaaaattattaccacactttgtttaagaggttttacttgtgaccaacacatgtcatataaaaatctgtaattttgaaggtgtttattgaattcggttggttcggagggctctgaattttcttctttacatgggccaaggacacaaatgagtcttctgttatcactttctcaaatgcattttctgagtcatcatctgctgtgacgatgtttaaactatgcctgtggaagatcaagttgtttcttagttactgtagttactgaatcatagtaactatgacttagtagttatgaaactatggtagaaagatagggagtaaaggaaaatgaataagatggtttgggtggatctgtatcatgataaagctcttgtatctttaacagaatgaatttggtatgtgaatattctcattgctttaaagagacatctgtcttagaattgtgccacacaaccagaagtgctgcttggctgtggcggtattttatgaatcatgggatgcattacttacagccttttttatttctacttgaaatattgtgcataagagcagtgcctcgggcgtgcactgtctaagccacggtgccctgtgttcacatagaattactgtttgtttttactgtcatgagtctatgaatccagcctgtcatgcagaagtgatcctgataatgtaagcacttactgtcttgctgcagctgattccccagtgacattttaaaaagtcagtatttggctgcagagtgctttaaatttctaaatggactatagattggaggccttagggtatttcataggaagcacatgaccctgcagtgagc

SEQ ID NO: 123728 - DNA, 1083 bp, Homo sapiens
gagtgtatttgtgtttccaatttattgaagcaaagagggagggtagaagataaaatagcatggtcctcatgtcacgagagctagttagtgccttgaggactgtgctaaattcagctgctttttaaattccgttacatttttagtcttagaaatgcatttaaacctctcagccaaaaagtgagttgagatcatcagctacctctgatgatttttaaatttcaaaatctcatctcctgccttcacatgactcattatctctcttttatcagtatagtaagaagtatcttcctttaaataatattctcagattatgacttattaagtatttgctatgttcagagagggattgaaggaatacagataagattcctgtcttaaggagtttacattatatttggaaaagacaaactgagcatacacttaaaactggaaattaaatagatgctattgctgtattagcaataaagatcaaaagagatgcagaataatagtcccttctttagtgatcatgtatactgcattttatagtagtatgttttttgtttcttaatggaggtcttctaagtttatgttaaatctctgactgactaatgatgaagatgttttagaagtctattgatattactgtactgattggatattaccatgagtaattgttggccactctgcatgcctgcccacctggagactcacgtaagagtcaggaggatgagtttggcccagctctcctacgttttcttaaatgcattgcagaagtgtgtgtcaagaaatttcagctacagattgattcatatatgagtttaggaactcattcagtaacaacttttcagcaagtgtttagctaaatatgtttattcatgtttcctctttgtttcccagggaaaagatgaactattacactctgagctatgtctttttttaatggggctataccttttgtgatcataaaaattaaatgtggctgtgtcttggttttgcatgactgcattattaatgcaaagggttcccccatctccactttccctcctgtgttttacaggtagtcagatgcctccgcagccacccgggagccagtcagaatcc

SEQ ID NO: 123729 - DNA, 1033 bp, Homo sapiens
tgaaagactgtgagagacattattatattgttatagtttgttttcacactgctataaagaactactggagactggatcatttatgaagaaaagagatttaactgactcatagtcctgcaggctgtgcagcaggcatggctggggaggcctctggaaacttccagtcatgatggaaggtgaaggcaaatttagcacatcttacatggcaggagcaagaggaagagagcgaaaggggaggtgctacaaacttttaaacaaccatatctcgtgagttctcatgaggtagcactagggggacggtgctaaaccgctagaaaccacccccatgatccaataacctcccaccaggccccacctccaacatttgggtggggacacagttcaacatgagatttgggtggggacacaaagccaagctatatcactgtacattcccttttgtgtgtgtgtgttggttaggcaacaccctgaaaaggaaaactttctattttaaaatgactgttacgttagaagatgctttgccttgcatgagtgaaatttcctccagcactgggtagcaaggctttaaagaaaatggctttattatttattaaaacttaggaagaaatgttagctcctaataacctttgatcaaatgccacctgatcaggtgtctaaatgacagtgactttagtgctttggcacaataatagaaacatctgtttgttggaccatcatttggtatgtaccagcagcatacacaatggaaagcagatctaagaaaactcttactaggaaattccccaaaattcattcccccatattggaaagtaacttaactttgtttatactcttacggttgatatatacctaccttgtttagggaagtgctgaaagaaacaggccaagaaatacattagtgagttagtatctttttttaaaacgagtatatcagactgggcacggtggctcacacctgtaatcccagtatttgggaggttgaggcgggtggatcacttgaggtcaggagttcgagtccagccttaccaacatg

SEQ ID NO: 123730 - DNA, 1063 bp, Homo sapiens
cttacctgtgtactttgtcctgattcttaaggtcctcagcctggctcttagtaggtgcttgagtcagtgtttgttgggtgaacaaatgaaggaagcataaccagtcaccgtgctgcccctatgggccaggcaccctctgaagcagcccagatgtgtacagtgttggtgacccattaacagctgggattacagttgattcacagttgaactctgttccagactccagaactctgcgagtggagggaccgtggccttgtcagtttcagaactccagggcctcatgttttacctgctgcttctcattttaatctgcagggactttggaatcagaagatctgggtttaggtacaagctttatcactaactagttttgtatctttggactatttgtgaaatgaggatcatggatatattgcacaattcaaataagattttgtatctaacagtaaaaactgcaaagcaccgtgaacatagtaaatgtaagatcaggttcagatacctcaggtgagacctgggtcgaaagccttaaaaagtagtttatttgcttctccagggcatagcgacgtacgtactttgtctttttcctcagcactgaagtggacttttgcagctaaaacttaaaggatttgtgtaaggaatgactggatcttctgtccccatctgtcatctgggtgctcagtctgacccctccccggactctcatttgcccagtgataggtggtataagttgcaggaccagtcagtagcggaaaggagtttgtggggtggatggggacagcttagaggttgctgtgcccggctccaagtatcaggctctgtggtagtggggaaggagagggagtcgttttgccagttaacctaatagcacagctggtgtggcgcggggggcctgggttaaagccttgaacgggccattagttcctgtcttcttcaaagtagttcatgttgtgaagagaggaaggcaggcaaataaacactgaacatagttaaatgtaacgagaatatttttttaaatctatttttctctccaaatggagatgtgacacctatttgtgaagagaaa

SEQ ID NO: 123731 - DNA, 1148 bp, Homo sapiens
tcacaagagaagataagggaggagcagagaactagtggaatcatgtccagcatgcaccattggccttcctccttcctggaagtggatgtaggttttgtcagatacacacagcatccttttatcaaggtttttaacctgatgtgtgtaggtatacatatatatatgttttttctaagtcacttttagcaataagacatttgaatttaccaccttccttatattttgtttatttaaattagacatgagtggataatttagagagaatgagataatctggcacaattcccagagttctctcacttctgaaaataccaggaacattccaggtgaagatgatgagtgccactgggaaactgtagtaaaatgtttaccacttctacaacaaaaccaggtttgcctggtgtagcgccttagtatttcctagaggccaggcaaatagaaggtgaggcccagtcacctttttacctgctggttctcagaaaatcgcatctttctgatgtatagtactttacagcttgaaaagcgagttattatcttgtgttctgaagatgtttttccgaaagatcttaaacagtttcagtgctaccaatggagcattgtttctttgccttagagggctttgttatatttactttccaaatatttctgttggtaggaagactatggggatacccaagaaagcaaacgtctgtatagagcctctcctgcctttgttctaggcttgtcctgagagtgagacttggtgttttgcccaattctctttatatcacatcatcaagagttttccatgttagtaattccagtaagcgttaggaatttcagtcccagttgacagtaatggtctgcttgttccctgtcagtgcccggtaactatgacatgtagcagtttgttgcagagcagaggcaggactgtgggtcacccaccatccttactgaacgtggtgggtgtcgtcaaagccaggtttctttagctgtcatggaaagaagagagcttagtggcagttggaaaaacggtttgtaacttgtggtaggcacagaaaatgcgggcttttgctcctaatgtaattggaagcaagatgcagaccttgttctcagaattgggtgtggctgaaggtctaggagttaactcttaagtccataagcccttc

SEQ ID NO: 123732 - DNA, 1015 bp, Homo sapiens
ctttgtgtaatattgtaagttttacattttaaagaattttaaaatgcatattgacctaagagaaatatggtaccttatgtatagttcagaaaacaaattctctctatttattcccacaaataggatttaatgcaacttgcggtaagtcagctttcattttgatgaacctgtatttgtgatcatctacttgatgcatttctctggctgaaagagcagcattgtgtgatagatctaagtagaaagatagaattgaaagaagctgtattgaaatagaactttatttttcacagaaaagatcttacttaaatatgataaccagcaaataaacacatggaaaatcctcaaaatttttttcattagggaaatgaaaactaaagccacgttgatttctattacatactgattcgaatggctaatttttttaagttggaatatcaagtgctggcagttagaactctcacacagtatttgatgggaatatatacaaaatagtacagccacagtttggcagtttcttataaacacgtacttaccatacagccagcaatctaatttctagggttttaccaagaaagatgaaacatattcctaccacacaaagacctgtatacaaatttttagcagctctactcgtaattgccaaaaactggaaaccatatccaagaatggactactactcagcactgaaagggaatgtacagatgcatgcaacggtgtggatggatgtcaaaggcataatgctaagaagccagccacgaaagcctatactgtgtgactccatgtgacgttgtagagaaataaaatgacatgaacggaaatcagatcagtggttgccagggggtggcatggggataaggttgacttatagaaggggaagagggaacttttccctcctttcatttcttgtgagagaaatattctgtaccttgattgtgctgtcgattacaggattatagaattttttatatctcaatatagacatgacaaagccgggcacattggctcacgcctgtaa

SEQ ID NO: 123733 - DNA, 1049 bp, Homo sapiens
gcactccagcctggatgacagagcaagactctgtctcaaaaacaacaacaataacaaaaacaacaacaaaaaaaacaatattttgtagtaactgttataaaaatggtaaacatcactggctacaaaacaagataaatgcatatttagccctaattcacaactgcctttatcatagtatgtagctaattatgcatttcttttttccacaagggtaagatttctgatttattgcattcacctccattttctcctccatcatatagggaatgacgcagaaccttgcccatagtagttgttcataactgttgagtgattggaacttagaagcaaaatttcgtatatgagtggaaacatttagtagtttacaaaaagcagtaagctctgagtatgcattgcaactatcaactttaaatattctggagtcaggtatagaaatttttgtgatctgcctgaaatgatgatggtgacttgaatagggtctagcttctgcttcctctctctggtgcttgaatggaactcctggtgggtagaaatctgaattcatttggtgaccaattttccaaagctagtgtgccaagatgaacccacttgaaaactgtgggtccttggacttggctgcaagaccagtccagctgaggtgggctggcccagcatctgccgccttcattgtgcttaatgctggatccatctgttttctgtcaaagccagtgccaacaaattactaacctattagagaaacatggaaataagattgcacttctcattcctggcttttcctctcatattttgcttggcttacatatttggtttttgtttattttgggaagaaagatacgttatcgagtagttggggggggcatgaatcatttttcaccccatgcacacatttttaaaagatggggggggtgatgttagtgatgttgttatggccattgatgacgatggcagctgtcatttgttaggcagtgcggtgcctggcgctgtacttgttactttcaacctcttactcattatcgtagtcactttacagatgacagaaccacagttca

SEQ ID NO: 123734 - DNA, 1007 bp, Homo sapiens
tgcacttttcacattgcatgctttgttttgcttttatcctttttcttgttttcacccttgctgctttactgcacacacacacacatgcatacccatacgtgcacgtgcatgcacacacacacacatacccatgtagatgtgagcttctcgagtgcaagaactggattgtatttagctttacgtcacctgtgcctagaacagcttctggaatgtagtaagtgtatagttatgttacatggatggagaaaggcttccaaaaaatagtaaggactgattgggaaacactaatccatattccacacacacttgtctttcgcatttatgtaatttcaacattcagttatcaggaggcagcacattttattggtcaaatacatgggtccccgagccagtttgcttgagcttcagtactaatcttctagctcttgatttttctcatttgtaaatggagtcctggggtatctatatttcatgtggttattggaagaaatgaatgaattcattggtgcaaagcacttaaccaagtgcccagcacacactgtggttcagcagctgttatgattgaagtagtatcatgtgtacctttgatttacttgaatctatctacacacaatcaaaaggtgtgaaaggaaagggaaaacaactgccatccctcacccccgcctccggccctgccctccgtccctcacctccgaccctgccgtccgtcccccaccccagcctccgaccctgcccgccagccctcacccccgcctccgaccctgccctccgtccctcacctccgcctccgaccctgacctccgtccctcacccccgcctccggccctgcccgccagccctcacccccgcctccgaccctgccatccgtccctcacctccgcctccgaccctgacctccgtccctcacccccgcctccggccctgacctccgtccctcacctccgcctccgaccctgacctccgtccctcacccccgcctccggccctgacctccgtccctcacctcc

SEQ ID NO: 123735 - DNA, 1011 bp, Homo sapiens
tgtggccagctccctgaagcctgtattccaggactcccggagagtttacaccctctggtttgtcatctttgtacaaccgcagggccatacaccagacagatggaaaggcatggtgcagcaggctgccaggagccaggcacttggtctcactgagtgttagcagtgttagagtcccatagagaaagaagtgtagtataccgcactgatagtaggtttggggaattctatttctgctacttactagctgtgtgactttaggcaagttacttaacctttctgatctttattgcctttattaatatatgagcataattccacctaccttcctccaggaatctaaaacattaaatgtgtatgcctagaatgtgcaccaggcatgcagtaaatactaaataaattactgtcactatcattaccagcccctccctgttctggtgtaaaaaactgaaatccaaaggaccagagctcccagagctccagtgacagagtcaagacccctggctttttaaccaaacttttaaaactacagatgtgctttaattaaggaccattgtaaccagcaactgacatccaaggcatggacctcattgttagtttaaaggtatttcttaaaacctgtagtgtgtgccttcatcatcttctggtgattaaagatggacacggatggacagtgctgtcctgggggagaaatcctagatgagggttggatgattacttcattcagtcatttgcctggtggattttctattctgattctcttttttaccttagtataaacaagtgtctcaaggaaccattagtttcatacatgttagttacactatatatgagacggaatttaatggaagcttgaaaaggcgaccatctttgtaatgccttttttcaagaataaaaatgttctgtagtaattcatccctttaacaattttttttcttttttttagtaattctcatgtgcaagggattaattaggcccagatcctcctctcaggaggcttccatacctagaaga

SEQ ID NO: 123736 - DNA, 1261 bp, Homo sapiens
gtgtcctgggggtggccacagtggggagggggcgctgatggcaatgatggggtatgcagggcctccagggtactcgctggccccactctgtgccatggagggtcctcccggtcagggctgtcagggccttgcgtatccaatgagagcagtgcgtctcccgagccgttcttagatcctgtgtgtgttaccttcacagtggactttctgtcttggcacatgtaaacatagtcatgaacatccgcggatgtacatagatcagccctctgtgttttcaaaaacaagaaatcaaatattttgcagtctggtatattaccatgaaatgaaaagaactgtgcatttctgacctatttcaccatcttctggaaatgattttgcagacttgtaaggagactgagtaaaggaagaggaagaaagcaggcatgagtgttgaagttcggtttgactcatgtcatgtgttctttacgttccttttgaatatattaaatccagtgtggaatagctgccttaggaccttgacccacacttactttaagaaatcgttctagttcttaaatttcaatggtaaagccagaggctggtgcttgaaaagtatttacagtgctcaggcagcactttctgcagttacagattctttactgcccctttttatgtctgaactttacatactggattactcgtgtcaataggagaaggaacagtgccttgatttaacacgtccttgtaatagtcgtggtccttctcttctgggaaaggagaagaaatagtgcccctggagtcccattgccttgggaggcatatggctcgtttcagtgattccttgagaattctggtaagaagtcaaaaataagcatttaaataaaaagaatagtaaaaaccacagtaaggaaagagcttctgatccatttagtaaaataaaacatacattttataaggtagaaatattaaatagaaccatttattactctaaattctatccttatttatctctcaaaataatagaacagtgccacttttgataatttttctatttgcacacccaaaatgcctgttttaaaatatataatagagaatgaagaaatttggggaatttcagaccaacaatgtgtttatattcatgtaagtctgattttcaaatcagtgtaaattgtcagtaatttccataatacatattggcctagttctgtatgcttacaagttgcgtttgtgtacgctagcacatttaatgcgtaaaatagaatcttactattcctgccttcaaaat

SEQ ID NO: 123737 - DNA, 1119 bp, Homo sapiens
gccctgttcatcaaacctcaggtttattttcatttgaaataggcctggtttctggttcttcccactcatgtataaggctcatcattctctcccgtctctctccttccctctcttcctcactctgactcttcacatctggttggtgcctcactcgcagcccctgcagcccagtgttgcgcagatggttttcacagtggggttctgtagaaattcagctgttattccctggatagctacactgattccttactctagtcttgttcttccactaaaaagaaatctaaacccatatttttaacctgaaaatgtctgctgtatctgcaatgaatgtggagaaatcagttgttctatggtgaacctttgatgctaaagcctaaatagaattgattggatttctgagcctagtgctagaaaatgtggtgttgactctggagctgctgtgggcctctgacctgggcattgagctgctgtaagggttgatgaccacaggctctcagacagactgaaaggatcccagcacaactgcaaagtaatcagaaatcctttccttccaaaatttatttttaattatattgtttttgaagccatctgctgtgattgtcttcccttattgttgactagactacgtgcaatagataaggttttcaaaagaaacactgtgaaatgtcaaataattttgcaaactatagattatttgcacttatgaaattgagaaggcactaaatcctctaggacctaggtagaaaatacgcacacccagtatttgcctccaactcctgattagtaatttaaacatttgccttatttccacttgttgcctactcttttgaaggtataataattttgaaaaaataatattgatataagttgaccttcataggtttgggtcttaagcacacagaatgactgcccttttttttagataaaaaaggattttgccagaatgcggtgctgtttgcatttcagaaattaatatgctccccattacaatttcttttttcttttcttccttcaagggaaatgcaagggcctcctgcttcactctgtaacttgtgttggcaggagtacagtctgacgaatcacacatataatcctaaactctttctcctgttttcgatt

SEQ ID NO: 123738 - DNA, 1203 bp, Homo sapiens
tttttgataattaattaattctacttgaatgcttgcttgtttatttgttttgtaagactttttcttcattatttatccatgaaagggttttctttataaataataatattagtgacaaaatgaataaagtttgcgtgcatcaaagaagttgatttctggtaatgaaaaagctgttataaagaagcacctctatacaaagcatgcgagtgtgttaactgggtccaaactccttcacacagtgactttttaaaaatgtctgatccattatgcacttatagaagattcttcaaatgcgttacttctccatttatatgggaactaatagcagccattgactgaatgataagtttggcccctgacctgtattttgcatgttctatctatttcaaaactgcctacctgaaagaagtaaatactcaatttgggtatggtttagtgtaacatcagccctgctttatttttaacccatttgtctgaaattaataaaaacgtacaagttgttagtatgtgaatgaatttttagtttaataatgtgtacctatgttagaatcagttgagatagaacaattgtattctgcacaagactgctgataatcttgaaattaagtgttgatttttgtatgatatataaattataacaaaaatgtcacggatgtatcagggaattttgtaagcctcaatgttcttctgaccctagaagtgggcctttagtttcctactaaagaaattctgtaccattagagagaaaaaaaaaatggtgctgaagcaacctttattttacattcatataaagaatcaaaagatcttaaaaaaaaaaaaacaacatgcaattacttgccaagaaggcttaattaacatgctcatttctgtaaggcgatgtattgacgagcacggctcaggaaggcaagttggaggcaagaagaccctagctgtgcagaatctggcaatctagtcaaaaccccaaaaggaggctgctattaattatccattcactggtttaaacagatagagcctgaaggcttgaagagttggttgttctagtaaatgtttgtaaaattcacatgcagctctaggataaccagcattttccctttcagaggaggaaagggcgatattcgctcttaccttctctgtagctacgtttcgattttgcagcacccgtgatgaaagagaaagcgcttctaggatgggtatagcagacag

SEQ ID NO: 123739 - DNA, 1023 bp, Homo sapiens
caaaaaacacacgagcttatagcccacaccactggttcccgtgactggaaatctaccttatatttttcagcaagcaccgtgtggttgctcatcctccagatgctgtagcattttaacgaagacaccctttagccattcttgttttgacaaggaaaagtaggagtccatttaatgttttgggctctataatatcacatgtaaaaattttaattcactatgatcattccatgagctagaacccttttatttttaaaaataacatgaggtgtcactggaattttgccttctgggattcaacgcttatatccaaaaagggctttgttcttttttgtttttgtttttaagtgtataaaagggggagtttgggccttttatttaaagtaaaagtaaattcctaactaagaaaatgtatagtttgtgcctgaactagtagccttcattcctaattgttgtgtgatagcagtagtttttaatctcttctcttcttgtatttgttagctcattacttttttctcaccttcttccctctccctctgcccacccatgccccacctccacatgctgcttctgggtactagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggtaagaatgagtgagggagggggtgaaaaaggaagcattgtggataagttcttacagtggctttctttgaatgtgtggactcattttttttctcacaaaggaaaagctaagcctgtgtgaaagtcgccttcttgcaacccacgtctgtgtgctgtcagggagcactgggggaccctggctctgccaccaactcgcagcgtgacctcagcaggtcatgttcttggacctcagtttc

SEQ ID NO: 123740 - DNA, 1050 bp, Homo sapiens
gacgtcacatttcaggagttctctttctttctcctccttttgcgactgtgttgtctccagccctttaagcctccttgagtaagagcaccgcacaggaaggtgtgcacctgccccgtcagcagggctggtggccagtggcatcgcatcatgctttttaagttgggggccgttggtccaggggctcatttgcctttgcacgaggtgctgcttttgcttttgcctgacaccccaagcagtcttggggtgaggggatgggtacggcccagaatcacaggcccacttctgagggcttgcagctgctggaatgagcactttcacatcagtgcccaaaaacctaacttggaaaatagtgccgttgttgctttttaaatgttttgagatgccctttttccttaattggaggtgcagtgggatgagcgtgaggcgttgggagatgtggcgggcagaaggacctccgagcagtgctttttctgttgccatcagcaggttccctaatggttttataactgtaaatgctgcctatgcactgctgagtgggagtaatgagcattagttaaaagaggcaaatgaagaaaagtcaaccaagacattaagtgctttttttgtctcctggctttaaacaagccactttgttgcaaaccaatgatcctgccgtgtttttcactaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggtaagtggcggcgctgcagtcactggcccaggaaagcccaggcgcctggcctgggaggttccgggaaggtggtttcacagtcaggccaacagggaacttgggacttttgagaggtggggggttcctgtgtcgttttgtttatttaattggacgcccactggcagtgttaagggatgag

SEQ ID NO: 123741 - DNA, 1272 bp, Homo sapiens
ggagctgagcagatgttgggatcggtatgatcttggagtagtaagtgtagaaatggcatctgcagtgatgggattgatgagatccttgagacagagagtgcagaagtttatgactgccatcaggagacaccaggctggcccttcccttgatgcctgccgactcccaaggttgaggtggcactgaggctgtgactgtctgagccactgtccttcagttctgcccgtggtctacaagccacaagtggagacttgatattttgctcttgcgcattcttccaagtgcattcaaggcctgtgaaattgaagcatgatgtgtatattattggaaaaaaacatatagaataaatagtgaataatatttttatggaaatacttactctggaatcccttaaataatagtacctgtgttggggtacataaatttcttgataatattgtctgagtggagagaagcataaagcccaaagccttggttttcatatgtattatagaccaatgaaaaagaacaatggagagtctttaaaatttgagtatagggcatataccatttaaaaatgaaattcatagtatttcatgtacaacatttcaggtaacactcataaagcaagatcatctatgatttttttctttcaaaagtttcagggctgcttattccaagtgaggattttgtaggacatgcagtaaatccataagcttagaatttcaaaagctttgtgaatgttggggtagctgtttttcttagtggtatgagatgctagacagaacatttcgttagtgcttttggtggctttagactctgaaaatatgacaacatggaaaaaaataattagtagtatttagaatttggcctcaaaatgtattgcaaaccattcccatatcccaccgatacaccacattagacaactataggtgtatttccctcgtgtcctcatgcctagaatttcttattacaaaaataaatttgtgggggtggaatgattctgggatcaccttgctaggccctaggtagatatatgcagatacttctcaccttacagtggggttacatcagaagaaacccatcctaaattgaaaatattggtaagttgaaaacacactttcacttacgatatttttgattgacaatgagttgatccggacataaccccatcttaaattgaggagcatactgaatgcctgtcgctttcacaccatcataaggttgagccatcctactttggtgactgtctgtaatgttgttttcatcaaccatgtaaatgatccccggtggca

SEQ ID NO: 123742 - DNA, 1050 bp, Homo sapiens
tatggtacctgagacaaaaataaccataaaatcctaagaataacaaccataaaaatcccggcaagcaagtctcagataaataatagaagagaacagagtcactttgggcaaaagagtctataaaatccatgttcccactcttctaataatgagtacattgtctctaaatcaggaacagaaaggtaaagaacagcaaggcactccctcagtgataagattagagatatgagaataaaaagtaagttttcgtgtagatagtctaagcaaggaagcagcaaataaggaacatgctaaacatcggtttagtttatactgtaaaattcaggaagttcgctggacctgaagggtagtttatctttcatggtccagccaaaaagggagacaaacgtgtgacaatgatggaaaggtattgacgggtctcaggatctttaccctcctcggtcatatctgatgtcatgacattgtacctgttctttctttcttctcctcctcctcctctccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaag

SEQ ID NO: 123743 - DNA, 1074 bp, Homo sapiens
ggaccgtatagattaaccaggatgaatcagggagtgtgttactagtactgtccaatgtaaagatcacctaacttctgtaagttagtgttcccaccttatggggttgtacgccttaggtggacccaggtgctccaggtaaactgtaatactgtgtgacactgcatgttaagatctcttaggctgggcgcggtggtgcacgcctgtgatctcagcactttgggagaccgaggtgggaggattgcttgagttcaggagtttgagaccagcctgggcaacatagcaagaccccatctctacccaaaatgcaaaagttagcacatgcctgtagttccagctacttgggggtgctgaggtgggatgatcacttgagcccgggaggttgaggctgcagttagccatgattgtgccactgcactccagcctaggcaactgcctcaaaaaaagaaaaaaaaatctcttgttcccttgctgtgactctgattccaaatcaactgcttgtaaaactcctacctagatttaaaaaaacaaaaacaaaaaaaaaaccactgtcttgcacataagaacattccagtttatctaccattccttgatttattcttgacgaaactcctaagtttcttctgtctgccatttctgtgtctaaaattctagctttgaatgacctaattatatttatttattcagaaagaaatcccatcctcaatggcatctttatatatgaaagccaacaatacacactcttcttctgggagggaataattattatggagagttgacggtttaggacatgttgccttgcagattaagagtggtttgtttgtttgtttgtttgtttgtttgtttttaaagagatagagtcttgctgtgttgcccaggctggactcaaactcctgggctcaagcaatctacccacctcagcctcccgagtagctaggactacaggtgtgagccaccatgtccagctaagagtgaagttttatgttatttattaataaatttatactcagaagaagaaaggaagtatatttcattttctttcaagatacctaggatatatatagtccctatctttta

SEQ ID NO: 123744 - DNA, 1033 bp, Homo sapiens
taggggattggcaaagattggtgagagaatggaatatcagaactggactcccggagaggaaaaggaggatttgagagctgggtgtgagtccaggtgaaaggaatagtgacttagtggcagccattcttggcccagggacttgctggttgttttcatttcctgcttcctccctcctaagtggtacaaccgaaagtactgaggtgtaatcctgccattagctataatactgtactgcgttttgaatagataatttgagtcaggttttcaattcagaaggaataatgagccacctaggataggaagtcactagggagctgtctagctatacttggctttccacatctttgagtagacctaaatatgctctggaggtcacatacatctcttcgtctttgttagtgctttccttttttatctcaagacttattgtaaataaaaaagctgctttgtttggtatgtttttattttgaacagttttttttccccctcaagattgatttagttgtggctaaggggaaaaactgaagaggcagctattagagagattgtatttctgaagaggttcaaacgatagaaagaaaatgactatagaaagtagccatcccgcgaagagtctttatgtccttgaatttcatgttcaacaacacttatcttggaaaatgacttgactggtgaaaggaatcattataggtggatggtgggaacagtcaccaggttaaaacatttcaagttatgactgagataaaagaaatgacagctatcaaaaattgttgcttttaaaggattcctctaaaacattggccaccattaaataaagatgacccttttaaaactgcagtttttaatttgacaaatgttaaccaaaaatctgaccaccagtgctaagaggattcatgtacctagtccccttaccatttggtttgtggctctgtcatctgaacggggtatctgatccttactgatagggaaaacatggccaggaggtcaccctgaaacaggatgtcaggaactcagctgatggcacacctttccc

SEQ ID NO: 123745 - DNA, 1059 bp, Homo sapiens
tctggtgcccttgctcatcttaatattatggcaggaaaaacattcataaaataactgagttattttaataccactttaatgtcattctgtgaaaatgccaatgaatgggggatagagaaatcttgacaaaatggtctaggatttttctggaagaattaacaggcaaggtgccttgcatactcaaatatctgtgagtcagagaaggcatgcaattattaagtagcaaagccagaattagaccttgggttgatttagcttcctaatatcatgttgtttgcacagagaggaatttgcaaacacccccagaatgcttattctttctgcactgattgtttttacctcaacttttctgtttcatttcagggaagtatggccacggctgcattaccggaaagcgggtcttcccttgccttgcgagctctgggctggggctccctgtatgcatggtgtggggttggtgtgattagcttcgcagtctggaaagctttaggagttcacagtgtaagtaactactgtcttgtccctggtatctacatgtttattctgcttactgtgttctaaatttttctggttttcaaatttatttgcatgtagtttggtcactgtctagggagatgatgacagagtacgtgactaaattcttacaaataactagacaacttcttattactaataaatacaatttttgaaggtggtaaaacttcaaatataattaagtaatgactaatttatagctaatgttctatataaattgacattagggcgagtgcagtgggttatgcctgtaatcccagcaccttgggagcctgcggcaggcaaatcacttgagctctgaagtccaaaaccagcctgggcaatgtaaagaaaccctgtctctataaaaaaattagctgggtgtggtggcatgcgcctatagtcctagctactcagaaggctgagggaggaggatcacctgagcctcacaggctgaggctgcagtgtgccaagatcattgcgcttcagccttggcagcggggtaagaccctgtctcaaaaacaaagtagaataaataaacaaatt

SEQ ID NO: 123746 - DNA, 1029 bp, Homo sapiens
gcgatctcctgctttggcctcccaaagtgctgagattataggcatgagccaccgcacctggctatcatgtctagatagcttttaatattagtaaacttcattgtcaaacattagaattgcgtttccccagttacacaaaagcaaataaaatgtgtgacaaaaagagtgaataacttagtcatttagttttagccctcccctgtctgcaattcttctctcatcccagctctcattcctgaccttgaacagatggacaagaaagtttgtccaagagaaatgaacttactagaactcagcaacaggtgttgatacagtctttagcccctggagaaaggcagggtagaaatgattattcccacatcaaagacgaagtgacagaggcttggtgaggttagtcacctagggttgcacagctaattagtgggaaggcttctggctgcaaagccagtgctctttctgactaattgtgctgctcctcgttcaagtctagggtactggttaaaggcatggattttggaaggacagaccctaagattattactagcactataaccctgggcaaatgattggtcttttttaagccttagtttcccaatctgtaaactgagattaataataatctacctttaaatgatgggaagattaaatagaaaatgtatactttgcacagtatacagtatagtatatacagtacagtatacggtatactgtgtaccagtgtttggcacatagcaagggctcaataaatggttcatattgttagagtaaatcttagaagtaggcccccaaggactctggtcacccttttctgagagcattttgaggaagggaacatgtaggttaagaagcaactgtgactgtgaaaaagctcacgactgtgcagtccgctattaaagtaaaaacctggccgggcacagtggttcacgcctttaatcctagcactttgggaggccgaggcaggaggatcacttgagcccaagagttcgagaccagcctgggcaacatagtgagaccccatctctaagtttt

SEQ ID NO: 123747 - DNA, 1440 bp, Homo sapiens
cccaggctggagtgcaatggcgccatctcggctcaccacaacctctgcctcccgtgttcaagcaattgtcctgcctcagcctctcgagtagctgggattataggcgtgcaccatcacacccagctaattttgtatttttagtagagacagggtttctccatgttggtcaggctggtcttgaactcccaccctcaggtgattcgcctgcctcggcctctcaaagtgctggaattacaggcgtgagccaccgcacccagcctattttagaacaacttaagcacactttagcacactatttaaaaacagcagtataatcatttctgtacatcttcaaactagattttaaaaactgctgacttccatgctgttgagagccatgggaatgaggtggggcccagcaaggcagctgatagaggagggtgtagccaacggccctgcctgtgacttgccctgagataatcttatcagcggaggaatggcgatctaacccacttgggaaggaatttgagctcaataagtctgctatcttttggtggttttcaggcgtggctcatgaatacaaggcaacagcttattttaacactaaataccagcgtctattggagatgttacttctacttgctgagaaatgattgcccttcttgtactgatcatagaaataagtctctaaaatgtgtgttcctggcaacttccttgacataatctggtatttttctcagtcttcacttttccctttctctcataagatctctcctaagtgcaccatctctggtggtataagatactgtgtctactttttcttgttttgaaactttttcttcctttaacttctaggatgttcctctcccacttacctttaattatttcctattctcctgcatcttgtatctcttctttctttcttgcctttaagtaactttgttcctctctctcctgcctgtcttaactttcctaagcaagattgcacggtcatggtggttgctctggcctttgcaaatgtgaccttcatctctgtgtctctgtcccctgcttagagcacctgccccctgacctggcatttcctcttgcctgtagagatctctgccgaggtgtcctctgactcccagaaagcaagtcattgaaagctgaatggcctgcagtttcttctcaatagacagtctcagggccccaccactctcaggaaagaacatttcctgggttgcagaactgtggcctgggaacattctcacttccacccttcccgcctacccaccgccatcaggctgtacgcctcctttccttccttgtctcttagactgcattcttcctctctgtgtctgtactgaaggttctggttcacagtcatttcacggattctttgacacttttcccatgaaaaggtggagtctgattcctctcctctggaatatgggccagcccacatatgaaggacagaatgtg

SEQ ID NO: 123748 - DNA, 1104 bp, Homo sapiens
cctgctctcattaaagatgttagcacatcagagaaaatgtaaattgaatttctaacaagcactcttggatgggaaaggggttttaaacagaatttctttgttttgtccctttcagcaaatactattgtcatgctccacaagctggaacaataacctacgaaataacctgctaggttatgaatgaaagcatatattttgtgaaatttgtggtcatttagttgggttgaaatgaaatagtcactgatgtttattttctttattattttcttcaatgttttacccttactcaacctatgcacctgggaaaggggaaggctgccagttgctttcttcctgtaccctaccatggacccacagcccctaaactccagtacaattattccctgcactattgttctctgccttaagcattagaaaagggtttagggccggcctgagaactctgtcttcatttgtcacattgtttctttgggaagacacattcccagtttcaaacaaccaacctacaaattaactttaggggctgcctattcactaaaaaagaaggctgatttctgtagagctgattagctgagcagagctcattagcttagcttagtttagcaagtatgatctccttagctaatgtgacaccataacatagacgctgccacccaccggtgtcaggaagcgtgaaaggcagtccagaagtggcaagcctcatggacccgcctgcaggagggcagacccactgcggctgctgctaaaccaacaccagcaggtgccttggcaggtgctgagcatggtgggcacacaaacgggaggacttttcccagtggggcctgcctgcacaagccaggtgctggctaagggctggtagcttacttaacccacacacttcccccatagttggtactgttattagttccattttacagatgagaaaactcagtgccatatatctttggagtctattgtacaaaaatagaatacgttgaacatggaaagtggctttctatttatttatttatttttgagagagtctcgctctgtcacccaggctggagtgcagtggtgtgatctcggctcactgcaacctccacctcccaggttcaagtggttctc

SEQ ID NO: 123749 - DNA, 1086 bp, Homo sapiens
ttcctacatggccgctgtgtataggcagcagcgcagaggtggtctctgggtagggaaccctctgcctcctaggattcattggggatgaaagtcgcagctgttttatactcttcttaaattttgctttcctgttaagccaagatttactggacacaagaaaacttcccagcagtcccctagaaggaaaactaactcttggtagtcttcccattagcaaataaaagtccccaaatcatttttgtagactgcccaaaccaaggcacttttcatctgagaagacacagcaattgtctcagctgtaaagtaaaagagaattaaaaaaaggtggtctcttttgaaaattcctgttggtgctttggccatgtgattacaatgaaattggtgtgccttcatcttcaaagggcagaactcggtgcttatatgttcatttcattgtagtctgatgggacagacacttcttgttggcctgtcctcatgctccatatttattccaggttgattaggatggcatgtgaacttagaactaaataaaccttgcttggatgggtcacctggctaagtaaacttaccatgaacttctcagaagtaaaataagcaggaagcaggtttttaaaatgcgagtcctctatgctcttttaagtgctgccgtgttgctaggaaataagaaactctttgtcctcaagaaatgataaaggacaaatatagaagtagactcaagaaggagttagctatattaatgacgatgaatctttaagaagtcattttgtgggcaagttgtgataggtgggctatatctctgttttatacatcagttttagctaggattaggctttgctgtaaataatagaaaccgcccaaataacagaggcttaatcaagagaaaagcttatttttctctcacataaaatgtcagaggtgggcagtacaggctggcctggtggctttgtccacaagatcttcagagacccaagctcctttctgcttttttttttctttaatttataagttccggggtacatgtgcaggatgtgcaggcttgttacataggtaaacgtgtgccgtggtggtttgctggacagatcaacc

SEQ ID NO: 123750 - DNA, 1053 bp, Homo sapiens
tttcctccttcctcttcttcaccttcatcatgatcccatgaaagtgtttccgagtggtttcccatctcctccaaggcatgaggagaggttggtcttctgcctcactggcagctttattttattttattttattattttattttttggggggggggacagagtcttcttctgtcacccagactggagtgcagtggcgcgatctcggctcactgcaacctctgcctcccgggtttaagcgattcttgtgtctcagcctcccgagtagctgggactacaggcacatgccaccatcacgcccggctaatttttgtgtttttagtagagacgggtatcaccatgttggccaggctggtctcgaactcctggcctcaagtgatctgcccgcgctggcagctgttctaagaggcattccagtacctgttggtcatggagagacgctcacaggccagcttctcagcacttcccagactgtcctttccttgtggcttctgtctgtggccaggagcctgcctgtacttagtggcatttttttgttttttcatggattctctctggtcagccaagctgcagtcaaaacatgcattgtacttattttgtattcatcttccacggaaagtggaaaaaataaatagggctggaatgtgctatgtcatggtagtgctatttgggtccaggggagacataaaattggctggatttgttgcagtgcattttgtataaaaaaatgattctgaatgaaaaagtaagaattgatgtgtaaagacttgcagatctttgagccagaaataattttgaaaacaacaagaacaactcattaccaactcaattatctggcaccttagaaataataggctataagataaaagctagtgcagtttaatgaggaagtagtcactttaggctaatctggtttccttggaagctccaaggttgtggcagatgaaggaggtggtagaggtaagcttacctgccttagcaagatatttgatttcatctctcttttttatttatttatttttttgagatggagtctcactctgccgcctggctaga

SEQ ID NO: 123751 - DNA, 1215 bp, Homo sapiens
atttaaactcactttgttctgtctgaaaaatgtgttgaaaagaattctgaacagaggggaaaaaaggcaaaccttaaagggatattgctgtgataaaatggtatgccagtggtggtgagaaattttgttttgccttcaggacttatttgtttattaaagaagagtgaaggcagtatggagatgtcaagccacagctcaagtaaacgttgaatctgacgaggtcaaactcaaacacaatcactgccctattttttggtggtgcgattttgaatcaaaagggggactgacagcacagatagggagagaacaagtgtctttctgaggctttctgagcttgaagccgtcctgttctccaaagctctaagcggaacacctgattagcagagtcagagagcaaacgtggtgcttcgcttggctatgaacaaacaactggttaaaaagcctttctggaggttcttgtgaaatctgtctgggggcccagaaaccctgccccgagcagtgattttagtaacatggggataagtttgcaggagattcgattaatgattaaatgaacaaaccgggagtcctggtttgacttctctttctcacctcccctatccaatcaatcacaacggcctgggaatttctccatagaaatatctctcaaatgtgcccttcactgcgtccccaaccccaccccaggccccagagtcagctgggcccagcttcttcagcaggatccctgccaggtgtcctaggtcacccgccagcccgcccactctcactcttcagtccatagccagccacactgcagccagagggagcttttcatataaactccaaaatcaagagtgttctgatgtttaagactcccattgttatttttattggggttgcattatgtttatagattaatttaggaagcattgacattgtcttattgttgaatcttcctgtccaggaatggacatcaagttttctgcgtccctcaggttaatttaaattctcttcataaggatcttgtacaactcttgtttcatttactgttaatttcaccctcttgcttctattataaatggaggcctttccttctaatatctcttgaaactggttattgttcatatacaagcaagttattgatttctacatattaacttgcttctaccaccctactgaattctcttatggtttgagtagtttcttaatggattctttgggggtttttagctgtat

SEQ ID NO: 123752 - DNA, 1057 bp, Homo sapiens
tttgcatttgggcatgaaaccgagcacagtgctggcacgatcactctatttcttgagacttacttaggtaataagaatttataattgaattaagttggctcttataattaattgctttgattctgatgatgtggacacatgattgcaagctaaataccaaatatcattatgtatcttttctgatatcgaaagaagggtagtttaaataaaaaaaattgtagcccccttgaataatgctttccgtttgcctaaaggtggaaactcataggtattcactaaataaagaaagaaaaagattacaaaagtagtgaccaagataaaaccagaggcttagggctctgagagttcagcctgggccgtgatgttcaggagcagctgtctacctgcagagtcctgggcaaaccacttaccctccacgggactgttttgtcctggttacaacgggaggagttgactgggtgaccccagggtctctttagctctaaaaattctcagattgtgtgactgtggtactctgaagggcaggttttggtaatagcatcaggaccgagtgtgtgtgctcacacatgcacacagacacccccactcatgatccaaagcacagctggtggcctttatcggccttgacgagtgtccttttcaaatggagactttatcaaacagtgacatggcatgtgctgtgaaaatggtgactgttttgatgtcttccagttggctggctcccatctttccagagggagcactggacttctgggtaaaggaaatagcagtgaccaggaacaagagagccaccctccacacacatacttttttcctggtaattgtaccagtatgtgacttagctaagtgtacacatcataaatagctatcagcccatgtgatgccagaggcaatggctcagtacatggtttttgaccctcctgagatatatgctaaaagatttttaaaaatccagttccaagattacataaccgccaacaacaaaaagaaaatagagaagaaaaacggtattagtattagacctaacatattaattgctgatgactttttttagaga

SEQ ID NO: 123753 - DNA, 1351 bp, Homo sapiens
ttgggcctgggggtgcctgtggtgccctgtactgcagcagggactgagcttcgtgcacatgggaggcttcatcctctgcacacacccgggatccacccctgggaggcagttttgttggaggaaaggtctccacgaggaagtataggagcaagacagtttggaatgtgatttctctcatcctgctggtatctttctttgtatgtaaaaatttcctttctgagtcttagcccaaacgtgatttctttagatttttcccatgtgtttatgtggttagatttttgttttcatttttcttctggctttatggtttttctccctgtcccacttttcccacattgattttgcatttctggcagagatgggcagagccccagtgactgactcttaaaaggctaaatctttttaaaaattatataatttaaaacctacccttgtatctcccctatttctgatttttttttttttttgaagggaaaaaaatctataaagaatgcttctaaggccgggtgcagtggctcatgtctgtaatcccagcacttcgggaggccaaggcgggtggatcacttgaggtcaggaattcaacaccagcctggccaacatggtgaaactccgtctccactaaaaatacaaaaatattagctgggtgtggtagcacgtgcctgtaatcccagctactcgggaggctgaggctggagaattgcttgaacccaggaagtggaggttgcagtgagccgagatcaggccactgcactccaccctgggtgacagagtgaaactcggtgccccctcaaaagaaagaatgtttctaaagctggtatccttgtttttttccattttgcacttaggcaatgaggtgactgtgttagttctattccgtggtgtttatcattccatgctattagttcagtgagttgccctgggcctctgtatgacagtctctaggtgtgttcttggtgactgctaagagaaacaaggctctcccatatgtaagggagtcggcctgctggtatatccaatcgcgtcactacaccggtacctgtgaacttggccgtatggtagacactcagccatggcttcagtatttcaattccgttaaacttgccaagcacagcatctcctacctgtattatcttgggcagtcgacaaatttctggctgacacctcttcacataaaatgaagcaatggataagacaaatgtgaatattctttctagctatgaaattctaaaattcgaattctcacttctgtgtgtatgtttttaattgtccaagttagatcttgaatcatttatatagatatttccattctcacttccatgagcacatattgagcacctaccaagtgctaggg

SEQ ID NO: 123754 - DNA, 1049 bp, Homo sapiens
ttaggtgggcggatctcttaaggccaggagttcgagaccagcctggacaacatagtgagaccacatctcaaaaaaaaaaaaaaattcagagaagtgagaggcagatgtagacttggagagtggaaggtagagcgcagcccttacagtggatataattttgacatttgtggctgaggagagtgtccaggaagaatgaataggatgagcagaggtggaaaagtgtaaattggggaaagagaatattgatcaaattgatgagtttggctgatatggtgagttactgtgtatctttcagccggtatttggaggcaagtccaaatcagtgactcgagggatttggtgcagaacagtaggtactgttagacagatattattatcattgcactgatattattatttgtggaaggtctttgagataaacatgatctcttcagtatctttgtaaacatctgtcccattgaacagggagaaaacatatttttgaaacagatgttagcaccttattcatactgtctcttgtcctgctttatttcttttcatgtaaaaaagttaaaatagaaaacagcaaattcagataaaggtggtagtatatccagagaatagtgcaaaaacatctgtcaagctaaacttgggactttattaataggttaaagccgcctatggctgttatctgtttccattgcattgagttcagtggttgttatgctggaacagctgagcagatttttacctcctgtgcttaatattaatttgattcatatgggttcttaatagctctggtgaagtggaactgtgtttgacactacttttgtttgtggttagatgatgtattcagttctgaaacttgaagagaaaaaaaaaaagaaaatgctgataacctgcccagttttaatcccatttgccccctgtagctcataaaactcttgtagctaaacttccactggggatcagagaacacttttggtgtgtcggcactgctgtttcatcttttgctgtggagctgtgttttagtctgtttaggctggcaaaataccctagattgggtagct

SEQ ID NO: 123755 - DNA, 1087 bp, Homo sapiens
agattcaaagagattgctatttgaactgaaaaaaattccatataatcttttggcagtgctacatttctaattattacctggaatgaatttctgtacctctaatgtacaatgctttggcagtttgtgcataggtatttatcatcatatccaaaatcaaacagctcttgctgatgtatatgattggagggagagttctgtaaaggcttctcatcattttagtatccggtgctaaattagctaatttcttttatgttatgaagatgtattcttatttttccccctgtcactttccagttaatctttatgaagactaagatgcctgtagcctgtttgctacactgccctgagttgtatgtaggtcacaattcttgagacagaaataggattccatttggtgtttatatctttggcagctgcctcatcatcttgtatcagatccaggcccttggggatggagtcttcctcaacacagatggcactcagcattggagttcccatccacagttgctcagaaatatggaggagccattttcaagtcatctgagctcggactaagaatttgccatactgtgcacagtgcttccttcagctgtgaagccgtgccagtctgtgggtcaactgggatgtcccattagtctcacctccttcaggaggttaacattcacagtcatgggcagggtctgcttattgccttgtctttaccacaaggactacagatgctctatgctttttctaagcagcattttgaaggtgtctcagtagccctgacctcattgtttagggttgggaattctgccacttttataaaaagtgagttgttgaggatttctaggacaaactcagcactgtcctctgtcacacacagaggctggtggaacgggactgtcacagagcacctagcattatacagagttgtaccaacatatggtgctgcatctactagaactttagcacatggagggtcttagaggttccagcaaatgcccacagaaggtgaacatgaggcacactcggctcagcgagctgaggaatatcctgtcctctcagctgagggagcctcgcagaaggaactgggccttagcatctg

SEQ ID NO: 123756 - DNA, 1022 bp, Homo sapiens
tcctttctctgccacaccctgctcacctaatccatcaccaggctctgtacagtttgcttactaggtggatcccagcttaaaccacttcatccctttccttctgtgcactgcctcggccagctgcaagccgccatcatctctcactttaactgtgcaaaggtctctcggaggacacccaccatccactctgctcctcatctaatccagcctctatgctgacatcagagtgaccgtttccaaacagaatctcatcactatgggaaggaggccaaaatccttaacctagtatacaagacccacctctctcggcttgcaccgtagtcctgcatgccacctgggctccagccccgaggtctcctctggttcctctctgttaattcctgctcatctttcagggagatgttcaggcgtgggctcctcagggaagcctgccactgcacacacttcccatagctttctgtatgcttccttcatagctctgaccagggttgtcatggtatacactggggatgtgtggactcgagtggccgatgtctctgcccacagttgggtaagcttcaagaggccaggcctgtgtcagtttcccttactgtattcccagcagccaactccttgactggcatgcagctgctcagttagtatttactgaaggagagaagggagggaagaagaaaaagagaatttgatgctcctcttgctgtatctaccttcatgtctccatcgtagtcttctctcttagagaaaaaaaaaaaaagtatattgcttttttggccctatgatgaggttagtgttctcaactggggggaaaaaaaaagcctcgggcacccaatctaaactaaatgaaacccatatccttcaccctcaaacctaccagaagcacaaattttaaaatgtcagactccaagagaaatgatcatttaaaaaaaattaagtctgatcaagagctagtaatccttgcacagttctgggagggtggaaatgccatcactgaaaatgactcatggtgtctttaggtctgtgac

SEQ ID NO: 123757 - DNA, 1005 bp, Homo sapiens
gggtaataccggcttcatggaaggagttgagaagtgcttcttactcttctgtctcgaaaagtttgtgaagaactgctgttaattcatctttaaagatttgggacaatttgccaggaaagccatttagtcttgaactttctccatgggtattgttttgattactaattcactctacttattataggtctattcagattttttacttttcccttgggtcagtctcagtggtatgtgtctttctaggaatttatccatttcatctaagttatctaatttgttaccgttttctcatctgtcaatattgttttattatgaaaatagatgagggaagcttaaggactgaaaaagttaaattgaaaatgagaataatttgtaaaactggaggggaagagaagaagcagtcaaagacttcagtgaaagtcaagaggcacttgaagtaagccctgaaggggagaaattggtattttgtattttttaaacattctgtgaaatgcacatgccagccgagagacctgggaacctctagcagagcgagttccagcgtggtctccgggccccgcactgttgctttgctttctcccgctttgcgtcatgttagggccatgagaaatacgcgtaccaattaatttccaggaattgtcaaaacacggacaaatgagctgaaatatttcaagactgacaacagtacaaattctctggggccactgtgacattcctctcctttgatttgcttcagctgctaataacagacatcccaggcaacaaagaccatcacagactaagccagcacatcatgaccagcagtgcctggccgaaagggtcccgaagccctaacggttttccggtctctgatgcagtgatagacatccagggcacccaccctctgcgccttggaaagcctgcagcaccgtcgctaagagcaagtggtctggcaagttgccaagcaatccgtcgtcttcctttctacttatttcctgttttggatatagttagagctcaaaatca

SEQ ID NO: 123758 - DNA, 1009 bp, Homo sapiens
gcacaaataagtttcttttatcttgaaaaaccttaggtcagtttcattcaagtaatacatggtctattcagagaaatgggtatatggaggatttgaacggaatgtgctagaatgtgacagactgttgggggaggggcaggggagctttgacaaagagcacttaggtttcaggcaaagcttcctggaggagacgacatctgagaattcgccacccaaaggtggaagggatgtttcaagccaacaaagcacaggcatgtgtggggcgaaacgtcctggtgtttcaagagggggtgcaagttgggggaagttgacttaggcatgtggaatgtgggtgcccatggatacctgggggtggtggggagcagcccaacaggtagctggatggaacactcagggaaggtttgcttcctgtgttgttggagaaatggtctggttggtagaaagtcacttggaaacagtggagacgtgaatctgttttgtcagctagcctgtaaaaaacctgtaagacttactcatgtttgtcatctgagatactaatccaatttcatcttacatgctggaagattattttttgaaatcagcattcattatattttcctttctctgtgcccacctctgccagctgtgtccccaccaattcaagggaagtttcttcttggtctaattggacaccagtaagaacaacagaataagataatcctgaaagatgatggaaggaaaagctttgcaaatagcttatgcagtggggagtggcagagaacagctgtggggtcagagcacctgggctgcctctgacctttgctggccctgacactttggggctgggtgatcttgggcaagtcacttaatcccaagagccttaaattcctcaactgtaaaatgaagaaagttatactgaggttcacctccctggcctgtagtgaggattgactgagattctatttcctcttgccattaccagtttatgacctaataaactggaggagctttttttgttttatttttttga

SEQ ID NO: 123759 - DNA, 1044 bp, Homo sapiens
ctataatattgtggaccaggatggcgaccttacccagacttagccactcactggcgcttcccctggaatataaaatggaacaaagaaatctttcctattgctggactcaaaatgtgtaacttggtgctccccagaccatgttccgtgctccccaccttgcactgaggtgcgtggaagttggcctacagcaacgagagacagagccctgaaagcttctcagacttcagtcctgcccttccacaagctctgcggaggcccagtcctgcttctactggacacttctcaggtattacatttttcttgtttgcttaactctggatgattgtaccccatagaaccaaaagattcctaactactatcttggaatcccatccttctgtggggctcgggatgccagctgattggacaagccttgtggcttctctcaggcactgactctgagttctgtatgaggggcttctggacacttgggtgtgaaatctggcccattgattctaaggatgtgtaatcactgaaacctgtacccccaataaatctttgtttcctcaactgtaaaatgagagaaacttttttgaaaatgtgaatatgataaagtgcaaaatgcttggacattggggttagccttgggataaagccacgttcagggtctcagtttcctcattgggttgttttgaaaattagaaatatatataggtaaatgtacccagtatgtgacaagtactaaatgaaaggtacttttattgttactattactaattactccttcaactgttactagcgctgcttctcctccttgacctaatgaatgtgaaagctctttgtcatctataaatgtcagttccccaataaagacatactcagaggatctgccttcaatatgaagctgcctctgactgtctcatctttggtactcagctggaggtatttcgcttgctggcactttaactcccctgctctgagcggttgagctagcacaagggccatacagaagtagaaacagactttcttttctctgtctttgaataagaaaagatgaagcaaagc

SEQ ID NO: 123760 - DNA, 1483 bp, Homo sapiens
tgtataggatggcatattttttgagcccttgcctatttaagaccatccttgctacatgcacacacgaaagacaagttagtcggctcagagaagtgttgtcaagctattaaaggggccttctaattgagttgagtcagaaactaccttctctccagccatccattactgtgctggttcagggaccagggacgtatggttcacaagggtaattttcaacccaacctcctccaccccaaagcagtgaaaatttccctatattctggaacatggctttctcccctctctaatgtccaggggtgttgcaagttcatcgagttttgtgtacactcacaggtattctactggaaagttcgggggggcccaccaagcaagatccggagtctgctgccatattaacccctaaatgctggcactattttgtcagcttttcttagccctgttttcagtaggtattttagatccttttcatctgtattagtcaaactactttggttgcagataacttaaagtaacttgaattcgcacaaacacaaaaaggaactatcctataataatacaggaaagtttcttggaacccaaggttaaaaatgttattactgggtctcaatggggaagtggaaagttcttaggactctgtttcttatttctgttttgccctgtagtgctttataaagattaacagaaatagctgacatctactgagtgcttagtctatgccataacaaccctcagagaaggggattttaaagcatcacctccatcctacacacgaggaaagtcagacacagagaaatcaagttgccccattgtcacctcattaggaagctgctggcataagatttggacctcagcagcctggtcccagaggtgacaccctgaagctgttccatacacagatgggtccagattggacacctctcagagttgcccctctacagcctccagcatctgtttgaacaccttcaatagcagctgcggagggcagaggggaagatgaggatcccactgggggcagccttaagtaaacaaatcattccctatcttagtctatgccataagaaccctcagatatctgaagaacatcttgaatgaacatccgcctctctgagaatattcccattggccaagtttctgtcccctggggccaccctgagcccatccaaacctcagtgtgctcaactgcctttgaggtatttgaggactgaatattgtggatgctctgggcttggcaacctcaattccctcaactcttcccgcagggatcttttaaaaagtgtcccatcatgttgcttcctgtcttcacaacatgcctcggatggtagaagccacctttgacatgacaagcagttctttctgtcagagcacgcgttctcatcagacacaacagccaccttcttctcacaatggatattttgtgggtttttttttttttaagtttttttgagacagggtctcactctgtttcccaggctggagtacagtg

SEQ ID NO: 123761 - DNA, 1019 bp, Homo sapiens
tgggaaaggtcgatttatttaaacttctatagtttccaactttttatttgtgtcctgtgttctgtcctcatttgtggtggaccatgatggacctggcagctccattgatcacagcacattcatcagttgggtccagagtcccctacatctggaagttggagcagaccctctccacactctgggagcccacatggaggcaggtaattggcaaggctaagggcagcagtgtgtgggtggtttcttagaaagtcaagccaggaggcatgtgaaggatggtcagcgatggtagagaaggcagctgggaagaaagagcaaccaggaggttcaggtaagagtccaggtgagagacgatgagaacctgggtcaggatggcggccccagggatagaggggagagacacgggagatggagcgattggtgactgctgggacaccaatgagtcagagggagggtcaggatgaaggccagctcctagcttggttgatgagtggcttgtgatgcagtcccccaacctagccaaggccagaagtggaaagcactgggtggggatggggagctaccacttcatccagtcataaaaccatgcttacatgactcgtgcctccaaatctcaccaaggccttcctgctgaacttacaagtccttcgtaaagaaaaattattttttttggttatctgtaaatgtaattgtgccaaatgtttatctttttaaaaagctgtgtagcacctggctccctccctgcttctggggcacccccctcatgggtggtattggtggagccccgagcactgctcctccctaccgcagtaaaggcgggctcctccctccctccacgctccagctcacatcctggattcaaccaactggatgctggggtgattatgttatgtgtcaacttggctaggccatggtactcagatgtttggttaagtgctagtctagaaattactgtgaaggtatttttttaaatgagattaacatttaaatcagtaaactttaagtagagcagataaagtgtg

SEQ ID NO: 123762 - DNA, 1467 bp, Homo sapiens
ccatgtttacattgtgacaaaccatttccattttaagaaaaagaagagcaacgaagcagttattaaaagaagacccttcctttgttttctgacatgctggtgattcttgtgtcaaaccaaagtctcattttttaattgttcccagagagtcaagttggtgctttcctcccttcccccatatgcacactccttccccacacctgagtagttgtgttttttctttgtcttcttcaaggggtggggagaatgtgcttagtagtaatgactaacttttaataaaaatgtaggctccagtggcactcaggctgttgctataagtattaactgatgaaaagtaaattcagtatctggatattttaagggatgtcgatttccctttgaatttatcagagacttggctatagtatcttcagatacaattttcttgtttgttcttacgtattaaggatgtggttatcactgaactattgggatttttaaaaactccactactatattttacaataaaaaaggaaattatcttttagaagaagaactttagtttgacagtccttcactgctaaagaaagttaatcagggtcgggcgccgtctcacgcctgtaatcctagcactttgggaggccgaggcgggcggatcacgaggtcgggagatcgagaccatcctggctaacacggtgaaactccatctatactaaaaatacaaaaaaaattagctgggcgtggtggcgggcgcctgtagtcccagctactcgggaggctgaggcaggagaatagcgtgaacccgggaggcagaacttgcagtgagccgattttgcgccactgcactccagcctgggtgacagagtgagactccatctcaagaaaaaaaaaaaaaaaaggaaagttaatcagtaactgcacattttaaggggattatctattttctatttctactccttactcagtagagtgctgcattcagtttaagtgtatacactcactcagtgcaatcaagtcttgttttacaaatattaatacaaaagctgcagagcattttagtcttgacctttattggaagcctccaaaggttatatttcgacccagccaaaatataacctatttatattataggttttatatatatatgatatataaatatattatattatatatatatattatattttatatataaatatatattatattttatatatatattatattttatatataaatatatattatagtttatataatatataaatatatattatagtttatataatatataaaatatattatagtttatataatatataaaatatattatagtttatataatatatacatatatattatagtttatataatatatacatatatattatagtttatataatatatacatatatattatagtttatataatatataaacatatattatagtttatataatatataaacatatattatagtttatata

SEQ ID NO: 123763 - DNA, 1885 bp, Homo sapiens
ccctctgacctgtttccctccatttagccattggaaacttaagagtaaaaataaatgtatatcaataaagagccatagtgtgaaaattttatgtagaagtgctaaatattctgacattatgttactcatgatgtagaagaggatcatttctctagtttagggaatggtgttaaatacttgaaggcatgtttagtttgaggtctcatttaaagagctcctattttagtgactgaccttgcaggacagaaagtacattttagagaagtgtaaatgtccactttccctggttgtactctaaaattttatctggcactggttaaactaagccactcttaggaaccagtgaacattcgaggcaagtagtctgtgcccaggcttgttctaaatcctttgtggccgaggacatagcgtcttggaatggttaaaatggatctgctccttttgatttccaggtaagctgttgtttgatgtgttttgtttacctggtttgcaatacccagagcttattctagagaagggattcccagctggtgaattgtcaggggatctttaactctttaaaatgtatatagattcggttaataaaatacaggtttacttaaaaacgctggacttcatagtacctttttggtgttaggtatcaatgaattgtccttgtgtataattactgttatatgtgtgtggggatgtatatatgtaatgaattaatgttgaggtcattggcattcctctgtgattcattatagctgttacataaaagcctatttcccctattagtgttttgtttctcttgaattttatatttagaataaaagagaaattatgtcttttattagagatgcaatgaatgaataaaattagttctacctgattatgaagcatatgtattttcatgtaatggtgatatagcatagagattaggagcctgggttcaaatcccagtccagttattaatacattactttgaaaagttacttactgcttcactttccttatctgtaaaatacaaataattgaatggattcaggtgtgaattccattgcacagtccaagtgggggaaaaattataattttgcttttctgtaataatttacaacaaattacatccccgtcctgctggggaagcagacctataatattttagttcccaggccaccgcctcttgcccagggtgaagcataatttgagggtggggatggtaacctagtgccatggccttgaaggtgtgaccccatcttgccctccagtctcctctttaggcctttcctcctgcccctcagtttagtaactctctccaccacttccttgctgtgctgcttgaggacatggtaaccaccttgctggttgtgcgcagtattggggcgtgaatctctgcaaagctcagacctttctgtcttaatgtgatacatagctgtttggattctcctatcctctccggttgtttcatggtttcactagggttctgaaagcaggtgaaaaaaaacaagaaagcctcactgggaaggtgacactcaggtagagatctgagggaaggtgggggtgtctttggatctcgggaaagagcagaccctcaggctggtgcttggggtgtctttggatctcgggaaagagcagaccctcaggctggtgcttggggtgtctttggatctcgggaaagagcagaccctcaggctggtgcttggggtgtctttggatctcgggaaagagcagaccctcaggctggtgcttgcacagtgaggccagagctgagggagctcagggaagaggggctgctccccaggctgaggaggcccaggcgaccacgggggctttgacatttatttggcaataaaaccattggagggttttcaccacacccaaaatgactgacttttacaaaaaatac

SEQ ID NO: 123764 - DNA, 1091 bp, Homo sapiens
aggtcccacttatcttcaaagtgcatgctgaggcaacataaaatgataagaatttactacactgtgacttttaaactatcatctcaatggtttggcatgattcaatattttctattttaactttttatttataaaaattttaaacatggacaaaagtagaacagcacagtgacactcccctgtgtactcatcacccacctccacagtgatcctggcccgttttgtttcctctagcctcccctcccctattttcccctttcctcattattttgaagcaaattccagacatcgtttcatgataagtattttaatatatatctccaaaactgtagacttaaataactgtaattcctgttatacttaaaaattcagaatacattcttaatatcttcaaatatccagtctgttggtaggcagtgtaaacatattcataaattaagtttgctgtatctattaagttgcttgatagtattaaggtgagaacagtgccatctcttactggttgacatttgtatgagtctgcccatgttaatgtaaaacagatttgccacaggtaatgtgaccatacaggtaacataatctaacagttaaaaaatatatgcatgtcttgcttttatcttgttgactccagtgctcttatcaaaatcctcatgatgcaactgcccaatgggttcaccatcaccactgcctagacagaatcgatttatcaagacagggggattgcaatggagtaagagtaattcacgtagagctggctgtgcgggagacctgagtttgttagtcagtctccccgagcatttggggattggagtttttaaagataatttggtgtttttaaagataatttggtgggtaggggcttgggaagtggggagtgctgattggtcaggttgcagatggaatcttaaggggttgaagttaggttttcttaatgtcttctgttcctgggttggatggcagaactggttgggccaggttactggtctgagtccatcaagtgcagggtctgcaaatatcttaatcactgatcttaggttttacaatagtgatgttatccccaggagcaatttggggaggttcagactcttgga

SEQ ID NO: 123765 - DNA, 1078 bp, Homo sapiens
ctcccgcctcagttttttcagtagctggtactacaggtgctggctacaatgcccagctaatttttctttaattttttggtagagatggaatctcgctttgttgctcaggctggtctcgaacccctggcctcaagcaatcctcctgctatttagtctcccaagtagcagggattgcaggtgtgagctgctgcactcaaccaaaataggtatatttcgagtaacttttttagggttgatctctaaatgcaatgtgggcagctgccagaaaccttccctgcctccggaacagaacagggctatcaccgttggtgttattcttcctcagagtagagcagatgagtcattttggtaatgtcttcctttcttccaaaacagccacagccactatcatgtttgtaccagcatgcttagaaagtgaactgtacaccttttgtgtttttactactctgtttgtgtttgtaacatcctcttttcctctccactcctgataggctcgggttatgtatgattttgctgctgaacctggaaataatgaactgacggttaatgaaggagaaatcatcacaatcacaaatccggtaagagaactgtacattcgagtctgattgtcccatgtggacttatttttaacaaatccggtaagagaactgtacattcgagtctgattgtcccatgtggacttatttttaagattttatttttttgtaagttaatcattcaaacccacatgatttttttcctgttgcttatgaaatattgatggtgaagtaagaagctgttatataaatacaggaaaaaagttccctaaagacagttatgtatgtaattgagtttattatgtctgcttattttgtatcttcttcgatatgtttatcttacaattttttaaattacttacaaccttttaggtaccccatagttgtcctggaacatggttcagtgtgtttacccctagcatgataatactgtatctctagaataagtaaaagatgatggtgattttcctaaatgtcttaactgattgatcctatcatcatttttctaagctcttttcctaaatcagattaggttgccagaa

SEQ ID NO: 123766 - DNA, 1023 bp, Homo sapiens
tgtcatcatctagcaacccacattaattcgtatagcgacttgggtgccagaagagtcagctgaagtgtgcagaagcccttgaggcaaggttctggattccctggaggatttccacttgattctgttgaccagcgaggtggcagagggcagattccaggcctgggatgcgcatcccaccgcttcacattcagagctgcaagccacttttattatctgccgcagaccagtacacagacaagatgagggtcatctaatcatcagctgttttcaatctttgatcacttattattgaagtttgatttttcttgtttttaggttacatcattttctgaagtaaagagaaggcttaagaatttaagattttgaacggtgttctctaggaatgaaaagcttaatgttaattgctttttttatgtataacaattcctccacacaaaatttctccaggaaatctcaactgtaatctttttcttttttttttttttttggtgacttattaggatgtaggtggaggatggctggaaggaagaaacatcaaaggagaacgagggctggttcccacagactacgttgaagtaagagcttcctgtcattcattcattagagctcatctttgccaggcatctttttatgaattatcaacttacaagaagtcagcaactttttgcaaaacaaaatttccattgtaaatataataaatgttaactatataaaatatggaaactacattgaaatagaactaagaaaaatattacctgtagacccaagcttcaaagaatgactacagatatttaggttaagtttcttccagggatagcaacttttaattggtctgaataaaagttagtatttttcctttgctaatattatctatattataaatatatattataaattgtataaattcaataagatatatgaaattatatctcaatatatctgttaatatatacattttaaatatatatttatatttttataagcaaaatatataaattttataaaatgtattataaattatat

SEQ ID NO: 123767 - DNA, 1657 bp, Homo sapiens
cacaccacagccttttccatacaactgcaaccccctattcacaggcccctggcctcactccgtaggtcttatgttgaagtcttgttttacttgtatgcactttgcatccaggagcccacaaattgacaagattgagaaaaatctgagaatttaagttgatattggcagtaattggattttctaggattctgcttatataaaggaatagtgattacagatattcttgggtttgcttacctttaagaatataaaaccccctctattagaaatagatcctgcaggcagaaaatcagtaaggacgtggttgaactcagcaccatcaataaattgatgtccacttagggacatctatagactgcttcatcaaaccacagcagcatacacattcttttcaagcttacatggaacattctctaagacagaccacatattctgagccataaaacatacctcaacatgtttgaaagaaatcatacagtgtctgccctgagaccacaatggaatcacactagaaatcaaaacagaaagatagatggaaaatctgtaaatacttagagattgaacaatccacttctaaataatgcatggatcaaagaagaaatctcgagaaattaaaaaatagtttgaactaaataaaaatgaaaatacaacccattaaaatatgagtatgcggcaaaagcagtgcttacagagaaatttgtagcattgaagaatataaaccctttttgacaattcttgcttgccctcgaagactccctgaagtgaccgtaatctatgaaaataattgcggctctttctcctattcagattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggctttacggaaaacagagcgtatttgtgaaggcttgtgatgcattatagctattgccattccccaaaagcaaaaacaaagtcgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagaggaagaagaggaggctcttgttgttgaggaggtcagtgtcagagcctcggcctggatcaggaaatagatgccctggccctggcatgttgcttacactctcagagctagaggccctcatcctgcgagtagaagcagtgcctgtgaaagtctaccagatccaggcactcagcacttggtactcttattgtattgcttccaggaaacttagaatagtgggataacttgagaagaatacaaggaaattttacattaattttaattaaaatttgactagtttaggtgaatttgtctagttcatttattgccaaatgatgacacagagtaagtgacaagaagaaaattgagaagacaggtatcaaaatattgttgctgctgggcacagtagctcacgcctgtaatcccagcactttgg

SEQ ID NO: 123768 - DNA, 1054 bp, Homo sapiens
gaggaaaaaacagaaatagccaagttaaaaaaaatgttaatattctgaaccttttgctttcagaggcattagacatgtatgtgagagagtccagacaaaatcagcaaagccacctggtcaacttgaagctaaccacagagccacagtgagtcctaccaatcgcagctgtgaatgacacaacagcccagctggtctgtgaacacaatgtctcccggtgtgtgctcttagggtctaactggcctacaatacagcatcttgtgagaagaggtaactgactgatgcgcttccaagaagccaattgatgggtaaactgcagcagatgtgttaagaggaccattctggagcccagcttccaggcttcaaatcccggttccacaactgtcctgtagggaagtcagtactacaaacatttatatagtggacgacagcatccttttcaggcgcaactctcctgtgaaataagcggtggtattattctcacctgagagatgaaaataaacttggagttgaaaatcagttaatacgcaaagcagacaacaaagatggagtaacagggacccagtttatgctcccaatgaaaacaaaaaatatgatgaaatataggaaaccgtgttcaaatcactggacaccagacagtgaagaagtgatcctgagatacgggagacagacagagtaagcccacaagtgcccattcactgcgtggagagactctccaggacacggagcaggcatggaaaacccacacaaagctcggcggtctctgtggtgggaggatacagagtctggggaagacagagacgcagagagagagctctggagactgcagaggacactgcagatctgcactgatcagcccatcacgtgaggggtctacccaaggtcagggaaagacacacacggaagaatcaagagtgaatcaagagtgcaacccctcacacagggctattcccaccagcctagatggaaaacttcatgattcacggggcatcgggtacaatactacaaaggatttgtttcaggaaaggggcaaaaatatccctaagctaaatgttgc

SEQ ID NO: 123769 - DNA, 1975 bp, Homo sapiens
ccactgtgcttaggcacatagcagtccacggaagaaaacagctagcctggttcttgcttttaagatgtagtacctccccctccccccaccttgccactagtagtaaaacaatgactatcaggctctggccaatctgattaatcgtttctatgagccagaacaatgctactcaaagtatggtccacagaccacttgcccatctgaaaactgcttgttcctgatccaccgtgagataggtacagtacatgagaatattttgaaaacttgaggacaatttggtattgttgaaaaatcaaaatgtgtaatgttatatttcaccaaactattagtctgtgatagattcgaaatttttaaaaactagtccttcatcacgtgtagcttgagacagctagactagaaagaaacattgtcttgtaaccagcactgtccttgggagagggaagctggtgtctcctctccatgggctgagctactcacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcattttccatcctgtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccttttctacaaaagaaatgtgtacatttaaaatatgtgaaaaatgacacctgaaaaaatagaaataattcaaatagcctaaaatggaaataaaaatgtatgacccacatgatgcaaacaggttatgcagatgagctgcattatttcattagatgagtgagcactggacagagaagccacagaactactaagtgttaatgaaggaagaagctgccaggttttctacttattttgattattaccctctcccttttcttgttttttaaaagtgccattttctatttattttgattattaccctctcccttctcttgttttttaagtgccacattccctcccctcccccagccccaagaatcttttggtaagtaacccatagtgttactagagcaccttgtaagtatgcagggcaccttgtaagtatgcaggtagaaagggtttgtttttgtgtcagggaattgtttttgtttttaatctccagcctagggtagactctgctactctatgtagtcactgagggactcagcatgtgtgtgttaaaataaaggttgtgtgccaggtgcagtggcatcccagcactttgggaggccgaggcgggcggatcacgaggtcaggagatcgagaccatccaggctaacacggtgtaaccc

SEQ ID NO: 123770 - DNA, 1052 bp, Homo sapiens
agcctggctaacacagtgaaaccccatctctacaaaaaatacaaaaattagccaggcatggtggcatgcgcctaaagtcccagctacttgggggctgaggtgggaagattgcttgaacctggaagctcaaggatacagtgagctgagatcatgccactgtactccagcctagaaggcaaagtgagactctgtctcaaaaaaaaaaaaaaaaaaaaaaaagtatagggtgtttctgtttgctgtttttatataggtagccattggaaagagaacatggctgaattggttcattctttaaagatttggtcccattaggaccattctgtggaatgacactgttcatgccctgagattacattcggagtataaaggtatttagtccatggtgcagagggagatagagtgggagctgcttcctgaaaattagaaagataaaggtgataaatgagctggtcctgtttgggaattttgaagaccagtttgactgtgctctccacttgaaccttacaacattctcatttacaggaatggaaaactggaaagaggaaggccgagagagatgagctggcgggagtcatgatattttccaccatggaaccagaggcacctgacttggacttagtagaaatgtgagagacgctgccaggttttctttcttctcaatccgcaccctcctcctttggccatcaggcttcagccagtgtagccgcagccgaaactcaaatcagactagacttttatgaaatgagtgggatttgtagtccaatgacaagggaaacatcatttgtacatagaagtactgtctttctaaccgcaacatcaaattacaatctttctttcaccttgaagccagtgatttcatagttgacacggtgctgagtagctgtttccaatagtgtgatgaaaccaagcggcatggagccacctaaaacccactcaatattcagacagcaaatctctttgaacattgccttgaggaagcagtctctaacctgctttttctgtatgcttttttaatctgttgattgattttaatcatgtagttttttaaa

SEQ ID NO: 123771 - DNA, 1930 bp, Homo sapiens
cacaaaacaataacgaaaacttaaatttttcttacctctgcttagtaattttgttgtttaccagagtctatagaaaacaaaaatctagtagcatgtctccctcagacacctgcaggtaaggtctgtaatgtagaatccagcctccgctggcggccttgctgcctacccagctcccctctggccatgggatctaagccatgttcatggggagtggtgagcaagccctctgctcagccatactggtggcatctgcgagctggacactgctgaaaacgcctgtctccagcagccagttcttaaaggagaactgtgcttgatgtacctaatgcatatttgtgaattgtgtcttggacagttggtttgggagactaacttacgggaggaactcacctaagccctgtcctcccttacaggacgtgggccctatgctctttaaatgcacacttttcccgtcagttggtgccattgtggatttgcctttcattgtatattagaatataacagattacatttgtctgtgtgagaaaataatgcaagggcaactctcaaaattttgatagtgttgatttattgattttcaagtccaggtatggtatagtgacattgtaattcagaatagaaaaccatgtatttcatcactgtctttgcataaacctaagtagctgatataacattgttaggttttagatctaagttttatggcaaagtaacccttaagttactaaaatttgtgtatgtgttcatggagcagacatatattgagtgtttcttatataccaagccctcgtgctggatgtttagcatccagggatggataagacagctgtgccttcaaggagcaagaggccctggcgcagagaccactgcagcgcctcgttagcttcacaggcaggctcgtgctgtctgcacactcagcagtgacagcagggtgtggccagggcgacacaaccttcaggggattctggaagctcatactcctccaggaaagagggggctctaggcaaacatgaaggcctgagcccccagctcatctgaggaaaagcaggtggtctggaagcgccgctagggcagaggtggggagcatgtgtagacgcctcccggcgggaagggaccaccagggccagctcgggccccagcgctgccggtgtcattcggggttaaggtctgtccagcagcaacgcggggcagggctggtgccaaaaagaccagttaaagaattggaatttgtgtcatgtttaacttgttggagttgtgaataaagaacactgtgaggtcgtaatgggagtgatatctcaacgttgttttgttttgctttcttgtcagattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttca

SEQ ID NO: 123772 - DNA, 1044 bp, Homo sapiens
gtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttga

SEQ ID NO: 123773 - DNA, 1014 bp, Homo sapiens
ggggatgctgacttgctggccagggtcccacactttgagaagccccgcctgaagcttacaggacagggcaggttcttgagccattgagttgggcaatgccatgggaagttgcaggtgcacagacgttgccttcctggctgcggttgaacctgggctccatttgtccccttggagctccaggcggccgggccgacttcgaccctgagctctcctgtctgatttcctttccaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggtgaggccctgggtcccctgcagagggtgggccctgggtctcctgcagagggtgggccctggttggcatctgaggccttgacctccacttgcaccacccccgggttatggggcacctctggagagttaggacccaggcctgctctcagcacaatgagaggaaaactaaccctgaactccctgccaccccccacccctggcccctggaatgtgttcagtgtagatttggaaaagaaacctgcgccaggcatggtgcctcatgcctgtaatcccagcactttgggaggctgaggcaggtggatcacttgagttaaggagtttgagacaagcctggccaacatggtgaaagcccatctctactaaaaatacaaaaaaaaaaaaaaaaaaaaattagctgggcgtggtggcaggtgcctgtaatcccagctactcgggaggctgaggcaggagaatcgcttaaacccaggaaacggaggttgctgtgagccaagatggtgctactacactccaccc

SEQ ID NO: 123774 - DNA, 1036 bp, Homo sapiens
aagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcaggtgagtgcccaggcccatctgtggcaccaaatggttccgagtggctgcagctcttgcacacgcgctttccacttggggcagaagaggccctggcatatttgtggtggtctctgatcaggcttcctcctataagtggagaacagcacgtgtaattgggctccacatgaaaatgtgacctctggtttgcatggtgtatcctttctgattcacatctcatgcagggaaaatgctgcttagccgaggtatttttaactaaacggaatcaggaatttttgccttggtcgtgaaaggtgggcagtattccaagggcagctgacagatgaacaaatagggtttgaaaatccttttaggacaaaaataagtagatcaatacaatggggggatgaaagaagaaaccattattttttattctaaatcaactgaagcttctcctggaagccagtattagcaccctagagttgtgaaatctgcgtgttaagcagccgctcccatccgttcccctagaatatagccatctgcttaatttctcctggagttttttctaaattctgttctcatttccagagatgctgtcttacaacttttaaatttttgctctaacttgcaatctgtaagataaggccaccatgtggaatacagtggtgtaagccataagaaaggaaaaccccggaaggcacatgtatggtactcctgccagggcaagctgggtgccctgtgtttactgagtgaaggcgtggctgtgcgtcccccctcgctgccgctgctgggagaggaatgccttatgcggactttggccactttaatccagcagaggtttgagcacctacctttactgtgtgggactttctgcctgctccagtgttcagagggt

SEQ ID NO: 123775 - DNA, 1026 bp, Homo sapiens
aaaaaaaaaaaaaaaaacacacagtatctagaatctaaaaagtactcaaaatggcagctgctattgatactaatagaaacaaatgataacacccaggagataaaaccaatggtggcatccggagaagcatggctcttggtgccgtgagcactgaatgagagtttcctcctgtctttgtgggaacagggacaccgtgagatgtagtaacatgaagacagcttcctggtcagtcttatctctcatccctcatagactcatcgtaaatcagtaaccccagatgaagccatttattcatcccaaacattcactgagcgtctgccaggtgtagggggcaccagggatcagatacagtccctaccttcagggagcagggggcaggacagggcagtgttgtgtggacagagccgtgttggaggaagggagaggccccgggggcagctctcccaggctgagggtgtggggtgggctgcccaagggtccagactggggaggggtgaggaagaagcactcaggcaaggaaggcagcccttgcagagggaacaatgggtgcaggtgttgtaacccttgggttcacagtgatcagggagcatcactgggtagcttcttgaagtcctgggcatgaagggaatgggaggagagataggagaggtgagcagggctgggtcaagggcctgtggatgctacactgaggagtttgcatcccataccagcagctactcaagcagtactccccaaccttgctgcacagaagactctgctggggagcttgaaaaatcctgatacccaggttgataccatacacattaagtcacaatatctggggccgggagccaggcagctgtcctttttgaagacccatgggtgactccagcatgcagaaaagtatgggaaccactcggtgctgtgctggcaagccagttttattggggtcagactgggtgcagggagctttggtttgtagcatttgtccattgctgtggtgtaaattctcccatcgtggccactttcaacctacggctccacatc

SEQ ID NO: 123776 - DNA, 1029 bp, Homo sapiens
gtttgtctgattatttactgtggccctggttttaaattttccactcgttttcattggacctgctggtgtgacctgataaatgtgtgtttctcctgtgctttttctttttcttacctggtcacatttctggcaccccacacattctcaaatctcgaatttgctagaatgtcagcttggtctcatctctgttctctgctggccactctgttctctgatcctcagctgcctagttattggcttcttatttacactctttgtcccaccttttctcagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagc

SEQ ID NO: 123777 - DNA, 1041 bp, Homo sapiens
catattttaacaaaaattttattctctgtcccatttatttggtatctggaacgaagagaaaacctaaaaatgagatctatttccagcactgcaagcaactttggaggagcttacttttcccctgcttctttgactggttgttacatttatctgttttcaaatttatctcctttttggtgagaaaagaggttatagggaaaagagcatttgaatgaattcttcaatttcatttcatttatgactctggctgttaatagcgatgtgcatcttggcaaatcagcttctccaaggaacccatcttgctctctcccccaaactctgttaaggaccattctgtttatttcttgtgtttgttacagaggtaaaaatcatataaagcacgtaaatgccaccaacggcatcctgatcacctaaacaccgccttttatgactggtcaactatgcatcttatctgtctagctctgtgggtcacggattcctttttttttttatccttttccaggtattagttttcagatgaaaagagatacgtgttgtaacttttgttttgatggccatatttaagtaatctgcaatatatcttgacagtgacaatgaaaactaattatgaaattccagatgtctaattggtaacaagacagtggcatagcccaggcaagatgatccttactatcctagcagtcagcttttaggacagacatcccccagtcacgtaagggatgacacttgatcactgctgtgcgagcctctgtacgaggctcccagatacaacaggcggtacagtaagatttcactactgaacttcttattaaatagcgaaaacacggtatctgctccaaatggattccagaccttgtaacattactttaaaaatgtaaagcactatggtaatgtctttttcagttattgaataggtgagaagtgctgttggaaacgtgggaaaaatgtataggcaaaaaatatagacaaacatatagacaagcaaacccagaaacactggcctggtgattcttatatgcagggacacatagcactttccat

SEQ ID NO: 123778 - DNA, 1047 bp, Homo sapiens
ggcagtattccctgctagcagcattcaagtcataaattcttaaccagatgattacttttctggtttttgaacttaatttaatagttaaaaaaacgaaccggttgggcgcagtggctcacacctgtaatctcagcactttgagaggcctaggcaggcggatcacaaggtcaggagtttgagaccagcttggccaatatggtgaaaccccgtctctactaaaaatacaaaaaaattagccaggcatggtgggacatgcctgtaagcccagctattcaggagactgaggcaggagaattgcttgaacccgggttgctcactgcaggttgcagtgagcaagatcgcaccactgcactccaccctgggcgacagagtgagactgtctccaaaaaaaacaaaaacaaaaacaaaaaaaacaaaaaaccaaaacccgaaactcaagaggaattactaaataaccagtaattacatttgatccagaacagaaggtagccaaagatattctaaggttctcttcatatctgaaaagaaataaacccaatttaaaaaaagacaaaaacatttaataggtatcatgtacaatttcagtacaaattttcacttcaaaaatattacaggattttattaatcactagtcccccaataatctttgcagctttccttcccaatgaaatgacttcattataaagtgaacgctttgatacattactttgtttatacttacacacacatcagggagaattttattatgtgccttgaacttcaacaacgttaaaccgttacaggaattgcttaagctgatgtcctaattcaatcattaaccaaaacatattttaagaataggcaagaagtctgagaagatggtgatgtaaaagggactaggcttggggtcagagagacaatggtgagttgtgaagtacctaaaccagtctgcgtgaactgcaccatgttagagaacagcaggaacaaaataggctacaaggtcacaataagaagccctggatggtagcatcaaagacgaaacatttaaaaaaccacagaatgaaatcc

SEQ ID NO: 123779 - DNA, 1028 bp, Homo sapiens
gtgggaactgactgctcatgggtatggggttcttttggggatgatgaaatagcctgaaattaaatagcaatgatgttgcacaactcagtgaactatactaaaaaccaatgaattgagcctgggaacaatggctctggcctataatcacagcattttgggagggtggcttgagatcgggagtttgagacctgggcaacacagtgagaccctgtctctacaaaaaagtatttatttattttttaattacccaagtgtggtggcatgtgcctgtagtcctagctgcttgggaggctgaagcaaaaggatctcttgagcccaggagtttgaggttacaatgagctatgatcatgccactgcactccagcttgggcaacagagtcagaccctgtctctaaacaaacaaaacaaaacaaaaatgaattgtataatttaaaagggtgaatcttatggtatgtaaattatatctcaataatgctgttactctaaagaaaaaaaggtcatcgacatgattatctactactcacatgctatagaggtcaattaataccacttgcaaatgagcaaggaagaagaaaggtttatttagccaaagagaatctgagaatcttgatactaagaattgctaattcatataatggcttagaatagttttacttcatactgtgatcaataatggattagctactttatccttatctaggacaaattccaagcataggcagctacagtctgaaaagaattattataagctagaatttttctaagaaaaagatttgttctcaggaatacgaaaatagatacaaggaactgacccagacatgacaataagtctaacaaagttaacactagtaataatgtgtcagataaaaggtagaactgagctaaaaactcaaactttaaaaatgtacagcaaatcaatacccagaagtaaaagagtcttgaatgttctagttcattcttctctccattttaggtactctcttaatggcatttttatggtaagttgagttacctcagaacctgccgtg

SEQ ID NO: 123780 - DNA, 1002 bp, Homo sapiens
aagaacttgaagagttccaaagaacagctgccagatgtttttaaaaaggactttggaagcttgaagcaacagcatagttttttgtttttgtttttaagagacagggtctcactttgtcatccaggctggagttcagtggtataatcatagctcattgcagcctcgaactcctgggctcaagcgttcctcccacttcagcctcctgagtagctgggaccacaggcgcacaccaccacacctgtctaaatttttaaattttttgtataaatggggtcttgctgtgttgcccaggctggtctcaaattcctggcctcaagcagtcctcctgcgttggcctcccaaagtgctgggattactggtgtgagccactgtgcctcgcccaaaagcaaagttaatatcatggaccagctgcttggagtggcatagccttgccctaattctgtcaccaagaggcttttcttccttcataaccaccacctgcattcctcacctaggtggcctcactagtacctcttatcacttccgtgcgaggggactttgttagaccgaaatatctcaagcactaaatcatttttaccctgaaagtgattattgggatttaggtatagaatggatcccatgtgagacattcccattcatttcaccaggagaaaggaagtttataatagaaactctgaagtaacttagcaataacctgcaggtgtaagaaggttttgaatatgttagtgctcaatctctgcttgctctgaaataaggaagtaggccagaacacatacgaaaagttcatggaaagcataaaactatggttctactgactgagaatcccttcctgcatgtttcatcaaatgtagtttagctgcaatcaaacttcaggttcctttatcttttaagagtcccttgtcacaaccaaagcaatgtctagaactacccattcggcctctttcagtattgtcaaggggaaagcttatatttttacttaggtttattgacttttttattttc

SEQ ID NO: 123781 - DNA, 1027 bp, Homo sapiens
aaaaaacagctagatgaggagtagaagggaactcacaaaccttctacttaggatctttagaattatttgaaaagataaaggagccacaaaacaagaagaggacatgagtgcagaaccaccagggcacaggaaagaaggcacgtacggaaaacacaatctgactccacgaaaggaaagtccaacagaaggtttagaagaaatcaagagattctccataaagtagaacaaagagaaaataggagcaaaaagacacctggtatatttaggctcgagccagggaatccaaattccgattaacaggtgttccagagagaaaactgcttatcaaaccagagtactttaaaattaatactaacaatctcaaagtttcatttacattttaacagttgatgattctccactcatgggggaaaaaagccatttattggtaatttggaataatacttaaaagcaaaacattatctgattatttttctaattttaagtatttaagataatattaaaattattacaatgcttgagtaaataatggcttaagaacaaaatgagaaattatcaaagaaaaatcaagcccaacccaaaatttccatgaatagtctaaacacaattatatacaaattataaaatgagataatacattcaaggaagaaactttttcttcttctctgtgtaactgatgttaatataaccccaatttcctttatgacaaaaagtattacccttgctgagttctttgacttccaacgaggggaagagaagatagcgaatattaacagagtattcagccaaacgtgatccatgatgagggacactataaaaaattattcctctggtattgttgataacagtactcatttctggcttcgtagaggcttccaacagcatctttttgacaagaagacctagccacagacaagggaaaaaaacaatgcataagctattttccttccctttattactgtaaaaaaagaaaaggccaaacaagaaatacataaaaagagatgctttctttttaaaaaaaatggtt

SEQ ID NO: 123782 - DNA, 1073 bp, Homo sapiens
agtgcttcatcagataaactaggccacgggctgcagaaaggccttctgcaaggtgggtggtgaaaatttcaaagtggactgggggagtcgcacacaggggaggccattccataagcaaccactaggaccccaagaacagacacttgatcacacctgtacctcagcagctctgggcctggtgtgagcaggcacccagagtctgggactgtgggcactaaagcgaccatagactgcaatggtgagggggagcaggaagaataaaggggcacccctggggccacccaagaatgctgaggcatgttgacgaggtgggtgtatatgaaacgggctgcttctcatgtttattcattaccgctatgtgaaagcactacgctgtcaaacccatatccctcttagatgatttgtaacaggttgcccttttctagagaaaggaacagcatggaacaagagtagtaattttaaaagtcctagccatagctacacagattaatttagcagggggggtaagggagccgctattaagtaaaatggaaagataaaataactttaggttggccacagtggctgaaaataacatcacaatggccacttcacaaagttgaagccacacttacctcccatgctatgtgatatccaaaccactggcctatccccaacaccagcagctctgagcttcctaagaagttcgttgcttctgaatgcaatggactttctgaacaaaacaaaaacagcaggcatgacacaaggctatcgatcccctcaatttgctgtctaatttttagagttaagaactttagtctacaggaccaatgctacatactacatttagagtaagaaatacccccattctctctgcttaatataaaatacccctattctctcttattgaactcctggccccaaggaatcctcccacctcggcctcccaaagcactaggattataggcatgagccaccacgcctgggatctctctgctcaattcctgaaatcgttaattctctatttgtaacttattaacattggcctaattaggaatatctaagcccagaacaggccattcatttactgcatg

SEQ ID NO: 123783 - DNA, 1023 bp, Homo sapiens
tcatcgtgttctttctttttaacttgtccaataatgctttatatcttttgaattatattgattattagactttaagtaggctattagcagaatctggaaaataatatactgtagtgactactgggggctgaaagagatgacactagaacatcctgggcttttcttacttgttaaaagaattgtgagttagtcttcacactttcatacaaaaggacacagaggagagacttgacgaggacacaggttgcgctcttcttggaataatttgtatgttttctattctgataacccacagtttgcataaagttccttttacatttccaacatattttgaggccctacacattagtattttctaacaccatctattagtacagagatttctttttttttgtcaaacaaaaatattagtcactttttttcagtaaaaattttaattattttaatttcagggtggtttatggtgttttggaggaaatggacttccttatgctgaaagttttggagaagttccttcagcaacagtggaaatgttctgtttagaagctatagtaaaacattctgaggtaatttacattttcaaaatgtagtttactttttatgattttattgaaataattatataggttgatttttgcaagggcaataatcatttactgtaaaaggagaaaagcccttcacttatttttaaatttctgctttcctccaattttaattgttagaataatcatgatttagcaccaataaatgagattctattttgctaagtatttctaaaaatttatttaattgcctaaaagaaagcagcctatcatctaaatgtggcatttgcctttgagttatgttgtcttctactgcctttctcagatatttttacatattattttcagataatttccattaaaacaactgccaaagatgtgacaggataaaagaaaaaacaggctgggcgcggtggctcacgcctgtaatcccagcactttgggaggctgaggcgggtgggtcacctgaggtcaggagttc

SEQ ID NO: 123784 - DNA, 1086 bp, Homo sapiens
tgcctgtaatcccagctactcggaaggctgaggcaggagaatgacttgaactcaggaggcagaggttgcaatgagccaagatcatgccactgcactccagcctgggtgacagagtgagactctgtctcaaaaaaaaagcaaagtaattaacattattctcttggactgtatttaattttaagggcttaatgcttttgacaattttcttccttccttaggtaattgtgaataaatatggagataaaatataccctattctcttgataagtgttttataattttaaatttgttagaaaatcactcccatgccttcataatgagcatagtatatccaatatcatagatttcacaatcaggttaatctacagtgtggagctagatacaaaagggcttatctgatctccttaaaaagttggcatcgtgaaaataaaaggtgggaagactttctataattgaaagagactattaaatcttggttttaaaaaacagctttaaatatatttttttgaaaaattggggaagcttgaatatggaattagactgaattttagatgatttgggaagatttttgttagtgtttttgggtgtgataatagcattgtggttatttaagagaatgcaggattgttcttaggagatgcaggttgaactgtgaaaggctgaaatgtcattttgtctacatcatcctttcaaatagtttgggaaaaattacatgtgaatatagatgaagaaaatacggtaaaataataacagttattgaatctagatgtgatgtatggatgttattcttttttttttttttttttttttttttttttttgagacagagccttctctgtcacccaggctggagtgcagtggcgcgatctctgctcactgcaagctctgcctcccgggttcacgccattctcctgcctcagcctcccgagtagctgggactgcaggcgcccgccaccacacccagctaattttttttttttttttgtatttttagtagagacagggtttcaccgtgttagccaggatggtctggatctcctgacctcgtgatccgcctgcctcggcctcccaaagtgctgggattac

SEQ ID NO: 123785 - DNA, 1076 bp, Homo sapiens
ttacaggtaggtagaaggagtacactctgaaatagcaataaaagtatactatagtgaatacataaatcagtaacatttattattatcaagtattatgtactatacgtaattgtatgagctagacttttataggacgggcagcacagtagatttgtttacacagcatcaccacaaacgtgagtaatgtgttacgatggctactcagtcactaggagacaggaattttttagctccattataatcttatgagaccactatcgtatatgaggtctgtccttgaacaaaaagtcagtatgtgatacatgactgtataaatgttatatgcatattactgtatacatgttatgtttcccaacaaaaaagaagtttactatgacaagcttaatagagaagagtagctcttgtgttacattttgattgtctatttatgatgcattttttcttttctctttaagaggttctttatttcttacatatgaagttctggccctgaagaaggctgtgacattagatactcaagtggtagaacgagaaaaaatgaagtcatatatatatgtgcacacagtttctttagacaaaggagaaaatcatggtaagtttattgtaaagtaatcctctgtgaaaaatggaagctagttattgcatttaaaaatgcgtctatttaaaacacagtattagtaatacagattgagctaattctaagaatcaccaaaccccgtgaaaaccaagttcctgaagaattaattgaggaccaaagtttaggcttccgtatttaatccaggtttgcaactctcctaaaattaagtgaagactaactggcatttttagtctgaacctggaattccacatcttagtggggctgtcaatacagaggctggctctcagtttggcaagtacaaaaaacatgattttgtaatttagctcagtgatatttctactttaagggatgtattcatgcaaaccaaactcatgagatatattcataaatatgaatgccaactcatttattataattatctgtcaccaaggctagaaaacctgtctttactagttaggacactccacttctcaatatt

SEQ ID NO: 123786 - DNA, 1060 bp, Homo sapiens
tgccatgttgcccaggctagtcttgaactcctgagctcaggtgatctgcccgtcttggccttccaaagtgctgggattacaggcctgagccactgcccttggccgagggcagaggattctaaagaggcttctttgtgttcctctggtgctagctagtatctggactttgttttacctgcttgcctgagggtagaaaccaaaggtcagaagaaggtgctaagctctgaatccagagtgcaatctttgtgtcaggatttagggagtgtgtaagtcaatctgattaggaaaaaagaaatcttcattttgagattcacaacaaacaacatttaaagttaacttcaggtgttgctcttaggaaaggaaaagctttcatatgctgatgatgggagtacacattggctaatctttttgcaaaaacggtttgtcattctctagtaaaattgaatatgtatactatcagaaggtatgtaattctagatacctgtacgtgtagatagaggaacacgtactgtatgcacagtacagatgtataagatatgtcacagcattgttgtaacagactcaaactagaaacgttctcaatacccatctatgggagagtgaataagtaagttgtagtatatccatgcaatggataattgcatactatacgaaaatctaagtgcgggaactacattttacatgcaacaacatggataactcacaaatacaaggctgagcaaaagaatacatgtagtgtgattccattgatatgaatttcaaaaacaggcaaaactaagctctgttgtttaaggatgcatatataggtggtaaaactgtaaagaaaagcacattgttataataaaaatcagaatcatatatagagatgagaacagatcattatccgggagggacacattgtgggtttctggggttctgttaacattctgtttcttgcctggatatgattatgcagctatttattatttgtaagccgaaatgtgtatatacatgtatatgtatatatacagtcatgtgtcaataatggcgatacattctgagtaatgtgttgttaggtgat

SEQ ID NO: 123787 - DNA, 1089 bp, Homo sapiens
tggagaattttttttttaattggaaagttttcttcgtagtcttgaaaaagctaactctgtgggtcatccactgtgatggtaacatgttcttgtagttaaaacaagtgttttgatttagatgctaaattaaatttgttgtaattgttctacttacacagaatgtccctggctgcttattgcgtcatctgttgcagaagaataggaacctctacttccccaccaaaaagtggcacacactggagagatatcagtgagtacagcttaaacaactcttattttcttataggaacagtgatagaattgtggccatttctaagatgggccacaaaaactttttgaacccatgattaaatctcaaatttgtttatgtctttctgtactaatagttcaccccaaatttataggcccagagccatacatactcctttttcttgagaattattttccctcttctacttcttctgtcaaatttcatactcatcatcctaaacttaaatataactgcattttcattcagcagatatttattaagctcttgcaaaacaacacccatattaggttctgggaatacactggtgagcaaggaagatgttgtctttgccttacgggggctcgggatatggctccagtctactccatttggagccttgccttcgtttaggaagctttctctgacaccctaggcccggttggatctgttacttgtcatttcatagggtcagtatagaacttaattatctgtctttccccatatgctgtaaactctgtgaaggcagtattttatcttgtttaccactataacctagttatttatcatgcatggcatgtagtaggtgatcaaatagtgtttgttgaatggaagaataaaataacttaccttttctgagcattatttcctttatgtgtaaaatgagaagattggcgtagaacatcttttattcatttgacaataaacaaaatatttaattgaccatctactgtgtgccaggtacaattctaggccctaagaatacaatattgaataaaacaaagtccttttcctcatggagtttctttttgatctttaagagaaatctgtttttagggata

SEQ ID NO: 123788 - DNA, 1049 bp, Homo sapiens
caggctggtctcgaactcccaacctcaagtaatctggcctcccaaagtggtgggattacaggcgtgagccagcgcgcccggcctggacttaacttctgaagaactctttctgtttagattgcaggagcgttctctcggctcatctcttgttttctcacccagctgttcttcttctagttggccatcattcttcatccctccctccctttcctgcagttaattatttctttgaaattttaaaacttcttaatgttgcctggaatacatgagtcttcctgatctcttcaaacggggtttgttttgttttgctttggggagaattcttttgacgtttttgaataagctgttaacaactttaatacctgtcttgtttgttttcttcagaaatttgttaattctccatgattagcacctttatgtggttatctcattattttcattcctttttaattctctgttttaggaatgcttgtcaaattcgtcactaaaattgatttactttcttgaaaacctgtttctgctgctcccaacatgatttaatcttggctactgagcttttggttacgttgcactccctttaaaattactccgtttaagtacagtgttcactctttgggtaatgtgtacaatagaagcccaatccccacctatacccaatatatccatgggacaagcatgtacatgcaccccctgagtctaaaataaaaattttaaaaaaactatatctgtcacagcctgtttttatttttaattgaagttctctttttatgagcgatacacattcattgcaggcagattgaaaaagggaaacaaaagaaaatacaactcaaccataatcccaccactcaggagtagccacaattaaaatgttaataacaggctgggtatgatggttcacacctgtaatcctagcactttgggaggccaaggcaggaggatcccttgagcttaggagttccagaacagcttgggtaacatagaccttgtctccactaaaaaaatcaaaaaaattaggccaggcgtggtctcacacctgtaatcccagaact

SEQ ID NO: 123789 - DNA, 1163 bp, Homo sapiens
gtctcagctacttgggaggctgagataggagaatggcatgaacccgggaggcagagcttgcagtatgcagagatcacgccactgcactccaacccgggcaacagagcaagactgtctcaaaaaaaaaaaaaaaaaaaaagagttctactccctatcccaatgagatcacactgctttgacacttgccttttcccttaatttttcatgctcctttatgaaaaacctgaagcaggatttctatttcagaggaaagtttttttttctgattttagatggggagctttctaaaaatgttgatgcctggcctcagcccccagtcattcaaatttagttgttctgggatatgacccaagcgtcagcatctttaaaaggcctgcctggtgcttctgctgtgcattcagagctgagaactcctgggccggtgtgtgcacaatggagactctgggtaggaggttttgtttttgggtttcgttcggtttccagtaggctaatctaccagcacagctgtttccttttactgccaaggaaatgctgagtctgcccagcaaggaaccagcttttgttaaaattcactaattagataactgattccccaagtcgttgcaggatcttatttattgacagtagctagcttgagttggatcctttggttagacggaggaaagtcattgcagcactcataattggttaagttttttttttttaaacataaattcactaagatattttagtcttgtgtttatttactgtttaccatgcttttgtgtgtgtgtgtgtgtgtgtgtgtgtgtgtgtgtgtgtgtgtgtgaaacaaactcttaagctatgtcagcatatcctttctcaggcagagtctttcggaggtagatgtctaattcagtattaactggtttacctagctctcatcactcctccggctccctcaagccctcagtaacatctgcacttacataaggtatttggatgtgtgacttatattttattaaattaaggacagaagttgagtttgacacacaaaaacagggagagcagaggcaggtccgtgagagataaacaaacacaactaatttagtgacatgaagaattcacagaaatcttggaaggttttgaacttctgtggacatggaatggaagggttagtcttatgtcagttttatcaaaca

SEQ ID NO: 123790 - DNA, 1090 bp, Homo sapiens
aagtttgacccgcttggggcaattagctgggaggtgtctacttcttcctgtggcgacaccgcttcagggatgggaaggtgagggtggtctggctttgtggaaggaaacgagggtgacacagccctctccgaggttgaggtccgttagggtcctaattccttctacctgctgaactgcccttgtcatcagaaagtctcttaagactttcctgtcggggataatcagctcccctcgccaggaactgtctcctggatctctttggggtctcccccacgcccttttgttttacagtagttcagcaccttaaggatatcctttaagtcattgcaataggcaggtttatgaaaaagcacagaggaagttatttctaaggttttgaaggacgtaaaaacccgttgcaggtgtgggtgtgggtcccttcctttgtgcctcttcctccgtgtctgggttctccatttcttagttgaagttcttgcagacaaacccgctgggaatggtgcggtggtcctggaaagttctccccgggctccgcagcgccagattgctggggtgtgaggttgtgatggatgagaagtgacagggcaccttgcacatagccacactgcaatccagagaggccatgggcacactcatctcgcgttgtgcagtgatagccatattctgaatgggagagtcacaagtgtcctgtcttctagtgaagtccttgataggtaactggcatggaagtgatgatatgaataaattgtgaatagctaaatttgatgtttagttcttcagtttaaagaatagtacttaatttgtgtgaaagttgttagacgatgtggatttcctttaagaattttaagagctctatattagggctgtggaagtagcaggtttatttatttatttttggttttgttttttacatgatgtggggaggtgttggcttccggagttaaagtccgtagtgctgaattagagggaggaatatggagaaaaatgttttcaacacaatggaactttcatacatggaagatgattaggaagtcatgattgcttcctgtggttgagaaatacgaactttatgcatttactattgtttatttta

SEQ ID NO: 123791 - DNA, 1039 bp, Homo sapiens
tttaggccaggagttcgagaccagcctggccaacatggtgaaaccctgtctctactaaaaatacaaaaattaaccagttgctgtggcacacacctgtaatcccagctacctgagaggcagaggcaaaagaattgcttgaacccgggaggctgaggttgctgtaaggttgcagtgagcagaggttgcaccactgcactccagcctgggtgacacagcgaaactctgtctcaaagaaaaaaaaaaaaaacttaaattttcagtgtacagttcagtagcattaagtatattcacgttgtcatgcaactatcacttctgtccagaactttgttcagattcccaaactgaaactccagacctgttaaaccccaactctttcttttcccctccctgcagcccctggaaaccacccctctattttctatctctatgaatttgactactctaggtacctcatgtaagtgcaatcacacagtatttgccctttcatgactggcttatttcacttagcgtgatatcctcagggttcatccatgttatagcatgtgtcagcatttgcatccttttgttcttgctgttgtttctagagacaaggtctcactatgttgcccaggctggtcttgaactcctgggctcaagcagtcctcccagctaggcctcccgaagtgcttggtttacaggcatgagccaccacgcccagccgaattcctgtccttctaaaaactgaataatattccattgtatgtatataccacattttgttgataaacgttctagatttttgtatactaaatgttagtaactgtggtacttcatgatgatcaggaaccttgtatttgaccttagtgaaaagaccacgaggcaatgatcaggaactctgattagaagttatagaacacttattttattaaaacaaattaaattaattaaattagttaaaacaaattcgttattgtttaatgcatagaaactctttaaaatgaggacccatgggggataaaaccagtacgtgtgttaaatccttgctgggtcctatcacttc

SEQ ID NO: 123792 - DNA, 1043 bp, Homo sapiens
cctaagtcccaatgtgatagtatttggaagtggggtctgtaggaggtaattaaggttagatgaggtcatgagtgtggggccttcatatgggcttagtgtccttagaagaagagacaccaggaggcttgctttttttctccccatgtgagcacacagcaggatggcagctgcctacaagggaggaaaaaaagcctgagaatgaaacctaccttgctggtaccttgatcttagacttttagcctccagaacttcgagaaataaatttctgttgtggccgggcatggtggctcatgcctgtagtcctagcactttgggaggctgaggtgagacgatcacttgagcacaggagtttgagaccagcctgggcaacatagcgagactttgtctctatttatttattttttatttaaataataataaaaaaactaaaaacataaaagaaacaaaataaatttctgttgtttaagccactcagtttatggttttatcgcagcctgagcagacttaagacagcatttttcagtgattatgttggcaatataatttagacacaatttttttatttttttggagacagggtcttactttgtcacccaggctggagtgcagtggtgcgatcatgcttactgcagcctggcctcccaggttcaagcaatcctcctcccttagccttctgagtagctgggactacgggcacatatcaccacacctggtcaattaaattttttttttttttttttagggatgaagcctcactatgttgcccaggctggtcttgaactcctgggctcaagggatcctcctgccttgccctcccgaagtgttggggttacaggtgtgagccaccgcacccggcctagacccaatttagtcctttatggatttgaaatgatttggtaaagtttaatataaagtatcatgttatgatgacttctgctgttccttctcttgctgatcttattatttgggcatctcctggtgtggaaagggaatgataaggatgatggtaattctcggtgctggtgcagatgaagggaggtatg

SEQ ID NO: 123793 - DNA, 1091 bp, Homo sapiens
aaagaaaaaagaggttgggtcataggagaagcccataagatgaatgcggttgacactgaggtcaccttttccaggccttacaagtgatttgagcctttaccatttttattcttgttatattttcccatgaaatgagaaactcagtcttatgtttcatatgtagaaactacttttctgagttaattttctgttgcctgaataatgaaataaataatctaatatttgaaatgtttgggggtaatgcacaataactcttaataaaagacagaaagctcacattttgcttatcttattccattagtaattatttttaatactgggacagaagtgagaatgaaagtggcacgcattctgtttcgtctttttacccagctttgcctctgagggacttgggaataaattaggtagtgtaggattgggatgctgcccagaatctatctattgtagcttactctaatgcatcagttcccagcctttttggatttatgacattctatttgtgtttgattttgcatctccctcctcacaacttcaatggctgtgacagccgggtctgtgttatcagtggagagcaaagtcctgataggaactccacaaattttctctctcattcagttttatcttaattacattaacctttaattttaactatcactttcagactttttctggaccattaacaagctgctcaattacattgctatatggaatatgtttatttaaagtttttgaccaattaaaatgccttgaaaaattttgtgatacagtataaaaagtagtcaatgatagtgagaattgtattttatgtgcatttttgtgcaagaaatttgatagagtaatattaagtatcatttggtccctgctaggctaaaactgcttctttttttgagacggagtcttgctgtgtcacccaggctggagtacagtggcacaatcatagctcgctgcaccttgatttccctgactcaagtgatccttccaccttggcctcccaaagtgctgggattagagacatgagccaccattcctagttaaaatgcatttcttttcttttcttttttttttttttgttttgagacggagtgtcgctc

SEQ ID NO: 123794 - DNA, 1025 bp, Homo sapiens
ttttgctactggtctgagcatgaagccaacatcaggttaaggactgagccaagccaacagcagagagaactctgcagagccccagtgcaccatgcttggcacccactaaccttggacttgttctgtgaaataaattttcttattgtttacaccaatttaagttagggttatctgttatttgcaaccgaagatgtgctaactgatgcaatagctgtcattctttccctcattgcatgaagaagtacagggtataaaggcagaattgatctagtcagaaggtcagaggtggcttccctggggaaatgcagaggccttggtgggagagatcccttttcttgctgggcctcgtgtgccacatttaaggattttggtctttatcgcaagagcagagcctgttataggtttaagtactgggctatggcatgaatgcagtgaactcttactatttaaagtaactctctagttacttaagctactcctcctgaagaacaccttggcttaacattccagagttgagtttgatttgctgagcaggcaaggagcagtcagtggttaaggctttggtgattagtaggtgtgtccagaaagcacagaagagcatctttgcttggaatctgatgaagtgaacagcccagattgttttcttttttctttgccagtgcgtgcatgtgtgtatgtgtttctgtatgtatgtatatatataacttctgtgtgtgtgtgtatacgtggtatgtatactaacatgtacacacatataccacactcacacaggcagctttcatgttttctactttaagggtaacttgtgaacatcctgttgttctctaagtctttgatcacttcaataaaaaagttgcagccgagaaaccaagaaacctgttggcggttataaaaacaagattggtggtcttattgtaaataaaatgttgaggatgtattaatatgtctgaaattgaactttttagcatttccaaaagttttcctttagatttgatataagatctgctctcactcttatacatatg

SEQ ID NO: 123795 - DNA, 1177 bp, Homo sapiens
cacatagatatcttctgtgattttgagaactctatggaattcagttgggattgaatattctgtgtgaattgtgaacctgtatgcagtaatccaaggtgaattgaaagcatcatttatttatcgcagttttgaaccactattaactaaatatccgaacagtggctaagaggtcataatgctttgacaccagtgctctaacaccagcttggtgtcacttcaactcggttctgacaccaaccacctgaactgaatgtcagacatgagttctgcaaggctgctctcatggcagataccaattgcaagtcttcatgctacctggacttctgaccaactggctgtaaatttggggattccaccaccttgtcagttttgataatttgctaaaacaactcactaaactcacagaagatggttttatgataaaggatacaactcaggaacagccaaatggaagagacacatagggcaagacctgggagggtcctggatgccgagctcccatgccatggagtcaggggcatcaccctcctggcacatcaatgtattcatcagccaggaagctctttgagctcaggtgtttatcgtatcagggtcttatgacatcgttggtcatgtgattgagctcagtctccagcccctcttcttcccagaggtcaggggtgggaatggaagttctggccctctaatcatatgcttggtctttctggaatggccagcccatcccttgaaatgctctaagggcccaccctctgtcacctcattagtgcagactcagatgtggtcagaagtgactcttcacagataacaaaagacactcctgtcacccagaacattctaagagttttcggagttctgtgccaggaacaagggcaaaacccagatatattctttctaccacatccatgatttagataaaacttgggttcttgcaggaagtttctgaggatattaagatgttcatgaccatcctggctaacacggtgaaaccccgtctctactaaaaatacaaaaaattagctgggcgaggtggtgggcgcctgtagtcccagctactcgggaggctgaggcaggagagtggcatgaacccggggggcggagcttgcagtgagcagagatcacgccactgcactccaacccgggcaacagagcgagactctgtctcaaaaaaaaaaaaaaa

SEQ ID NO: 123796 - DNA, 1037 bp, Homo sapiens
agtgtggaagaatggcagttatgatttcattcagatgtgcccagctgctgacaaattgaatacaacgatcagtggcaggcagaactctcatttgttgtgtgttgtcttgagtctggtgaggtgtatcctttcactattggattttaccattcagtgcagtcagtagctccatttgatgtaagtgtaaagatgggtctctcatttcagtttcagcaattattcttaaaacctttattttccagtgttttaaagtttttaaattttatatctttttttttttttaaacagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgagaaggtgactgagaaagaagtgtgatttcaaacattgcagcggctcacacagtgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccccttttttcctgcatctataggataatattgtaaaatagcaattgaaaccaataattattaaataaatatcaaggaaaatccaagcaaagctttctttttgttggactagtggtgt

SEQ ID NO: 123797 - DNA, 2390 bp, Homo sapiens
aaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagcgattccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggtgagctgtggttttgtttcactttttggtcacttccagtggtgtttttgagccccttgtggacttgaaacttccttcatttcagtttcatagacttgctgcctagtgagacttcccatgctgtgagttctgtctcttattctctggcagaaaagatgctaagatggacatagttcacagtaggctgcgcctccccaggtgggtcagttgtccctggcacccctgctgtcctctccctgcactgtctctcttagagggtccgggcagtgggaagacgcccagcagtagggaggccagggcgctttctaaccagggtggggggttaaattagatgatcctaaccaacttttcgtgctccaagtctacatggcaaagagttacccccacccctgatgtcccactgacagtgtgaaaaatgaaagtggtgctgcctttaccttgcacggttaacatctacgttcctttggtgatggcttaacacttggcttgtatgttttcgtacttggaggtaaagaagtagttaatggacaaaaaccatagtttttcacatgtatagggtatattatattgaggctattatgccatatatttgtacatgtagattcctctgggcttctaaaatataagcagtgggattatgaaattcatgcaaccaacatttattgagcaatacttaagtgttaggcattgtgttttaaagaagagcgtgattggtaatttcttgcaaagttttgcttgtatggcaccttcgcaatattcatgttttactcttcactagcttatttgggtatttttaaaatgaggaatccatgactatttcaggcatcttaaaaatgtcattaaatggttattaaatagctactgtaaaggagcaggaattttttcaagtataggtcttagtccatttgtgctactataacaaaatatagacagggtggcttataaacagtagaaatttatttctcacag

SEQ ID NO: 123798 - DNA, 1044 bp, Homo sapiens
tgcctagttacatctcatatggctcagcaggggagaggagtgccctcatggttgctaaatgtgggaatggaatgtgaggcaggaggcaggtgagaggttagtacaggtgggaggtgtccccgctgtgtggggaggagggacttttgccactagttctgttacaggtttgggattctaggacactggacactaatgtgcctaatctgtaaggcattctagactcatcttgtgcagttcattcatcttcccgcctcgcaagccagcagagcctgacttggggcctcagctctgcatggagctacctattgggccttcaacagcgagggttttagtcagaaacacagaaatgaatccttagtgcactgggcagtgggtatcgtattttactaggaggtttttgtctagaagttggtcatttctctgggatatggtataggatgggtgggaagggtgccacaaggaaaaacgtgagaatttgtactgtgcaacagtttggtgtttccagttgggtccacccacaaccttgactccaaacttccaaaacaaacacacctgtgcattttgcccaagattctattgctgggtgtttttattgtaccttctggcaacctacatttggtttctcttcctcattgttgctgttttagggaattcttactgacatgtgttgttttttccacttggcctagttagatttggtctactaaaatacagaggagattgtctctatcttagggacttttctttatcctcctagtcaagctcacttccagcctttctttttcctccctgtatataatccctgtgacaacgtttaaggcaaaaccgagatttgtatgttttagctctgttctttctttgctgattaaatttttagagtttaaggaagagttcattaatcagaaccttaacattaaaaaaaaaaaagaagaataacctcgaaagcaccatccttgtcagaaagctctattttgtaaactccttggtagcagaaataaatgtttgatggctttgtttaaaaaggcagtatgagttaatgtttag

SEQ ID NO: 123799 - DNA, 1020 bp, Homo sapiens
gagagttaggagttaggtcagaaaccacgcagtggttttctggtaattttccccagctgtgcctagcaacatgggggtaggcacttccatttccaaaaaaatagatctctgtcacagaataatagtggctgacattttcttaaatctgctgactaggaggcttcaggatacaacctctgcccacagcccccaggccccagggagtgcccgagcgtcctccagatggggtgggcagcacggcccctagcttctcccgtctgcagcaccctctctggatatgctattgctaggagttgtatttgtggtggattttgtgactcttcgagtcaaggttttatttgtctagaaatgagagccttgtctgaggagaacatgcattttttaatgaaacgtgacaggatttgccactggtgttaccagcaggcctgggcagaggcctgtgtcaggtttaaatgtgagctgcaggcagagtcatttgtttgtggtccatcttctaacagtcattttgaaatgtcagtgttcacttctggttggaggaccaccctgagaagattctctttcccaggagtcagtattggcttgtgatgcacgtctaagatcctacataaaaatgactatagtaagccagcagccctgcggcggccagcaattccattagatgagtaggaagagagctgtgctttctgctgttgtttttactggctggtgaagctatacctttgctctgatgttatacccagaaagggaatcgtctcctgaaacttgaagtgttcctctgatgccgaggcctggccttccctgagggattgccccaaggtccctacaccagtgctggcccaggcttgccctctccagtcactctggtttgttgtcaggcagagaattttcactttcatctttgctgctgacttcgccctctcacctcttaattttttttctttgtaaaatttaggaccttagttacgtgtcgtattgagaaagcatagatgactgaagatccatcaggcttggagtcttcat

SEQ ID NO: 123800 - DNA, 1061 bp, Homo sapiens
ctctaaagattgtaacattcatcttggatttatcacaatatacttaaagttgatgtagaattgcttctgtggtgatacaggaagcttgcaacagtgtacttccatctgtccagtcctttgagctgtccttgtcaggttcagcctctgcctgtgattgggacccctggtgggttttgagcagagtgatatcaggagcagctattgctgttagctgttcctgttagcagtacctccagacccactgattattctaatagagcagtattcaattctagtttttagcaagtttttaaaaactttgagtgcatggttttcactgtttaaaaatagcaatgtgttgtcccttataattgagagagatgagctttagggtccctgaaagagaatctcaaaagcccgtttaaccaatgtgccagattgcctgactttttatgacgtttttcttaattagtggatttgtgttatattttattggctcaaaagtgaatccctagctcatagcttatttctcaaatcacttagcattttaattacttttcaatttttgagatacaagtcacatattttctttttaaaattaatatatgtactttctcattgtaaaagacctgaactatacagaactgtaagaagtaaaagtcttagttttccttccagagagaacatgttaggaaaatctcttggcatctgaggagctggctgtctatttttacttctatattgactagctctttttccttctaataaagagtgtatattggtttaaattataccaacttcctctgggttttagaggttagcttatttgtagacgagtctacctaccacatctatttctccttatggcttagagcattttctgatcatcagcataaaattttaggtgccttattcattttgccccaagaatgttcaaactcctcaacctcagaaatgtttctagtagttgaaagactgttttgcgattacttttattggattctacacagaagtacccatagcatcattgaactagctctgttgcataactgtcctgtgtctaaaaatacactgctgagtag

SEQ ID NO: 123801 - DNA, 1053 bp, Homo sapiens
aacacgcctgtagtcccagctactcagaaggctgaggcaagagaattactggaacccaggaggcagaggttgcagtgagccgagaccacgccactgcactccagcctgggcgacagagcaagactctgtctccaaaaaaaaaaaaaaaaaagaagaagaagaagaaagaggtttcaaacagccatctttgcctgaggctcttgtcctgacacggacagtggtggcatgctggttctgccaacttggaaggggagcccttccgagtcccatgatggcatatgtaagttagcaaggcttcctgaaggtgggtgggttgtaatttatttgtacatttggctctgattcttggtgattttgggagaaacgactgcaggcaagaagataggtgctttatggttgtttttttttttaacttaacactgagttttttctctcaaagtagtgtttctttgattctgacttcttctgtgcctccacaaagtaaatacagcaccataatatcatctgagcgtctgttcttgaattctcagtattttggattttagaaggtgtatgctacacataccatagagtatgaaagactccaaacagggctggggcatcaccctgtaatcaaacgtaatatttcagcaaagctcattaaatgggatgattaaaggcttaatagagccttatggcagttcaggacagattttatagccaaatgagtcagctcaagttttgtcatcaaatgaattagtgaaaaacaattggttttcagagatgtttagatttcagaattctggagaattcattatggacccatattccagtcatagggctctgcttttattttcttctcctttgcaggcttgatggtcattagaattgcggattgtgttttagagtgtggaggagaaatgactggctgtgtagggtggattttgcattatgaactatagaagtaaatggctacctagctaagaagaccaattcaggtgtatttattcttcagtaatgacaatagtttcatttatttttctaaaagctcaaattatgaatacatagcttctc

SEQ ID NO: 123802 - DNA, 1062 bp, Homo sapiens
cttccctcagactcctccggcactcacctattctcaaaagccacctagccgagttgctacctttttagataagtgatcagaatttttcaaattaaaaaacaaagttcttatactcagaaaatttgaagcttataatttcttgttatttcctctgtgataaatcgtaaacaacttagatttttcaagtatgtatttttttttccaaattaaccacatttagatgatttagatgctaaactattcagaaataagttagatacggaaaattttgcttctggaggaaaatgaacctaaatagtactcaccctttcctctttccatactaaataaataataccctgattcaaatccatagtaaatgttgttaaaatagtttccccacagcacaggactagcagatgaaggaccatctgagaggcaggtgctgggtgcggatgggccccaggtcgcctctttgtttttgtagtagtgggcatgttcgcactgtctctcattgttaggaagccgtgtcagtggggctggttccctgtggactctcgtgtgagctctgtctgttccctgccctgatccctgcattcgcccccagtcttctccctttattgactgcattctaattagttcaagtctgatcacatcacagaaataatcctggcccacagatttatttcctgtggtaaatgtcttcttggtggttttctaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtggcaggcgcagctctgccagtgaagggctgcggggtagaggactcccagacaggcattccggagccagtgcgttagcaccacacagcgccacgtgctccagagctgggggaagagaaatcaatcaaattagaatcctacttttcatttctctcacatatgtcactggataaaaagagtacaggatcatgcccccttttcaaccatgctgctgttgtgagaactctcc

SEQ ID NO: 123803 - DNA, 1024 bp, Homo sapiens
actatgaatacacgcatctctgccaaaagagaaaatcatttcttgtttgggaacatgacagtgtggtggagcattacagactcaaacaaactagggtttgagttctggcttaccacccatgaacttccttggacaagttactcaactcctgacctggattcttctcttctattaactgagaataatgatatttttggaacagggttcctggagactgaaagatataacgcatgaaaaaatcaagcactcatttggcatttatccttgctccccttccatttccttttctgagcagtgatttcaagtcctctggccaccctaaatctgaagatatgtctcacctcatcactgggcctttctagggaagagaatcccatgctttagttaatggaagaatgacagcattttagaacctttacaggccaactcggagaggcggtcatttcacagaaaccaagaaaagctgctacctcaaggcctgaaactcatctttggtgatgacctatggctactgcttcagggcagggcagttccatgccagacaaggtggtagaacctccacatgctacaggcactgtgataagatgcaagcggtgccatgggcacttttcatatacagtcttatgtaatcctctgtgatcctgaggcacaggcaagtatctcccacacagaagtcatggggtgggatttccggcctacattgtctgattccagagctcatgctcttaatcacatgtccactcacatgaagatgtctacatctgtggctctccttcaagaaggccagttaatggtcaaggggcaggctctgaaggagcctgaaggaaactggtaaggccttatcagtcagtcaatattattacatttactctaccaaatcaactcagaaaaaaatgctgttttcacacagggtcttctgtgatgatatcttacagaaatcctcggcctgctaatagccgctgacaataatgtcttcattcattgtaattttatgtcacttgactgatctgtagcttaggaagct

SEQ ID NO: 123804 - DNA, 1014 bp, Homo sapiens
ccctcagcctcccaaagtgctgagattacaggcatgagccactgcgccttgcttattcaaggcaaatctcaagaaagatttttatttagcgtattttataattcatcaatactgagtgctctatttggtgattcatcgcctgagtccagagataacaaagggcgatttaatttctagacatcttaactgtcatgtcaatcaaccaaaacactgacaaaatgaaaaagtacaaacatagtagctgcacctgtttctgctaaagaaacatattttattccacaaagtgctcaacagaatttctcaaatacacgcaaaaagaaataactaaaaacgaaccagtaccaatcattggataaagatagccctgaagggtgggaggctgtctcccaacttctttcctgagcaattcattctcctaactgtgattcctgtgctccttgctgattttgacaagaaccattcctatatatgtttagttcagggcttaaaataaagatgggcctcccttgtgtggtattcacactactaaaaagtcatgggcagatctgatgggaaagaagaaaaaggatcactctttgcgttggcttagactaaatctcattgcaaagttgagtcctcaggagctatgagcagcagctccactcttaccagccctttaacctacttacagcacactcaccagtcaccagtaagggtttccagtgtagaagctgaccattgagattttactttagtaggtttgtggattttttttttttttttttttttttgagacagggactcactctgtcatccaggctggagtgcagtgacacaatcatggctcactgtggtctcaacctcctgggctcaagcagtcctcccacctcagcctccccagtagctgagactatatgtgtgcccccacacccggataatttttgtattttttgtagagacagggttttgtcatgttgctggtcttgaactcctggactccagtgatcctcccgcctcggtctcccaaagtgctgg

SEQ ID NO: 123805 - DNA, 1015 bp, Homo sapiens
actgcccagggtggccactcaccaagaggcctgggaaggtgcatgtgtactttgatcagaagaccgcgagtgatgctggaatctgcttggcctgttggtgtgtagtcagagcctgttgggggaacatcctatcctctgcaaagaatcgggcctgggggtcagctagtggggctcatcctactttgagtcctagtgccatagtaaggttcatcattctgcctcccaagtgtcagcctgaaatcctttcccatttcaaaattttacaactcttcaaaacacactgaaatatatttctaaacatgatgaaaatagtaatttcttcccatggctactgataaacttctcaacaaatgagctgagaggaaaggatttgctgatctgtgctaccagtggcagctggggaatagtggtgcaagcagacccaacagcacttgtgaccggtgccaaagacaagccaagctggacctgagttaatacaggaaggacaaaatttaatccataataactgctgcagtagggagaatgagggaggaggagggaggcataggcagtattcagggaagcagaaataactgaaaagcaggaagggggctgtcaacgcgattaggctctctggctttactaactggagcttaacaaaattaggcccctactctctcacaaagcctgggagatgggccctatcaaacagttgattctcttggcaggctctcaggcaggaacgtaagagagctggagcagtcatcctcgggacacagccttgagttgttagaaacggtgccagtgtttgctccagggtgtgtgtgtgggaagggaagatggtgtggatgaaataatttatgtccgagagtctgcagtatttagaggccaagattgaggtccagctgagaagagggcccagagaggcctgaccagaaggagcgagcctttgtcctggtggtgaacacatgtgaaacaatacatctcacccctcctaacacatataaggacatattcaatgccaaggtcaggggct

SEQ ID NO: 123806 - DNA, 1074 bp, Homo sapiens
atgtccctagtgtcctgcttcttactcacaaattctctgttagtgcccactgatggcccttgtgtagttcctgaatgatatagaatgtttcattcaggtagcatcccaatccagagtaggatctgcattgtcaggcaatttctaaggcaccatgcaagatttcagctttgggaacctggatttgggtggtgtgcttccctccttttcacttggcacttgtgttcctgcagatggtccggcagcatatcccatcccagtgcagaacatcaagcctctgctcaccgtcagcttcacctcgggagacatcagcttaatgaacaactacgatgacttgtctcccacggtcatccgctcagggctgaaaggtacagaatgctgcacacaccccaaacctgcagaccgggcctgtgtgtgcttgcctcaaggccggtcttgtacactctgtgcttactgattcctgtcctctgtggtgacaccttctgggcttcatggagtctgttaactaaagccactccctcttcactcctttgcttatctgataagtccatacctagtcttatctcaaagggagattcctgacattcagtctttgtcttagcctgctcttttcctcactatgacaagaatgatcctctctcaggtgtacaggtatgtttgcatctggcttacgcatgtctgcacaataaacggactgcagcacctgccatccctaaggcagcagatggtgcacaagacatcatttacacagaagcccctgtaattttaagaatctgacagtcttattaaggaactgatcatcactgtgcgataaagttaccttgaaagacttgtggaggttctgcaattactagactgaggcattgttgtgaagggcagcagtcaagtgctgataccttcctgatagatattatgagtgttgttatctcaaaagaaaatcagtgggcataggcatttggagtgttgtgaattttgcagttcaagagtactgttgatgttgttgaccccattgatgtgagttctatggaaaaacaatctgtctcttcagggttgaatggtacaaggtaaaaaggtttt

SEQ ID NO: 123807 - DNA, 1036 bp, Homo sapiens
ggactgtgaggaggaggaggtcagtactagtgaaaacagaccttttttttttttttctcgagacaggatctcactctgtcattcaggctggagtgcagtggcatgatcttagctcactgcaacctccacctcctgggttcaagcgattctcccacctctgtctcccgagtagctgggactacaggtgtgtgccaccacactggctaatttttgtattttttggtagagacagcgtctcaccatgttggccaaggctggtcttgattttctgacctcaagtgatctgtctgcctcggccttccaaagtgctgggattacaggtctgagccaccacacctggccaaaagcagaccattttagttactgttgcagccacatctctaagtgtggaaggcgtttggggatgagggactagaactgaggcaagagattggggtggagatagagatttggagtcatccacatggaggccatagttggagaaatgaaatggatttaatgtcaaaggaatgaatagaacgaggggaaatgaggaaagggccaagcatagaactttgggtagtggagtgatagccttcatttaacaagcagcagaaggaaggagatggaagaggaatgtcatagagagctgttaccaggggtccttgctcccagagctcccaagatggtggtgggctgcttccagaatggcggcgggccacttccaagatggtggcaagcctcgtgttctctgacctggggttcttggcctcacggattccaaggaatggaatcttgggccatgcagtgggtgttatagctctattagaagtcgtgggtcacggaagagaaccgtggaacccagtgactagtgttcagctcgattagggtgaacacagtcacttagccgtgcaggaacaatggcaagcctttagcctgatcgggagcggcaatgggcacctcgctggatcaggaacacagcagacaccctgccagattcggagggatgggagtcagcggcgggtctgcgacggcggcaaacagcagtggtggacag

SEQ ID NO: 123808 - DNA, 1093 bp, Homo sapiens
ccatcctggtcaacatggtgaaaccccgtccctactaaaaatacaaaaattagccaggcgtggtggcgggtgcctgtagtcccagctactcaggaggctgaggcaggagaatcacttgaatccgggaagtggaggttgcagagccgagattgtgccactgcacttcagcctggcaatagagcaagactgcacctcaaataaataaataaataataaataaatgcctgtaatgccgtaattgggaaacatcaacacatcgcatccactgtagaacctttttcttcactaagatttctagttttaattctgtgattttttttctgatgccatgaaaaactaaggtataagttacatacagatacacatctgtccaaatcgtaaacacctagctcattgtacaagggctatcccagtgtcttcccccaagttcaagataaaagacatgtcatcatcccagaaagtctgcctgtgctccctccatttgatacccattccctagaagtaatcactcttctgacttccatcatcagctttgcttgttcttaaacttcatatgatatgtcaaacgatatgttccctttgtatctggctctttttttttttttgctcagtgtaatgattttgagagtcatcatgttgttgcatgtatcagtagtttgtttttctttattgctccgtggtattccattgtaatgattatactacaattagtttactctgtttaccaatcaatggatatttgtagtttccagtttgaggctattatgaacaaatccatgataaacattcttatacaagtctttttgtggacatgtgcgctcatttctcttggatataaacttgggaaaggagttgcatggtcatgggtcagatacatgttaaagtttattagaaactgccgagcagtattccagggtagccgcacccacgtaaatccctaccagcaatttccaagagagtcccagtttcttccatcctcagcagcggctctgttgtcattttttagaaataattctaccttgttctgataggtgtagtggcatctcatttcagtttaattctgatatctccagtgatggatgctgcttcgttt

SEQ ID NO: 123809 - DNA, 1230 bp, Homo sapiens
gaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacgtacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggatgtttgggttcctcaagaaaggacagcacagacttcagggcccaaccccttaaaactgtcctctctgatgctgagtcagggccagcacctggacgtgtcccgactgcccttca

SEQ ID NO: 123810 - DNA, 1056 bp, Homo sapiens
tggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgt

SEQ ID NO: 123811 - DNA, 1011 bp, Homo sapiens
gtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagt

SEQ ID NO: 123812 - DNA, 1044 bp, Homo sapiens
tcctagggcagctgagtgcttgcggactgctcgcctcccctgccgtgccctcctggccctgctttctgaacccctcgtgagccctatgtgggaggggtaggcacttagtgggcaaagttgtgttggtgccgtggtcccgaggtgctcagtgcatctagtggggacatggctttacagctggccaggcctgagcaagcattgtggcctcaaggaccaggtcccagggagaaggttttctggatggggctgccaggaactgctgtgccccagctacagaagcagagggccaaagccagagccacagacagcaggaagagacaacgctggggggagaaagttcaatgttgcaattcagtggttcgcttaccatttaccattgcagggaaaataggagaacatggaggaaaacagaaaaaaacagggaagagtgagttagtaaaaatgagaggcatcgaaagttactggacctgcaccattcctgaggctcagtgctggcctctgggggtgggaggggagctgcaggtgtggggagggtgtggtgtggatccacagtggagcccctgcaatgaaatcctgaaaactggtgcagcgtgtcctgcgggcgagtggacagttgctttcccccacagagcctcgcggtgggggcgggggtggagtgacctgtcagtggccgcaggatgggcagtgccccacagcagggatgcctgctgtcttgcgttctgaaaggacagttcccggcacctcgagacaggaggttttctatgcctatgtgactttgtatgttgcgtttccttctaaattttgttttatttctggggtgtgtgtactggtggagaactttggatttagtagaatatctgaggtgaatctaaatagattcttcccagtctcctggcttgtgtacctggacggttggagttgttgtgtcctgagatgggccaggccacaggcacaggaccaggggtttggtgtgaggcaggtcatgtgtgaggtacctgcttgatagccaaacgggcatgccaagtggttgagtaggggtctgga

SEQ ID NO: 123813 - DNA, 1057 bp, Homo sapiens
gtgtggggaggggtgttgctgcagggccgctttcctgtgacctccgggccttcccctgaccgtccctcactgctggcttctgcccccaggctggcgcccatgcggctctacacgctctccaagcgccactttgtcctcgtgtttgtcgtcttcttcatctgctttggcctgaccatcttcgttgggatcagaggtaaggttcggtttttactcattgaatcttttgccatgcgcggtggccctggcgtattgctttcggtcagcccagctgtgcccctatcttccactgctaagggccccagcgtggagggagaagtgtccacagggtggatggggtcccagccctgcgcttctagctgctctgtctcttgtgggggaggtgtgcagtaagtagccccgagtgaccctggccatgccctgtgcagcagccaggggcagccttgaccacatgccttcattggccaagcaaacgtttctaatctgctgtgcacgagacccagctgggcgctggtgtgtccagaacatgctgcctggttggggagacaggccatggaagagctctgatgcagctgatggggaggggaggagagtggggggctgatggctgtgagcatggggcggggtggctgtaggagcagtgggatcatctaggccaatcccctttctcatggatggagaacctgagaagccaagtggttttcacaaggttcccagagacccaggtgtcttcagccccgtgcagagggcaggcaaccaggagcctgacttgtttggagagaatctgttcctccattgctttgtttccctcttaaataaaatatctttttccataagggtgatttctggtagatattatttaattgattgacttaatactaaagtgtgaatggcagttaggcttaacctgtcccagaggcaatttgtgcctcaaaaggttagtttcttacccaaaactgggttggtaaatggacgaggaagctgggggagagtgctgtttatctgatggtgatggtgataatagcagctgtagccaacttcttttctttcccgttaagtc

SEQ ID NO: 123814 - DNA, 1192 bp, Homo sapiens
ggcagggccggggcagagcttgctggggaggagtggctggctctgtgtgcatggctggtgggtgcacctctgtatccctgcatgagggtttgtcctccctgccactccggaaggggataacaaagcagaagagacctggcttttaattctaaaggacaaaaggaagggctcttgtcaacagtggagcacacgtatcctcacatctgcacttggtgctgtgcacacagcctttgctttgactcggagtggagggtggagagagcaggatggagaggaaagagggctccatgtagagagtgacaggttaaaaggagagaaagaagaatgtgtaattcactctgttcattattataacaatcgcaaaattgggccagggaggacaaattaggccgcggcatctgcattgacgtgtcttagcttacgtttcccctgtgctctagtgttatatatttatggaaatgtcaggcttgcgttgcactgttaactttcttacacggtgacttattttcagtcatccaaagtagaaagattctaattggtgtaaatcatatattatgtttccaaaaatacccatttggttcattctttctaggaactgtgtttggctggcatctgactttctctgggcttttggcgagttccctggagacaatgagttctgcccatctgctgttgaaacgtgttacttcatgggttatttggcgggagcgtgagtctcgctttctttaaaggcaaatctttctgtgtatttgcagaaatgtgcggagattattgtggctcaccttggctacctgaactacactcagtatacagtgatagtgggatttgaacacctgaagctccccatcaagggaatgaacttcacagtaagtataccagctgactgcacgtttccatggctcatgttctagttcccattctttgttcaatgattgaaatacatctcagcatctaaataatgttaatttggacagtggaggacttgtaaagtttttaaaaattataggaaaactacagtttcttaagtatatagaactaagaatagcttaaatatcatagagattgggcaaaccttaggtgtctgagatttagaatagagagtatatagtgtgttcagctgcaaggcagtgaaggggttagcagacacagcacccccttctctggcccctgtgagtggtcgtcagtctctgcc

SEQ ID NO: 123815 - DNA, 1050 bp, Homo sapiens
gcctcagaggaaggcagctcccagaattctcactcatttcacttctccagaagctcgggaggaaaagaggtgaagcaaagaagaacattccaagaggagatgcctctgtgtccttgtggaggacacacatccagctccctgccaaagagccactgggagccaagcctagagcagggcttcactgatacccactgtcatttggatatgctgtattccaagttgtctttcaaagggaccttgactaagttcagaagaatttacagcagctccttctctaaggaatttcagggttgcatctctgacctctgccaccctcaccctgacaaattgcctacggggggagctgttgaaagagaatctggtctggggggcctttggctgtcaccctcattttccatgttactacaataagagtcaggaaagaaatcttttacaagccttaaggcaccccacgactgtggcatttggagaaacaggcttcaattactcctacaagtgcaccatgcctgtcccagaacatcacaaggtatttaagagacagcttgagctggctgcgtctctagagaagctttggtgatcctctgccagcaagctgacgaggatctgctggacaccatgagaaaatgtgtgttctctgactacaagatacacaagcattgcttcactgcagctacctggccatggaacccctgctgaagtactttcccaacgtcggtgggcctcatggcagtcctgacgtactcctccacctgagaagcccgggaagtgctgaggcagatcccactggagagaatcatcatggaaacggatgctccctacttcctccctagccgggttcccaaaagcctttgccagtatgcccacctgggcctggccttgcatacagtcctggagactgccagagtcaaagatctagtctcccacaccctggccactttgcgtgagaacaccagttgcctctacagtctttaagcagagagggcacagtcattgggagtctcccagaaaagggcaactagcaacctgacgtaatacaggctggcctgaagt

SEQ ID NO: 123816 - DNA, 1101 bp, Homo sapiens
gcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcacttctatgtgtcttgatttgtttgctctttgtgtgtggagttaatttggccttgcagacataaatgctttaataaagcggctttggagacaacggcagggcttttccatttcagcaggcaggcacggaggtatctttattgccatgtctaatgtggcctggggaagagcactcaagatggagacaaggcgtgggtttgggcccagctcccaacttggatgtgtgactttaaaccaatcagataacctccaaacacattttctgagatttttaaatgactgcaaattgttgaagacacagaatgaatgattgtgaaaaccattttgtaagctctgaagtactaagacaatttgtgagccctacagagaacacaggattaacagttaaggtgttacag

SEQ ID NO: 123817 - DNA, 1090 bp, Homo sapiens
ttctaaatacacagtttcacgtggaacacagcagggggcaggaaggtgggtggattacaccagaactgggaacagtggagggggcttgttgggaagtctagttctgccgcagttgttttctgccttatctttgacttggttaccagctttcaattagcaagtgcaattgaaagtacacatttccatgctgggcgcgatggctcacacctgtcatcccagcacattgggaggccgaggtgggcggatcatgaggtcaagagatcgagaccatcctgtccaacatggtgaaaccccgtctctactaaaaatacaaaaataagccaggcttggtggcgcatgcctgtagtcccagctccttgggaggctgaggcaggagaatcgcttgaacccgggagatggagggtgcagtaagccaagatcacgccactgcaatccagtctgggcgacagagcaagactctgtcttaaaaaaacaaaacaaaacaaacacatttccaatccacatggaaacatgaggtgacattgcagtgttacttgaacttgtgtcactggcctcaacagcttttttgccgccgcaataggtaattctgtactcaagtgaccctaaatattgggtagtagtcaatttgcgcaggtccaaaattggtggagggttccctcctccttgaaaaactgaatttcaaagtatgtgcggagggagagctggcggagggagaggtttaccttcaacaaagcctcccccaccctttgacgggagaggtttagcttgaacaaagccccccctaccctttgacaatgcccaggtctagtaatactgctgttctcttaaaccgggacttctggccccccagccctcttgtagcctctgagctgggagggagcacagtggccgaggacaagaagtaagccagccctatgtgtaacgtgactactcaagagtctcagggagatgatcagcaggtcagtgggtagaaatcagagtgacctagggaggttttaggtcctcaaaagcaaggtcgccagatctaagccccaggcatcagatcccagtccatcaccaccatgcacagctcagatccctggactgctgg

SEQ ID NO: 123818 - DNA, 1152 bp, Homo sapiens
aaaacactcgagagccaggtgcagtggcttacacctgtaaacctagcactttgggaggctgagacaggaggactgcttgagcccagaccagcctgcgcaacatggtgaaacccatctctacaaaattaaaacattagctaggcatggtagcccgcacctgtagtcccagctactcgggaggcggaggctaaaggattgcttgagcctgggaggccaaggctgcagtgagccatgatggtgccactgcactccagcctgggtgacagaatgaggtcctgtctcaaaataaataaatgaaaactcaagaattagacaaaccagatggctctggacccagtagtacgattagtagagtggaaataagaagacagcatgaagaactgaggggcaagttgagaagaatgggctcgtgcagttggtgacttgatggctaatttgcaccttgccacttggcacttggtcacacacagttttctattactttcctcttttccagagactcagagccttggggcactgagggatgccagttctgcctgttcatctggaacctggatctaaggagggaagaggcgttgcccctgctggcatagtcaggtaccagcccagccaggtaagaacctaaagtccttgttgctttgtgattttcccttcatctagagaggaggcctttggagaacaggtcttgtgggtgctttgtcagagactagaagccgagaacatcccttttcagagctctgggttttctgttcctcatgcaacctctgcagttgggatgaataatatattttaattttattttacaatagggaaactgacaaatattgaattcctgaactgagcaatcttggcctgtaggcccatgaacttggagaaaaaattaaatctttatttttattaacctttaactcaaatttagcattttcttaaaatatggatataggcaagaaaccacagtagaatcagcagaacttgtgactttgtcaccaacagaaatcacagatattttcataccacatgatatgttgtagctatctcaagacattgtttctattcatcactactttgaaattctgggagtccttagatcactgctagatcttaatatttcatgcatcaaggaacacatatattactatattacaattttta

SEQ ID NO: 123819 - DNA, 1054 bp, Homo sapiens
gcatttctgtacccttccctcccagacatcacaagtcatgcagtcccttcctttaaggctttgttccaagccaccttctcagggagctccccctgccccactccccccacctgctctatgttaatccatgtcctcaccaccccgacatgctatagagttggctcatctgttgggtattgtctgtgtcacctccccactagactctaattcccaagagctgtatccaacacttaaatggcctcaataaatgtttgttgagtgattgggttaatcctaatcatagttaccatttattgaaagcccaaggcaggtgcttcacagctcagtcattctcacaaagatcttgttatggaaggtgctgttatcccatttcacaaatgaggaacctgaggttcacagagtttaaagcgacttgctgaggtcctgagatgactgtagaactctgattcaaaccaggggcctggggagtccataccggggagtccaggcttttcacactatcccacaggcgttttgtactcttacattgagcagttttcctgacccatgctgcctggttcagcctcactcactcagggccagtccacacgtagaagcagggaaccaggatgctagcctagggagaggtggggtgagcaaatccatcttagtccctttgctgcttagggactttttgttggaaaacaaaaatttgtttttaacagccccatcagtggcatatgagattatgcaattccccatatactcattaactttgagtattaatcagattttacacatacacacatggatgatgttaattttataattattaactatgcctaactaaatcatagtgcaaattcagtagggctgtctattctcacccatttttctaaagttttctctgatttgtgcccttaaaatttataatcatgttactatgcattgaatcgtaacctgttccctttaggctgaagcagcatttatttgaggaaactgaactcccacaaaacaaaccactgattattgcttcttgctaaaggtgttgccttcccttctgagaaatatttac

SEQ ID NO: 123820 - DNA, 1026 bp, Homo sapiens
agctttgttggggtgggagtggtggtggcggcgtctgtcatcagtggttggccttttaatgtggacttgaggtgaaaaacttctggctggtcatcatttttaaagggatgagaggggatgaagtggtgccctccccgaccatggctaaattgtcttcctctcttacagagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctccagtgcttatcaaatgaggtaaaaggccggctggtgggcatggtaactcccccctgtaatcccagcaactttgggaggctgcagtggatggcttgagctcagaagtgtgagatcagcccaggcaacatagataccctgtctacaaaaaaaccaaaaaattatccaggtgtggtggtacacacctgtagtcccagttactcaggaggctgaaccgggaggattgagcccaggaggttgaggctgcagtaagccccgatcatgcaactgtgctccagcctgggccaaagtaagaccctgtctcaaggcgggggggggagtcacagcttcgctgtgagaagcactttattttttgagacggagtctccccgtcaccaggctggagtgcagtggcacgatcttggcttgctgcaagctccgcctcccgggttctagcaattctcctgccccagcctcccaagtagctgggattataggtatg

SEQ ID NO: 123821 - DNA, 2455 bp, Homo sapiens
ttggagaaagtacctgttaagtgaggagagctggctacaaagcagatccacactaagctcaactctagggctggctgggatggaggcgggcgggactgggtgtgtgtgaagctgttggaaggactgcaagtggcgagcaggagagcacttgataatgactgtggcatgaagggaggctaggaacagagcccgttactcatgctaacaggattttttttctaaaaattatataatgtctagagttacaggtaaaaaaagaaatggtagttttaaaactgcccaggttccggcatcacagttcctcttcctgtcttggacgcagagggttgtaaaccccccatgcaccctgagggtgctcctcttcgaagccacagcccagcacagttcagtgctgccttagcctgccaggacagagggaggtgacagtctgttctcatagccaggaggataggacttctgggtgagaagtcctcttattaatttgctttccaaaggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaatgctgcttaatgttacagacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagcagcacgggtgtgtgcttgtgtgtggggtgggagggctaccgccgactcgtctgggctctatgctgtcctctggccaggtttcgtgaggggccgtggtgtccctgggggtacactggtaagttggagctgaccaacccaagacatggtgctccatgggtcacctaacctcctcgagatggtttccacagga

SEQ ID NO: 123822 - DNA, 3047 bp, Homo sapiens
ccaggcaagcatcggggatggggagcagcagtgaggctggagaggacatcatgaaaggtggctacctggaagagcaggcagctctgagacttgaaaggtttcccaaggctgagagttctcaccttggaaaagctttgcagttaacgtgcagtggcatttcagtgtgcatgcaggatgtccctacccacacacaactgcacacacacgcggcacctgcccttcctccacccgtcccagagaatgcactttcccagtgctacatacccacacataaccgcacacacacgcggcacgtgcccttcctccatctgtcctggagaatgcacattcctagtgccgagatgctgccatccctgttctgctacatttgttcttttagaaaagttctggacctttgtgaaggatggtttggagaagaaaaccaaacgaaggagcttgagtccaggtggccctgttctgttttgtaggactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggtgagcgcgtgaggccagagtggggggggcctgtgttctcccaactcagccactggcagccagtgcctgtcaggtgactgtggagctgatggggagagtgtggtggaatggaacccagtcaccacgctgggatcttcgaggcctttgtctctgggcggttgctgtggtgctgagcctgttgtcagccctggagcggctgctccgtcaggcagctcaggctggcagcaggctagggtggccctcaggataccaagtccatcctggagcttcaagtacccgtgaagtgtgttgacccctcactttcctgccagagtctaaatctccctgtgcctctttttccctgcaccaggcaacagctggaaacagagaagaaaaggagagaaaccgtggagagagagaaagagcagatgatgcgcgagaaggaggagttgatgctgcggctgcaggactatgaggagaagacaaagaaggcagagagaggtcaggcgccctggggctggcactctacactgggtcatgcatttccacagagtagcaggggccacacccacccacccactcaccaggaaggaaaccaagaacgtgtcccacagcgcagactcacagccgaaatgataaaatggttatttggtttggaaaacagttctgtacttatttaactttgatgctagttgttctaagactttgtattttaaaatttccctagtcttttgcggtaagtgctcaatcacccagtttccccgatgaggacagtaaggtttggtgcggtacagtgatttgcccacagtcccccagcccatgactgacagggccatgctgcactgccctcgacctctagactaaaacccaaaggcgtgttcagagccagacttcccagcacagctccagtcaacaaccccagcagctgggccgattacacaaggcgccacagatgctgtattcactggcagcccttacagcacacatgggaagggtgttctgtgttctgagtggagtgtggaccaccagcacagcgggcggctgacctggggagagtagcgccaagagggttgagtcaggcatgccagagagagggcgcctggctggcgttggacgggtttctagccatcttgaggaagttgtcatggatacagcagcaatgagctctgtgaagtgctttcctccagggtcactggaagacatcccctcaacctgtgacttggtctagggctctgtggctttgggggtgggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggtaggaatggcctgagtttcaagatgctgaattatagagaggctgcttctgaggatggaaaatgtgacacctgccttgtaataattgtcatgactggaagctgtaaactgatctgctggggggctgaaggcagctggtggggaaggggctgggctgttgccagggtcacccattgaaggtgggtgtgggcatccaggaagagatgccgggggtgcacaatggaccctgctggccatggagtgggggtggcggggactcaggtgtcacgttggagactgcttgccaacacacatgaacactcattcacaactggactccgttgaaaggatatcagaactgacgtgagcttggcattcccttcccaggctgcggagcttgcagaatacactgccaagattgccctcctggaagaggcgcggaggcgcaaggaggatgaagttgaagagtggcagcacagggtgagtctgcacgggggacacctccgcacggccacagcacctgttgcccaattgcctgcggtggggcccttctgcaggtgggtgggttgggggagaggtctggctcaagctgccacatcccactggaagcttctgggatgtctcatgatcctctgccaataccagctgtactactgaagtagacatccccaaagagatgggtttgactttgtacacgagtcagtgcagctgctggattcatagagggaggacctctgattgactttcacccactttgctccctccaccccgaactgttcagtgctgatctgacagcccccggtcaggaactggttttaaatctaattatatatgtgccccttgcaatggggtcgcagtgcctgaaacacgacctcctgcagctagtatatacagcgggcaccatggaaagatccagctccttggacgtctccaggctggagtgagagctgggctctgctgctcatcagctatttgggg

SEQ ID NO: 123823 - DNA, 1106 bp, Homo sapiens
gtcttgcgagtctgcattatttcagcctctgaagtttgtttgaggtttgagcctcagattttgtgcttcagggtttcctgtctggcccaaacatcctttatggaaggaaaacaactcaaagcctatgaggagggttgtgggaagacatgtgtgggcaagagaaaaaggaggattgtgctgagtgataaaacttaaaaacctgttagagaaaccagtgtgaatcagttcttcttcaaagtgtggggtttggtggtgaggctccagggcagcacggaccccaccccaggcatagcttctgggctgtatgggtcccctcctcaccggtcggctgcccggcccctgcctgcctgcacgcagcacacagcattgagcccatcctacacaaggcgccttaatttaaaaatactggaaaggttttactgttctagatattgagtgctaccagtgactctgcctgtttcactctccccaattagagataatgctatgttggaatacctgaagattgctcaggacctggaaatgtatggaatcaactatttcgagataaaaaacaagaaaggaacagacctttggcttggagttgatgcccttggactgaatatttatgagaaagatgataagtgagttgaagttcacagttatcttcagtaggtagggtggtgggcctggaaacaatggcaaaatggcaaatttgtgggttatttttgaagtatttatttagcaacttactatcccaaagtaggaaactttttaaagggcttttggactgctgtggccctctcaaagggtggtccagaggtgtgggttatcctctctcatggtgggcggggccgatagtgggctcagtcctggtagaggaaggcagaatagagcagaggctgcctctcctccccgctgcctctgagattccaccccagctgcctgcaggtaccagcacatccatccatagctacttcgcaggcagcccagccagtgctcgactcctggctcgaggtttgtgctaatccaaccaagaatattgatggtgtgatgagagacttgaaaagctgtaaacaatagcctgtacgtgtagacacttgagctaaatgctgggagtctgcagg

SEQ ID NO: 123824 - DNA, 1048 bp, Homo sapiens
ggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaaggtgagcacaggatgacccggcctgggcaggagcagtcatgccgtcctcggcagggagaagtgattgccttagaagcacagtttaaaaacacaaggacttcgccagtgtcaagtgctccttcatgctagtcattaagtcactgaccagcgacctgaaacatagccagggaaggcgagctgccattcctcatggaaactaaagcgtggccgtgtcctgtgggacatggcatagcaaacttctcgacctgactgctcagctcctcctggggtatgataggttgcccctgtgaaatctgtttttatttagtaatggtcacaaaaattaccccatttggaagaagaggccacttaaaatacctcttagtttttccagcagaactgagttcttgttcaaaatgctaagtcttccagattaactgtcataaatagaaatgctgcacatcaggaaatagaaaccaaagctctttgggattgattgatttgaatggaaagtaagggtttgaatgtgggtggtaagtgggcctccttccttgcctgtcacattccttaaggatgacagtgctgtttccttttgcattccagagtgatggaccagcacaaacttaccagggaccagtgggaggaccggatccaggtgtggcatgcggaacaccgtgggatgctcaagtgagtgctgtgccctgctgttgggatcttgccatctccgtgcgctccagcatgtcttttcctgtgactctagttagtgctttaaagggctctgtgtcaggccttgtgaagaccttgagggaaccga

SEQ ID NO: 123825 - DNA, 1081 bp, Homo sapiens
ctgagaggcagaggcaggcagccagaggaggctcaggtgtggcactggatgctttagtcttctgcatgagcacacctgaccggcagcgatgcacccaccgcactgttccctggggggctgtgggctcccatggttctgtgtgtgctggccataacccgccctgctgagtttcatgcaggagagcatcctggagtacaaaggagtaggagtgagattttctaagatttgaaggtagaaccctgaatctgctcaaatttatattaaaaataagtcgttcatggctttgagataatagcctcagttagtaacaagttatttgagtgcaaaaaaagatgttgcccagtggttggactgagcagatgtcctggtttcctggggactctgctagaccatgtgatgaacgacagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatccttttttttttttttgaaacccccactgtcctcccaagtcacagcaacaagttaaaaagatgatgggaggtggggaag

SEQ ID NO: 123826 - DNA, 1044 bp, Homo sapiens
gctgagatcacgccactgcactccagcctgggcaacagagcgagagaccctttctcaaaaaaaaaaaaaaaaaaaaaaaaagcggagcagcaaactaagtcccttttccatcgagggaggtctctgaagcagagctgagccagcctctcagctctgccctggtggggcaccccatagcgcccagaagcagtgagggctaaggcggcagagtgcagcatggccatgcatgattggagcgccgctactgtgttggtgtcagtttggcagccagcaacttctaagaacatagaatattttcatttagaacttaaaaacagtaaacccaaaaagtttagtttttaaaaattcattttgtttctccctaaagatttttattcttttgaaaatgaccacagtctagtttgaatgccattgtttttcagctgtttcttatttgcaattgctaaaagcaacaaggagcaagttaaatgtccatcacctgaatgggtagacagaagtgacagccacacaatggaatattcctgggcagtaaaaaaagaatgaagtgctggtacatgctacaacatgaataacccttttaaacattatgctaagtcatgggattcagtcatgaaagactgcatattacaaaattctgtctctctgaaatgtccagaataggccattccttagagacagaaagtagattggtggtttccaggggctgagggatcaggaggaatgcagagtgactgccagtggccatggagtttctttttgggctgacaaactattccaaaactagatagcagtgtcagttgcataactctgaatatactaaaaaccactgaattatacattttccatgggtaaattttatggtaagttacatttcaatagctgctatttaaagtacatagtgactcaacatgaaaggaaaaatatacagttttgtctctataattacccaattaagtgaaccaaaatagctgcaaagtttttaattcatttatcattggttgtaagaattttccctatcatactcccatttgtgggagaaaattt

SEQ ID NO: 123827 - DNA, 1022 bp, Homo sapiens
ttctaaccatatgcttgctggaaaccataataatgtaaaaagtcgtcattgggttttcaattgcaattacattgatataattttgtatataaaacagtctgttactgggagcagcattgttcatgtaagaaagatgttcgcttcatataatacatggaaacaaagttatattttcaatgttagccattactgtgacactccaaaaaaggctggtgatggggagaaagaagagctttaaaaaaacctacagacaattcacttgcctctcgggcttttctgctttgcctgccttgaccgaattagagtatctgcatttctgcactaagctggttgaggtttgctaagtcaatggtaatgttttacagagcttggctgttagccagcatttgtggaaaacgaccaatgtctgtcatagctagtgctataatttattcagttggcatattgtttatggagacagtgagataaggggattaggatccagagagactattaaaatatgtgagtccatctgttgtgatctgaggtttcattagagaaaacctgtctgctagtacaacaaatggagacttagtaaggatgtttttatataaaggattataaatcagcagaggtaaatacattaatcttggccaaacaggtcatgtccttttgcgttttcctgatggcaggttctgccccctgccgcccgggcactgttggtcatagcgtgaccttggcatcagctgtgagccggtaaacatggaaatgtaggcccctcccaacctgagtcagacccttagcctggggtccaggaaactgttttaacaagcccctgggtgattttttttcacatgttcaagtttgagcgcctcgagggcctgtgaatggctgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcag

SEQ ID NO: 123828 - DNA, 1065 bp, Homo sapiens
ttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattatgtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtgatgcacgcctgtaatcccagatactctggagactgaggcaggagaatcgcttgaacccgggaggtggaggctacagtgagccgagat

SEQ ID NO: 123829 - DNA, 1888 bp, Homo sapiens
ttagagacttttgactgaaatgcttgatatagttaatacacataatttttttcaaaatgaaaccacaaagagctataaagagaatttcatagctaatttactgcttacctgtatttggggaagccatttagcatctgtgaacctaaatttcgtcagccgtaaaatgggagttagtttttaagtggaaagaatgttacataagataaacggagacaaagtttttatcagtgaaatccaaacaactcatcttaagatgctgtaagctttatgtgtttcttttgtgtttccctaccccgcaaatgtttttcaaacttaaccctgttaggtaaaaactctgggttcctataaacgggtaaagtttgtccattggtcttctcaaggaaaaagcaatatgaacagtttgggttatcttagtaaaagggaggactctgattttgtctcatgtccatcctctctctgtgtgttctagtcggaattcccttatcagtcacatgggtaccaccttcatgttttgaagcgctattatatcccattatgtgcttggtgcagggacaataaaaataagattggttttgcctttaaggagttctcagtctcctagtgaaagcagatatgtaagcaattacaatgcagtgtagtgcatgatagaggtcttcacagaagagaagtgtgccctggagaccagggagggcctcccggctggtaagatcctttgggtaagtgtggagggatgtgggcttcccagtcagcagtggtcagttctgttttcctttattcattaacccgttcttaacacttacaggcaaacagtaatgctgtttcaaaggaaatgtaaaacttcattaagttatccttttaatctaatatacttgaaaacaaaaccttaaaagcaaaataaaaaatatctcaccatgacccaccttttattgataggagaggaaccagtatcacctgaggatcaaactctagtagtcagtatatcagattttgctcatatttttaagttagaagtcacttctgcaacctaattttgttttccatttttgcctgagagatcaattttaaactgcctgtgtggacagttgtcatttcagatactgtaaataattgtttttactttaggatggggtaggtaaactatcatcttagggccgagtctggctgtggcctgtttttatttggtctcccagctaaaaatggtttttatatttttgaaggattttaaaaacaacaatatgcaacggactccaagtaagaccctcaaagcctaaaatacttactggctggctctttagagaaacaaatggaccaactcctgcttctagcataaaaataattattgttaagcatttattctaaccttgtatatattttatggctggactaatatttggaagcagatccaccccattggttccagtttttaaaaaattgttctcaaagaacagaatgtgttttgttagccaatgttgagcacatcatggactctgagcatggactcagaaactactgaggagaggcatcgtggtgctgaggtaatgttttaaacaaagctggtgtttgggtgggtctttgtgtagagaaagtggcagtatcttgtgtcacacttgctaagctattgtgtaatgacagatttctggcatatgctaaaagaaagcaatttgtacctgatgtttgagttggaaagagaatgttatgtaaatgaattgcttttttcctcattgatagtttaaaatgagcttttgatctactatagtctgtatgtgaatttctgactgcagatgttttgtaagtccattcctgattcagaacaccctgtctaaagtacagctccatctctgtgccgtgccccactttactgcactcatagaactcggtctccacctat

SEQ ID NO: 123830 - DNA, 1002 bp, Homo sapiens
ctgagatctctttaagctgtcatgagaaccatagagctgaactgcctttaagtggctccaacacatcttacctgttcatttctgaagtgttatagacatttctaatacaaaagcaggtttacctttcattaggaaaactctgaaagtgtgttcacatttctactgtgccaaaattttaaggtaatttctgagattaccttgcctctttgggaatacataaccttttctattaaatattttaacagggacagtttactgaatgtactcccccctcacaatcccctcgcaattgaggaggatgcgtagcatctgtttccacccctcctcctccacgaggggcagtggtgaattaggtagctaacattttgccatgtggcagtgagaggtgctggtaggatgagtgatttgccatgatcacgctgtaaggcacaatgaatgtatttggatgttcacagacacagtccctgtcagtggatttacagtctggtttcggggacagacagcaatcccagagtaaatgtaaaactgcagcttcagagagtatgcctgaagaggggtacatgaggcctgagagtagatgaagtgtgtatgtgctggtgggggtgcaaataggggaggtcaggaaggcatccttgaggacgtgacctccctgggcagaggtaacaacgtgtgcaaaggccctgtggtgggaggaagtagtgtgagtttggggtttcacatgaagcccaatgtggctagagaggaagacaggtcaggccatgccttgtaagccattcttgggtgttttttagtttaacttggggttttgactgggaggtgacatgatcagatttgccttttgaaaagttgactgtgatctgtaataggaaaatcacaggaggcaggagacagcaagggtagttatggtagaccattgagggagctcatagcttggaccaaggtggtggtggtgggaacagaagtggatgcatttgagagttctttgggaggtagaattgatag

SEQ ID NO: 123831 - DNA, 1021 bp, Homo sapiens
ttctgggtgtggttttctttatttcactaaaagaagaggtgcagagctcagctaagatagcactcaggaaaaagttaacctgttctccgtcactacttttctttctcatttctcataatgaatggtaatttatttttatggtttcttttttgtattttggtaaaatatacagtttatcctcttacttttaggtttacatttcaaggtattaagtacatttacattgttacatagccatcaccaaggtccatctccagaactttatcttcccagattgaaactctgtacctattaaactctccctccccatccccaccaccagcccttggcaaccaccattctactttctgtctctatgaattcgacaactttagatacctcatgcaggtggaatcgtgatagcatttgtccttttgtgacagtctcatttcctgtagcataatgtcttcaaggttcatccatgttgcaatgtcagaactcccttctctctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagcactttgggaggctgaggcaggcagatcacatgagcccaggagttcgagacttgcctggccaacatagactctgtttctacaaaaaatagaaaaattatctgggtgtggtggctggcgctctgactgaggctgaagtgggaggattgcttgatgagccctggaggtcaaggctgcagtgaactaagatcaagccactgcattccagcctgggcagcagagtgagatgttgtctgaaaacaaacaaaaccccttttttgaga

SEQ ID NO: 123832 - DNA, 1035 bp, Homo sapiens
ccgggcccgggctggccggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccagtaagttgcccagtttctgggccgggcggacgggagaggcttcattggagaggggaggcacctgctcgaggtgttggggcagttcctggggaacagggttcttctcacacgcagaagacgataggaataggaggaggttttcgccgctctttgttacttgttgacccttttgtggagcgttaggaaaacaccattttgatgcttttctctgcagtctttttctttgtgagccccctccccagtagttacggtcttttctaaaaactagaggcctttttacactgcttccgtctgtttttaaagggtatagtaatacaacttagaagtttcttaaaaagtccaaatcacagggagactcagatggcttccgaccacacacaccagttctcagagctcctaagggtccgaaaccacaggcgccccagatccaactggggagatattaaagggcgtttgggagaggagactggctttcggaagttgcctttcagcttcgcttcctactaggcccatgaagcggtgccctgtacaccagcaaacttgctggctgcagcagaatttctgtctctaacagaaggttagccatggacttgaattgtagatgcaggcagccggtggagtttgataagaggttcctggcaggccgggccgagcactcctggtcagctgatgaaagggctgtgcctgcgcctctgtctccttgaatctgattgtgttgagattgctggcgagacctgggggttgtaggcacaaggcaggttctctgggactgacgcttcttagaaagttgtatgtattctacctgcttttaacactggggaactggtgactag

SEQ ID NO: 123833 - DNA, 1067 bp, Homo sapiens
agtaactaggactacaggcatgcgccaccaccagctaatttttgtattatttgtagacacaaggttttgccatgttgcccaggctggcctcgaactcatgagctcaagcaatctgcccgccttggcctccaaagtgctgggattaaaggcatgagccacccagcttggcctctttccccgttttttgaaaaaaaagtatgtggcataatggggtagttggaagcttaaacctcctctattcggatactctcatttgacagaggaaccgggccccaaaagattaaactgattgtcctcattcctgcacttaaacttctcttgtcaatattaacattacctccatcttgctgaatccagaggccaaacctcttggcctcatctgacccttctcctaagcagctttccacatgtccaaccattccctgagcatattttgtgcttaggatttctgtgctttctcttctcttcccctctgggtccttcccagcccttatctatgtacgaattcttcccctaggtcatgtagcctgatcccaaggcttcagtcacgtccccagccctgccttttcccccagcaacaaccgtctattggtgtctccagggttcttgtttgttcaagaacttcctccctcctagcctccctgttctcagcaaagagctccaccacacacgctgttacatggccccaaacctagaggtaacctgcattctctttttgcctcaaccccattttatccttcacccctgtgcctccagtccagcagaccaaacagccacatttcccggctaggtcagatggtgcacgcctgggtttggggataaaattcaaactcctccttggccgggagtgcatcggcatctccagctgcgtcttctttccctcactctcactcgccctgagcttgagctcagctggctctgctcccgctgctgatttttttatctgtgatcactcagccccgttgctgccttagaggtcttgtgcttcatattcccacggcctggaaggcatgtcccccatctgtgccagcctggccttttctcatcctccaggtctttgcagcagt

SEQ ID NO: 123834 - DNA, 1056 bp, Homo sapiens
caatttattgagtcttaaaaaatacaaaggcatagttccccttaatctatcaggcttccagctctaaagaatgtctctagtattgcggggtggggctgcgcttaaaaacgcagacgctttggttttagtaccagcaacgttaaaaatcttctatcttgtatgagtgaatgtgtatcccttgtgatcagttatttgcatttgcagttacaccttcattcagctaattgctgtcttgatttgaatccaggttctagaatgtactagctccgaaacctcaggcaagttaaatgtttttgtgcttcattttcctaatccacaaagtggcaatagaagaatttatctctttaggttttgtcttgaggattaaaaccgttaatacttagagctgtgcctggtaaatggcaagcctttatattaagatctggaccgttctgtgctttgaagtgtatgacctaaagcagatgtaggcattctataagtaacactagcataaaggtgtatggtaaattctagaggtgaaaacactcccaacatattttaggtctgatcatttaattttgaggtaatttctgaaagggctagaggagaaagtgacatttaagttgtgtttgataaatgatagtattttaactggccagcctcttgggggaagtgcattcggaatggcttgatcaaaggctcaagaagcccaaggtgcatttggaaaactgtaagcaaggtttgtgtagatgagttgtagaaatatatatagacaggctgacaccacatcgtggaaacagtaaacactagcatattaattagaatattttttccctcaagtaacaaaaaaccaattccaagtggctgaaataataaggaattcattattttacactccccaggttggttaacctggagggtaacttgggggctcagcacattatcaacaacacgttttttcccctacctttccactctgtcacctgggttgttggcttcaacaaagtagtaatagaagtatctgctcttttgtctttattggaagagcaaaaccccctcgtaaactcccaactgacc

SEQ ID NO: 123835 - DNA, 1074 bp, Homo sapiens
attatcaatgagttgagaagctgaaataaattattctaaactattaatgttggaaagaactccaaattttagccaaattaaaggaaaaacaacttttattctcactagagaaaataattttaaatctttattttttaggaaaaaagtgttttaaaagagcatgcaactaaaaaagataggaaagggagcactaccgaaatgtcccaggcagttagtaaaaatgttatttcatattttggtgaaaaattttgtttgctgtatttgtcagcgttattaaatttatgctttatgtttttttgttctagatacatatttgtgtttatgattaaatttgcatttgtaagtttgccttctttttcttgtagagagcctccaaaattataaaaacacagagcccctcaaaatctgagtctgacctgaaggagcccagctttcaaatcgatccttgttttcccacaaagttgttatttgagtctgatgctactatttagaattgtaggttctctgtttttccatttcctacagaagaactcagattgagaaaagctatttaccaatcatttccttttaacctaaaaggtttcagtgactctctctagcaagagtttgagggtgcatgctatttacctagtcagagcaaaaccatgattcagagtgtgagaaaatggctctcattttcctaggaagttttcaatataaaaacatgctgtgcttttgaatgaaaagtaaaatttaaagccaatggatggaaatttcttgtaagaagatgtaaaaaacccctagctgtttctattcttgaaaataagagttgttttttcacagggtctaagacttgaatacattttttcgaaatgaatttggcctgttgtattaaggcctgtgataatacgatttcattccttggtgcagctccttaagtaccttccttctgtagccactgtgctttggtgttttaaagttaaaaaactcaggaaaaaatagtcttgggtcataaaattacatttgcatatatggggttttaatttgaagccaggggtttctttgcctttatctctgatcaaagataagcttcac

SEQ ID NO: 123836 - DNA, 1211 bp, Homo sapiens
cttggggagcagagctggttcctcgtaaacccctgtgagtgcccagaccctttggaggaggttctcagtgggcttttgcctgctcccacagatgtaacccacccttcctgctgctcctaagaccaccatgaggaaggctgggaattggctcttgaattaatttgttggtatttttaagaatagctattaaagtactgttgttaattttcccaagtctattttattgttagtatttgtcacattttctttgtaaacagtgaattaaaaatattttataggaatattcattcttatctagatttcctacttatataaaaaaacaagtgaatgagattgttacaaagggtaattttgtgtgagtagaataataaaagttgaaattgagaagatgcaatgttttagactgaaactgatggttggtttgttttccccttctttctaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaag

SEQ ID NO: 123837 - DNA, 1101 bp, Homo sapiens
gtgaaactccgtctcaaaaggtaaaaaatgaaaaaaaaaaaaaaaaaaaaaaaaagttgaagttataaaaaacaaaaacgtgaattaaaattgtgaaacttagatccaggtgtcgcattctgatgttgtctaatttcttgggccctatgacaaaaatattttaatacatgtaatataacattttactgtaattattgaaatctgttcatttgtgggtggttttggattttttttttaataggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggttagatttaaaaattgtgatttcatttgggagagatgctctactgtaaagcattcaactagaaataaggaaaactaacagtgttttaagaacatgtaataatttgcaaatcttaacagataacacccagagtcttgtgtaagtaaaaatgttttagaagtcctgatatttcataaaattaagtacacgtaattttataggtacattaacaaacatgttttatttttatttattttttttgagacagatctcactgttgcccaggctggagtgcagtggtgcgatctcggttcactgcaacctccgcctcctgggttcaagtgattctcctgcctcagcctcccaaatagctgggattacaggcacataccaccatgcccagctaatttttgtgtttttagtacagacagggtttcaccatgttggccaggctggtcttgaactcctgacctcaggtatctgcctgcctcggcctcctgaagtgctgggattacaggcatgagccaccatgcccagccaaatgttttacttattaaccctgcttcattctacagagaattaatatcagcttagataattatatgtactaaaataaaaaaaaaattagctatagaacaagagtgaggaaaagaaatacaagcagagactgatttcagagcttgtactgttacctcctctgc

SEQ ID NO: 123838 - DNA, 1020 bp, Homo sapiens
tgtgtatgggaatgttatgttttaacgttttttacaaaatagtattgtctttttaatttattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaacttggggaaaaaagataaaacaatgtcataatctcatcacatttaactgactaatatgaatatttttcaacaaaaagcatttgacttttattattatttgaggcaaaaactaaactgaaaccaaataaaatgttgaatttcagaaaagtgttcttaaaagcagatattaagccctcaatttttattaattttaaaatgagtaagcaaactgtaagatgttaagattattaaattatctctcattaagcatgtatctttcccattttaaaaattcagttactattgatttattaaaaaacaatagaaaagttacatctatttttagagtgactctcaagaaaatttaataag

SEQ ID NO: 123839 - DNA, 1860 bp, Homo sapiens
gacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgtgagtgggccagaaggcgaacatggcggagcggggaggctggcgggaggcgggaggcgggaggcgggaggcagtggcgctggcctgcggcgcgttcggaccggctgtggggcggggcagggcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggtaggcgcgggccggctggcgggagcggacgcgggggacctccggggcctgagggctgatgcgcagccgcccccggcgggtaaggggcgggcagggcccgaaaggccacacgggcctggtgcggcaccggtctctcgtgagccgctctaccttcccgcctgcggggaacacttccgccgcttcgaggccattttatctctgtcctccgtccccaaggcccgggttgagaggggtgctctggcggccggagagaccggccactcacggaggccggaggatgccctccccgggctgagcggcggcgctcgttttttcctcgcctcggggtcgcccccttcacctcccttgggcctctcctgaggacctggcggcactaacgagttcagcaaggaaaaaaagaaacattcgttccctacatttcatgtcacgcagtaggatgttactacgttctcttgtagacttccatttttaaatgagtataagcattctgaggaaagaaactgaattattgcagatttttgtgaaatccaagtcttaccttggatccctgtgagacagttactagatttttttttcaccgtttttcataagtctgtgtacacgtaatggaaaagcccgagttcttgttttgataagaaagtcacttggttgtttgatcccaaaggattagcttaacattatcaaggactagcataactgtgattatgtaaaaaaaacaaaacaaaacaaaaaaactattatttagtctggtagggaaatacttctatgagtatgttacaattggaagttgtatttgtgcctattttatctagttttagttaattccattgcttcggaagataagtggacgtcatagatccatcgcaagttctcgttttttggattttaaaattttgaccattaagttttctacgatagataaacatgttgtggacatttaaaaccgtaatttaaaactatgagcgaaaaatcttttcaagatggatacattttaattcattcaagtagcatctgattagccaagtcggggaaagattgcagtccgcaaagctggcttgtgataaggttgaggttacattttaagggtttgggtaggtgtgtttcttacagtgcttttatatgttaaggtatcttaagcagacacatggtttaaaagttcagtatttttagtactttttcattggcagaatttggacaagctaccagaattgctaactcctaaaggataaaagtaata

SEQ ID NO: 123840 - DNA, 1073 bp, Homo sapiens
agtaatctaagatcaatttatgatttttcctctaaattctgctttcttcaacacaatttacttaatctgaaaaccagggtttaataacagtatgattagaatgtttcatttataaagtggagttgagattgtacgtagtataaaacatgctgttggaagattatctccttttgaggaatctcaaaatcaagtgggagaaatcaagtagtcttggtgtgtgtgtgttttgtttgtttgttttaatgagagacagggtcttaccacattgcccgggctcggttcaaactcctaggctcaagcagctctcctgcctcagcctcccaaagtgctgggattacaagtgtgagccaccacaccagcctcaagtagctttcgagatgatgccacagcactccagcctggcaacagagtgagactccatctcaaaaaaaaaaaaaaaaattcagtttaacataccaagcttttggtcaaatttctagtagtttagaatttataataagtatgggtaattaaaataaaccataaacactttaaagtaagggaagattcatgagtatactattagaaataataactagggctgggcgtgatccttccacaggtagttctagctacttgggaggctgagatgagagtatgacttgagcccaagagttcaagactagcctgggcactatggtgggtccccatctcttaagaaagaaagaataggaaaaactaaattagtataagaactaattacttaatttgtataagttatgaatatgccaaatgcaatttagatgctttttcaaaagagcactggtactcagaaccctgattcaattttttaatcctcatagaatttttatataaagattttatgtttgtcaggttagctcttcatgtcgtatacttttttttccaaccttgtattttaatgtggtgtttatgtttattacacattttttctttgtcttttttttgtgtgtggatttgtagtttaatgaataatacctgctattagcattcgttctaaaaaacagcataataaagtgttccctacttgaattcattaacctatctttgaaaca

SEQ ID NO: 123841 - DNA, 1079 bp, Homo sapiens
tggcgacatcaaatgatttgaatggctgatcagcttttttacgagggaatttgtaaaaactacccaataactctaatgatggaagatgttaacaaaggaagatctgggtacagagtatataggaactctgtaatatctttgccacttttttgtaaatctaaaactattttaaaattgtttatttaaattctaattattcaacagtaatttagttcactaataaattgatttgaaagagtcagtattttttattcctactttcactggaagaaaataaattgaacttgttttccgcaacttttttttttaggattcaagatgaccaacgaagaacctcttcccaagaaggtatgggttttggttttgggtttttttgttttgttttgggttttttgggggcttttttaagcactttaaaaaaaaatagacttgaagggattatcgttgtttgcttatttttcatttctttgcctttataacaataatagcattggagttgtacagtgtgccagatattgtatcttatatccagtatattttttagaatattttcagattttggaaaactttagttataataatattcccatggtctactcttaatgttcattatgtgaatatttccaggtctactcttaatgttcattatgtaaatatttccaggtacatatatacaaataatgtcaaaaatggacattatgagtatattattattcttttcctagtgtaaatccctttgattgtaattaaaaactactttattaaaaaaatggttatagctaattttcaaattctacctttttctctgaagttttgttgtctagtctcaaatctccccctgttgtgcattcctaccttgagtttaattactcttacatacacacacatacacacacacagtggctgttataaaagaggtaacatcgtctctaggaggaatttgtgattcaattgggaaagcttactaaacttaatatttaagtgaataatttagatattacagaagtttcctattgtggagtcagattactcattaaatgaataaaggattgtattatgctttcataatctgagaatta

SEQ ID NO: 123842 - DNA, 1137 bp, Homo sapiens
tttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcaggtgagagtgaaaaaagatgaggtcagcctggaatcttgggtattctagaagagaggggactactgaagaattcttcagcaagagatgtatgtgatggatcagatttagatttacattttaggtagatcactctgacttgagtatgaaagatagatttgagaggaacaggactttaagcaggaaaaccaattgtgaggctgttaaaatagttcagatgaaatacatgaagccactggtggtagcagacaggacagaataggtgttttggaggcacaatcaataggacttgtttagtttggatgctgttgtggaaggaatgaaaaaaatctagggaggaatcacagcttcaggtttgtcttgtttgactgagtaacgatgctactaggatagatcctacaaagatcaaattttaaaagaagagtagagtgtggtgttaggaaaacaggaaatccagcattccctcctccttccccaaaatacaaagtgattaaaacaaaggcatacataaagttctgtacaatacgaatttaaaattgttcgttagatttggcagttaagaggttgttggccaaggaagccaaaagattggatacccctgctctagaggaactgtcaagtgggaagtgagagaaactaaatttaaagagtagaaagaatgggagtgatgtactataggagtttggagggaataggttaagcgaatggttgaaaggattggccctgagaaggagggtttcttaccctcttgagtgaaaaatagtggaaaggtttgtattaggtacctgtcctttaaaacagagctgctgcatttacccttggtgtttcaaattaagctaagcttagaaaaaataaaatatacatccttaggaatctatttgtgtagatcttttgtttgtccagcatactaactcatccatttgatcttttaa

SEQ ID NO: 123843 - DNA, 2210 bp, Homo sapiens
taaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaatagttggtttttttttttttttaagttcaaagaatattatgatgattttgttgtactctttaacattttaatttggggcggggagggcctgttgagagcagattcattttggaaatactgttgctgtgctcttcaaagtgaaggaaaaggcgctgtgcctcatttttaaaagacctacataaaagacaaggagacttgacacttgttacttttatgacactttgtcccagggtattgcagtagaaagtaatgtgggacagcttcacagggtgtctgccagaagataatgtgttggaactgtgggctggcctaagtaagacattttgtgaattgaaaaaaggtatagtgatcatttctagcaaattcatttaatcatttagataaatgaggcattattttcttcatgcttccatccaatcctggaggtgaattttttccgtcagatcattctataagtcaccaattcaaattttcgcttggtgataatggagtctaagatgagtggaagataaatgttccagcttgtcccaacgtttaagtgcagttttaacaagggtgacttaagttctctcttaatcattcaaatcaattgtaagtatcatatgtttgtgctttagggaactgattgtggggcagagggtgggttgaagaagtggtttgtgtgacttttcagcaagaaatctgcttctaaaattctcactatttgtgagggttggagggtaagtaaccagatctgtttgaaattagcttatgtgcttgcattaaggcttttgtaaatattttatgccatttaagttcacagtagaaatggcctaagtatctttttagtagattttagtagaagagtaatccataaaatgtattattaacatgtactcaaattgagcaggcatctttctttgacacttagataacagtcatgagttctatggtttttttcttgtcattgttaaaattttctcttttaataagataatacatgcttatgtataaaattgaaatactgtagagaaagggggagatgaaaagtgagtgtcactcccggatgtgaccttgacatcctcattctcttctccaagagcagtaactgctattactttttcttgggtatcatcaagataatttctatgcatatacagttattttatgtatattgtttta

SEQ ID NO: 123844 - DNA, 2003 bp, Homo sapiens
tttagagtgtttagaggtatatctttcaaagtgctttctattatgtttgtgggttaatcgattttaggaatgggttgatttttttgtttgtaattttaaaaaattatttcaaaaacaactacttgtaattaaattattttttcaaaactgtgattttgttaaaatttattttactaatcactagttttaaacgtgatatgactatcttagcttagacatttatttattaaaaggtatgactttttaaacgaaaccttttttgcattagaatttgtgacatttttatatggggttaagtcaggtcacagattaatgtatcttacagttgtctttttctactctttaaaattcatatagtaagaaggttagttgtaaacaccaatgaaatatatatactttgcaagaagacagttttgagagcataggcagtaaagtggaaggaattccattgtttttgacaatcttgcatatctctcattttcccattgtttaatttctaagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaaaatgctgtaggtgaaagaaccatgcaacacttcaaagattgataaaatatttacaaaatgctctcatttttaaacttataaggcatactgaagtagtgtatcaggcaagtgaaagcctcactagaagaaggaaagactagaatttaaaaaatgttttaacccataaggtcatcctggacttaccccaaggacaagaatgtcacactgtctttatccaagtctcaaaggtaaatatcacaattatttacttagatccctttaaaagtgatcatttctttttttttcttttttcataaataattacaagaacaagcaaataatttctccttttattgctgaggctaaagaaaagcagtaaaattttattgggaaacatttgagcttttcattacatatttgcaattgctatgtatgtgcacataggttcagtagtatgttgcactagcatttggaaactataatctgtggaaagtgtgacactcctagattggcagatatttgcgtgtttgaattgtgatacgtgaccactggtcttatttttgtgtcaaaaggatgatcttttccaataaagtcttaagtctttaaaaaaaaaaccttaactgctgaatgtgcctcaattaatataatagataatattcttgagagttatggaagatggatgtaccagaaaacttccctctctcctcctcttttttgagacagggtccctgtttccgaagctggaatgcagtggcatggtcacagcgtcaaccacttgggcttaagcagtcctctcacctcagcctttccagaggctggcactacaagcatgtgtgcctggctactttttaaaaaattttttgtagagttggagtctatgttgcccatgctggaggacttcctgttaaggaaaatccttattaaatgtttttctagcaagaataaatactctcattcatttttattt

SEQ ID NO: 123845 - DNA, 1834 bp, Homo sapiens
gtagtgtgattttagaattgtatttgtttacttgagcgtttattgactcccttgctttgtggcaggcactaaagaaacatttttcaatgttataaacgatattaaagttggtctgactctcctttgcacagaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttaattgagacagggtcttgctttgtcacttaggctcaagtgcagtggtgcagtcatggctcactgcagcctcaaagtcctcgactcaagtgatcctcccacttcaggcttccgagt

SEQ ID NO: 123846 - DNA, 1029 bp, Homo sapiens
gaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatctt

SEQ ID NO: 123847 - DNA, 3494 bp, Homo sapiens
ttacaggcgtgagccactgcacttggcctggactcatcttcattgtccacctcctaggctaaatttatgtcttttatgtgcttgtaatctctgcataccactttagtgacacttgccctggagtgtgattggtaatccctctccccactagatccttgaaggcaggacctgtgttccctgtttaaccatagttctcaattagtaattcaaatttgggttggggagagctaagtggtaatttttaattccttcaaattttccatgaattggactaatttaaattctggtcagagataacaaaggataatacaatttgatctatgattatcttgtgataaatacttaatggaagttaaattatttttaaaaatcacagaaggtaactcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcatccctgcctatcttacctcgttccttttatgccaagtaagccaatgtctttttttttttttttttttttttttaaaccttgggaagtaatgaactcagtcctagtaactagtatttctttaactattacccacatggccaacacctagaagatactatcttaaaattggattgtgaaattcactggtaagctctcagggttacttgtgcatctttaccttctctgggtttaatccaagttctttaactattgcagcagagacagctgcaaaggcttcattgatttcaaatatgtcaacatcttccagtgaccaacctgcttttgtaacctagaggaaagattcatagaaaagaggtctaaacttgggtggaaaggctaaagttaaaccattctttgtcaacataaatatatgctgcatgatactggtaactgctactttggtttgttcttaggttaatacagtgacattctca

SEQ ID NO: 123848 - DNA, 4874 bp, Homo sapiens
tgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaacgaccgactttcagaaagttgaagccataagtgggtcatttgtgctgtgtcagaaataagttacatattctgaatgcccagaagattgagcaagaagaaaaaacaaaagaagttacacatttaagaggggaaataagcttcttaggtacagattcagaaacaaaatttgtaagttgatagttacagctagtttgtacagtttaagtaggaaagaatttgagttcatttgacatagccccattgttttaaatgttggtattcacaagttttgagggcttatttttccttttatggcagtattcagacatcacacagatttttttatggtctctcaaaagtcttgtttcctcccccatcaccccttgagacttggaaagctctcaacttttctgattatttggaggataaaatgttaccaatctgggggagaaacaatgtttttatattattatttttaagagaccatctgtagcacagtctgaagtgctgcagtgctgtcatatctcactgcagcctggaactcctgggttcaagcaatcctcctgccttagcctcccagagtgcttgggattgcaggcatgtgccaccacaagcaactaattaaaaacctcttttttttttttttaagagacagggtctcgctatgttgcccaggctggtcttgaactcctggcctcaagtgatcctcccttctcggcctctgtagtgctgggattacacgcatgagctgcactcagcctgttctattttttaaatcctgacaggtaatctcaggaattcaaaatgggagtgtgagaaattaataaatacatcatgatatgacagtgtgatcttaccgagtcagtaaatgtgatacacagtataaactcttcatagatcatccagcatgctggtatagtagaaacactattgtttggtgagaaagatgttaattctggagaaactagatagtttgtggggaaaatgtatttctagattaaactttagccatgaaagaatggaatctactcctaaaatatgaatatgatctttgtctaacttacgataatgtgatttaacaaatgtagttttccttccataagaagctgacagtctttttgctttaaaaatatttcttagtgttttatcaacttgaagaactatcttttttaaataaaataatagcttaatataggtcatatgaatagtcacactcggtttagcttctgttgagcattttttctaaaggtaatagatgtgttgtcttttacggttgtattgatgaactagtttcttattgctgaactagtttcttagaacatttttctggctcctacccagttttggccatttgcatttataatacaataagacctcactgaacatccacagtggcttcatggaaactgactttaagaggaaagatgatgtataaaaaaacaagttttcctccccccatcagcgttacaataaacaactgtatttgagaaattgctgtccattgttttgcttaaagtggcagtttccaagaatttatgagtaacgtggaggacttggagtgttttgtagcgttcttctcccttcacgcccaggtttctaataaccagttaattcatttcatcactaccattttggttaataatatatggccattttagtgtcattccatatgtattgcacatgttgaatatccggcacactcagaccagtgaatgttttctcaacaggttattattgcagcagaactcctaaaaaatgcagatgaattagtcaaacagaaaattcatcccacatcagttattagtggctatcgacttgcttgcaagtaagattgtttgcattcagagaaattttttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctatgcttatgggatagattaaacttgccatgatctgaagagggagggttttttcatgtcctcctcctatatgaaatggctgaacggatattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgctgctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggtaaggtttgggatttggtttatagaatgagattgctacagattaaaactagcttttcttttggctgggcgcggtggctcatgcctgtaatcccagcactttgggaggctgagtcaggtggatcacgagggcaggagtttgagagcagcctgtccaatatggtgaaacctcatctctactaaaaaatacaaaaattagctgggcatggtggcacctgcctgtagtcccagctacttgggaggctgaggaaggagaatcactggaacctgggaggcggagattgcagtgagccaagatcacaccactgcactccagcctgggctacagagtgagactccgtctcaaaaaaaaaaaaaaataaaaaatgtttttttgtggattatgtgcagtacatctttttgtaatttaaagcacatacaacatggtagaaggaatgtgaattaaaagaaattacgtgcatttaatgccataaaatttttctaagataaaatgcaatgaattagtctaaatttgtgtgtttacatacaatcgattataggtactctttattatgcttttaaggatagacgtattaacttaatcttatgttcaattgtaggcatgcccaagagaatcgtaaatgcaaaaattgcttgccttgacttcagcctgcaaaaaacaaaaatgaagcttggtgtacaggtggtcattacagaccctgaaaaactggaccaaattagacagaggtatgttgagagattatttttggccttttaagtgtgagtgtcttggaggactttaacatttttagccaagtcaaactattttacttccagaaaaattagcctggtggtgtttttagagggatttggggttatacaacctatatgaaaatcggcctttttgtggaattttgattgtatgagtctattaatattaaagatgtaaaagacaggaatctaatttcctcaaagcagtacagaactcagcagtatagtattgactgtaacctactgtttgctagatactggaggtgcaggtgatattagtggttggcatgccagaagagctaatggtggaggtagtgtgaccattgctatagatttgactgcctgacagtcacttaaaacaataaattgtttaggctgggcacagtggctcatgcctgtaatcgcaacactttgagaggctgaggtggcaagaatctgaagcccaggaggttgaggctgcag

SEQ ID NO: 123849 - DNA, 1040 bp, Homo sapiens
cgagatcgtctcagcgatggcgcttcggtcgcggttttgggggttgttctcggtttgcaggaaccctggtaattagtcttgccccccttctcccagctcactcgcctgggcttgcacagtacattggaacgtgcgggttctattttgtattcgacgtgccggatcgaaatagagctcgcggcactgcgaagaccacagtaggaagttaaggacggggtcagtgctgactccaccctgtgggcatacgtatttttcgtcccctcgggcctaaagattgggggtgtaaaagcggatagacgttagagcgggttcgtgcgctgtccatatccgtcatttttaagccctgtgcggtttttcccgttgcccagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggtaattaaatctgcttgtgattgacaagggcagtgcaccctacagactattttcattcattcaactccaggcactctcccaggtagctgccatgcggcgggtagaggcagggttcgcggaggggctggaacaaacaacaaataggtgtgatgggggctatttaaagaggatgttacagtagcggacaggatacctgcctgtctgaggtgacatttaagaaggtgagatctgaaagaggaagaagcctagtcatctgccagaaagagcagtcctagcaaaggaaactgctggggtgaggaactgaagggcttgtggatctgaagctcaatgggcagaggatgaatggcccaagatgaacatggaggggtaaggaggcgacagatgattagctttgtaagtcaagatgagcactttagactttcttttcattatagtgggaaactacgagaggatttaaagcttgagcccgaattggtttttcaaga

SEQ ID NO: 123850 - DNA, 1504 bp, Homo sapiens
tgtatttcctgttcatatattgacatcttgtccatataatattttgaaatgctgctgaaccttgacatctctacatttcctttttacttacatcattattaagatcactttctgaaaaaccgttgtaggctgggaagttagcaagaacaaatcaatttatttctgtcttttggaaggtgaaagtattttcagcctactcgtgctgctgacttaatcttttccttttttttctgattttcaaaaccagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtgggttgttttttaaaataggaaatgtcagtatcaatctaatactatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgataaatgtgagaaaaaacctgtaggcagttaaggtggcttctagagcattgttttccagtttttttaatgtataccccaattaaatgtttgtttagaagtgaaatatgttacttctgccaatttgagtattcaatgtgttattttaaatggaacacatctgtatgaagtatgatttgttctgagaggtcttcagaatcaaatggcttaatagtccccttttgcttaattaatgtcccggagaggcatttaaaagtataattgaagatcggatgcagtgcctcacacctctaatcccaccactttaggaggctgaagcaggtggatcacttgtggccaggaattcgagaccagcctggccaatacggtttaaccctatctctactaaaaacaaaaatgagt

SEQ ID NO: 123851 - DNA, 1062 bp, Homo sapiens
ccgaggactgctattttttgccttcctggcaggtctggacatagagttcacgggccttcgttctaacctgtctgggccccagcagatcaggtaaaactaaagctgtgtcccctctgtataagagcctggccagaccagcactgtttctggccagcagcctgttggcatttggggggcaggacgttttgtgtggcttgctcctacgtgttggaggaccttgcttttttctgtccactaaatgatggtagtgctccctagttgttgtaacaaggaaaaaatcctccccggttgcgagtggtggtcctgccgcggaggccatagtgccgggatgggatgtcattgctcgtggaatgagatgcctgtttgttcacagtctttttgatttgccatcggagtggtatctaaagacccgtcagagtgttcagcaatttacagtctgtcagattggtgagtttaatatcagctgttagagtttttcaagaaggtatttttattgtccttggatttcctactgtaaaaacagctctgagatttttcaaggatattgagtatcgttttgtatgcttgttttgtgttgggccattgtatacatatggaaatcaacacttcggagcaaaccaaatttagcagcattgtttccgtgcttaaataagtcagtattaaggaacactcactgttactctttcaagtaaaactgtgtgtgtgcgatttttattttattttttgagacagggtcttgctctgtcaccaagactggagtgcagtagcatagtcttagctcactgcagcctagacttcctgggctcaagtgatactagcacgtcagcctcctgagtaaactgggactacaggctcaccaccacacctagctaatttttaaattttttgttcagatgggttttcgtcatgttggccaggctgttcttgacttcctgggctcgagcaatctttctgcctctgcctctcaaagtgatggaattataagcgtgagcaaccacacctggcctgtgatttttttttcttaagaaaatttacacacaaaaataattttttttaaggtca

SEQ ID NO: 123852 - DNA, 1119 bp, Homo sapiens
agtgatccacctgcctaggtctcccaaagtgttgggattacaggcataagccaccgcacctggcctgaagtcttttttttttttaactttgcatatggttttctttgaggggggaggaatagacattttaaatgagttaaatatataaatcttaatggtttttggtattttctgtggatagttttaaaactatgagaatgtcattttaatatttacttctgtatttgaagaacaggccacaattagattttagcaaattcagtgtgaattacaatttgacatttctcatgcttccagtctgtcttttcttttttgtcattaaagatgttatcctgttgtacagcccacatagtatctgtgggcgcaaagtactgtttgagttgtttttgtctttgtagtgaaattcaggttgcttttccttggcattcattccctctacggtcattcttccaggattgtctgtgttttccgctattgaaggagaggcaaacaagtatgtatcaagagcttctgcaaacataggtgcttcccacctatgttccacagctgccaccttcaaattctgcctcaggtgccccgatcacttttgccctggatcttccgtattctctcctgtgtctgttcctccactcactctgccctctgcggattccagcttgtctttgatgtctctctggaagcagtacctttcccgccagccttgctctgtaccttaagtgctcctttccccatttccattgtctccagtgtgcacctatattaataaaagcgcctgacacagtgtggtgtaatgaaagtgatgtttaaactacctgacacagtaggcagaaaggatgccccaactatcaggatgcctccccaccccccatgagcagttgagggtgccagcctgcacgccctaacctggcatccctgggcagcttgtggaggggctgtctctgtggtatacgctggccctgaaggcaggctctctgcctttttcatttagcacccccagtgccaatcatagctcctgaaacacagcagacactcgggcacactcagattcttcttgcctaaaagaaagagcccaccctgaagccagccctgggagccagagttttttaaatggttgtggct

SEQ ID NO: 123853 - DNA, 1513 bp, Homo sapiens
aagcttggcaaaatcagaaatgcatgaagtcagaagtcacctttaatcagctagtatcctgaatttttacatatttgattacactatttgatttttgtttggctttttttccacttacccaaagcattattttatgttgttaaaaacctaataaatgctgcttcagtgtcatgtgacactgtcttctggctgtcccctactgtttcatggttgattccattattggacattcagtggtgcagcctagtgggtaaagtggggcctcgagccttggtgatctcatccatcccacactcactacgtgcgtagtctccagcgagttgacattaccttaattgtaagattgggataatagtgccaatatcagagttgtgagattaaatgaattaataaacgtacaaagaacactagtctagattacgaggggtaagaaagttttaggagccatttccccaagaaacaatgaaacacctgagtttgggcatattgagagagttggagaattagcagtgaaattaataatacacattcaccaaaaaactaagtacaacaaaataagcgctgggagaacaaaagctgtgcaagaaaggagaagtcattgtagccaccacagagccttttgtgaatgacgcgcgtggggcgatacgggcatgtgtgtggaggtggaatgagaggggtcatcaccctctcagccggtgggaggtcgggagtgaggtgtctaacaccacaccatgcatgtgcgagagagatgggaataaataccaaaaggaaaagaactgcgagtggttgcctttggggagtaggaaatgggagagtagcgggaagagatcacagggttttgtttttagtgtgtgtgttttgcaataaacctctttaggtgcaggtataactgataactttaccaactgagttcttgcataaattttcttttatcaggacactttactagttataatttttgattttttttcttggatttttctctgagcaattatttacaaatgatatcatgtctgcctttctgataatacttctatttttaagtcttatcccatcggctagagcttcgcaaactacattaactacggttggcaatagaatgcatcctgaatttaatagaaaaccgttcggcctttactattaaaagtggtgatggcagcttgatctgagtttagaaatccttagtggctaggattaatggtgttttcaattcctgttttgtttcagtttgctttattaatcagtgccagtggcaagctaggttcaagaatgttccttcccatttttgccaacaaacaaattcactcttgactacctgggtttttcccctcagaaagctacgatcaatttaagcagaatatccacagcctatttcctgttctcattgataccaagagtgtaacaaaggatatctggaaggtaatgaatagaactgctttgggttaagaactgctttttccataccagtaacacttagctttctcttgtggggtttttttcttgtgtttttttg

SEQ ID NO: 123854 - DNA, 1039 bp, Homo sapiens
agtgaattatccagcaaggatgccgcacagatgggagtggggtctgtggtctgtctttgcccagaggctgttattatttgtagttggtgtatttccagctactatgaacttttaggatttagtaaccaggcattgccccaaagccctctaggccttagaatgcctgtatgctccatgtatgtccctggcctttgtcctcgtgccttgctttcctgtgtttatgggtaatctgttgaacacattttctaagggagatagtgtgtgtagagtttttttctagcctaggtttttgagagtccttctaggaaacccaggaatactgcgtaccctgacatcctaactaaggaataaggatggttgcaccatttgaagagaaagaggaggttgtaggagtgagcattttccaggccattttaatgaccatttggtactgcctgaaacagagaataaacaaaagcgcaaatgttttcctctggtttgttttccatgattgtaggagatgaatttcccgagggtgtcgaatctttcggaagtctatgaagtcctgaacaggtgaggacggcgattcctggagctactgctggagcggccttggtggcctccctgtgctccgcaggcctttgggctctctaggcgtgcccaccattcacagtgatgcctgcttgggacttggtctcctccagctcctcctgcttcatggcccccttcctccgatgaccctcttgcctccgtttccaaagagagagaagccagagacaggaaatctctcaacccctgcccctcaaacagttgcgcgattactgtcccctttttcattgtctcgcccctgtcaccagcaaatggagcaccttccctgtgcaaggccaggcaggaggagctgccacctactcgtcaccttcacccctgctcagcaactccccacccctacctgccccttcccggggtgtctccacctctttctgtctccctctcatttccttccacatcaacaagtgttctcccaacttaacgacaaagcctcctgaactctctatgctcc

SEQ ID NO: 123855 - DNA, 2078 bp, Homo sapiens
acaggagtagcccttcctaccacccctgtgcctgcctgtatgggtcctggccccctcatccccgcagatgtcaggaggccaaggcagtggggttaggcttaggttctgacacctgtctcagtccttcccagcctggtgtgtgcttgattgtctctcacttgctttcttatagccatgtaagcaacagtgaggtatgaggagaaagtgttcaggtcaatgaatgacatatcctttgttgggggcacataggctagggagagattagtggaaccccacattggaatcttcagtgcatttccccatggcaacaccatctttgatgcctgcagccctgggcacgtaggcaccagaaacacattagcagcgtgcacgctacagcaccgtccttggcatgcacgttagttaagtaggacttagccagccaggtgaaggagcccatcaaaattctaatgtgtgctttgggattgatgtagaaatatctttttggactatgatctattaacttgggtactgcctatatttgtccattttagcagtggatgttataaatacaaaagttctgtgacacacggatgggaagcttatttcttaaatgtgccagcctaaccccctctcttgtggtttgactgttaaagggccccctggtaagtacgtgtgtgctggacagtgaaggagctagcagtggtggggcacctcagtgcctggtgtcacacatcttttatttcttttaatcctcatggcctaaaagccctccctgcctgtctgtgtggcccgtggttttgccggggccctgcgctcaggtgtgtgtgctccctggacagagggggcactggcagtgggaggaggctgtgggatgagggatgcccttttggaatcaaaggtgatgtcttaccaaggggggacagcatggggctttctctgaatagtggcctcgcactgattctctgagcctattgctgtttgtcaccagtgggaccctcaccaaaccatcaccagcagatggtgactgtctggaagctcttcttctatgtggccacggagaatgcttttagacttgccagctggggaagcacccaaccagagccccaagacttgtgagggcaggagggagggagagccgtccgagggagtgtccttctgttctgtcaccggattcttggctgtggccgaggaagtggatgaacttctgtgcgcccgacagctttggggttttctgtccttgcagcatcgaccccgtgcccgagtcatcctttcctcagtaccttgacgtgctggctccttacgtgaaccaagtgaacctcatccgagcgggggtcccaaagatcgtgagtagatctcatttggccccctcgccccattcagagttcagaggctttgctgggaagcggccagtgctctctgggactcgtgagagggatttcggtggtcggtgagatgagagctgggtttttctttcctctcatgtttctccactaaagccaacatggactcatccttccttctcttcccctccctgccccaagcagagcctttcctagtttcttttgagatcttcagactggataagaagtcaggaagaactgtggaaaatctcttgtgttctgcatgttttctagaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggagtaggtgcctctaagtccgcgtcccccacccctcgtgcgttcatccctgtatctctctgactccacccgcctgatcacagcaggcggcgccatcctgctgcctggctgaccacagcaaacttgttttggcagtgcgcggaacatcctgaaggagtaccgggaccacccgaccctgtgcatctccctgtaccgctactggaggcactccccaaacgtcaactgcctgctccagtaagtgacaggctgaggccacctgcctgtcctggggtcctggagtgcccggggt

SEQ ID NO: 123856 - DNA, 1135 bp, Homo sapiens
ttatgtttcttttctggaaaatagcaattggtaaagttcggttcgaggaatgtgggcctggaatcaaaaataggtcttctgtgactttccaacttctgcttctgagtaaatcattgcatactgggtattactagtcctcataagtaatattccgcagtatcaagaaaggtataaataaggatttgtgattacttatgaaaatcgaaaagtgtctaaaaccttgtaaagttacagcactcatagtctttttctctttctcttattttctcttcttggggaggtttagtaggatcagtagtatttgtttttctatttcttttttatctttccatgatgacccagttctgtggtgatttaaaatttgaaacaaataaatcagttaatccaatattatatttcataacttgtgttgcttgcaactatgttgtatgtacagcctaccagagatggatgatgaattgcagctctaacttgaaagtccccactttggactgtgtcttggattgagagattgacaatcaactctccccacaacgctgtaaggtattattcccttaatttcacacataaacaaattgaggttccaagcagctaagcaacttgcctaaggttatagaacaaggaagtagaggggcctggactgagatccaggtccgcaagacatcaaaggcctttacagagaggaccactcagtgtggaaacaatgggaagtgtgtatctgtcaggagtttgtgcttatccagtgctaatggccgcggcattgagttcaagggtgggacatgccactcttggggaggtatgcagggccctggggaggtacacattggaccatgagtgagcaaagagacagcaagccgtctgccagggagaggggtgaactcaagctaggatcagcaacctggaaatgtcacagctgcttttgcacccggggaagtcataatgggctccagttcacacgtttgattaatgacagaactgggacccaggggaatcctagtttctgatgccaattccattctttcccataaaccaactatctttccttcaagcccagcacaaaactgtccttctccaagacacctggcttgccccacttaggccctagggactgctattccaaatgccagggatacac

SEQ ID NO: 123857 - DNA, 1057 bp, Homo sapiens
ccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggataacgttagccccgcaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcttgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaagaggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctctttccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaat

SEQ ID NO: 123858 - DNA, 1040 bp, Homo sapiens
tactactggcctgcaattaataaagcaagataaaggcaggatgggatcagtaataataaaagtaggcacgtgtgaatctgtaatttggtttccttaaaagacagaaacccagttggtgacacataagtgaaattcacataacaagatacatggtcactagctagagaaatgtttctctgagtctacagcaagcaacaaatctaacatgttggagacaaagagaatgtgaagtgtttccaacctgaacatccaaaaaagattctcctactttcgacatgcacgcaagtcctctaacagagtattcaagaaatcacctggctcactactgtccctcaacagtatcagacagtgtttcagctcatacatatccagcacagtcaccttcagaaatccagaccagtctccttaactaaggagaaagggaaaaaacagcaaggaagaggagcaaggaggcagggttcccacactggaccttgggagcagaatgtcaagagcctaaggtaaccactgtcgtcaacaacttgctgttgcctacactaaaagagaaacaatctgatttgcatgaagactcctaccccgagctgaaggctggggaagcacgtgagtttgacacagcatggccagagcttatataggaagtacttcacttcctattctaacaaacccacaaagctgtggacaaagatacagggccgacaaatacaaataaatagaagcagggaaatgccaaacgtcagcctttggttttccctgagaggtatgcagggtctggaaggaagcccggtgtatggagagggatccggctggaagccctaagtcaaacacgacatctaagttgatgtcagagcccagggaaccagggcaggcaatggggactgcgtaacagaggtcacctggaatagagagggggcacgctaccctaagaaaggtgccatgaagggcctgggccagattcctgccccagcgctgactaacaagctgtgtgagccagtctctcccagctcaacttcctcgacaaaactcagctagcctacaaggtc

SEQ ID NO: 123859 - DNA, 1036 bp, Homo sapiens
aggctgaggcatgcagatcacgaggtcaggagatcaagatcagcctgaccagtatggtgaaactccgtctctactaaaaatacaaaaattagccgggcgtggtggtgcacgcctatagtcccagctactagggaggctgaggcaggagtatcgcttgaacctgggaggtagaggttgcagtgagctgagattgtgccactgcactccagcctgggcaacacagcgagactctgtctcaaaaagaaaaaacgaatatgcctagcccctagtatcaacaggagctcagaaacagtcatgtggtttaaataatctctctgaaaatttatgaagaatattccaaaaactattatgtactctggtatgcaccctggttaaactatcactagatatgtttccactaaagtaaatattttttaaagactatttcataataaacttgaaaatcgtataaataactgacaacaagttttaagaaatcacatgtttgaaactaaaggattctaaatttcttttcagattaaaggccaagcccctagaatggcctaagctaaaatcattcttaaaattaacttgatattaaagtttaaaagcaccatgatcacattatagaactagaaaatggtttcagaagcaataaaattattacagactaaataaaatgtaatgatatctttgaggaataataaattttttgtctgaaagtttgtctgttagaaaattctctacctgaagtgaacatgtacagccagaattaggaaactattccaaacagtatggttcatttaacagccaagcaaatgaaaccattcagctgagattcccagaaaaagcctacattctagactaagttatctgagcttacacaagtaaagacttaagaaaaaagccaacagaaaaaaaaaaaaagagatcaatatattcaatcaaagagaaaactaagctgtaacagtaagatgttaaatgttagcaacaaacaagcttctggaagaaagtatctgcaagctgtgtggaaacaccgtcttcactcaaacacaca

SEQ ID NO: 123860 - DNA, 1087 bp, Homo sapiens
ctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatgatttggctgtgtctccacccaaatctcagcttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaac

SEQ ID NO: 123861 - DNA, 1050 bp, Homo sapiens
cagaaacactgtctgggaactacagccaaagctggaaggtacaaaggaatgggagtcgggggagcactaaaaggaaatgtgggctgggggagaatgtaaaaacagggtttaagaaaagtgtgggtgagaagggagagccatctaggagacagctttcaatatcaaatacacatctacataattcttcataacagctgtctgtatagtatccactagacagaaccaacctagttttagctcatactagacattcaaaccgttagcatttttaactactaacaaatgtgtattatgtattataaacacttatgatttctaaacattcaaaatttttgtatcgctatatacgtatagctatacacagtcatttttgcaaaattggggaatcatattgccaatccagtaatttcaggtagttctacttacccactgaatgataagtgcgtgtcttcaagtcgtgcatacaaacagcacttgatggcccgcactggacaatatccacacttccacagatgttgattttataaagtacattatttttggtatcaacagcttcccatgtataactggaaaggaagaaaaacaacttgtcaatgtcactgatttatcaaaaattaaacttctctctagttttattcaagccacatttgcttaaaactgccacaaactagaaaatacactttccttagccaaaaacactaaaaagtcaagtatgttaagttgcaaagaagccagggcagaaactactaacaccatctgtctgtggttcaatccattctgaagctacctcaggactcaaagattatcaaaatagaagtatctggctgggcatggtggctcacgtctgtaatcccagcactttgggaggccgaggtgggtggatcacgaggtcaggcgttcaagaccagcctggccaacataatgaaaccccatctctactaaaaatacaaaaattagctgggcgtggtggcacacgcctataattacagctacctaggagggtgaggcaggagaactgcttcaacctgggagacggaggttgcagtgagc

SEQ ID NO: 123862 - DNA, 1073 bp, Homo sapiens
gcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatacttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacattgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtaagtagaactacctgaaattactggattggcaatatgattccccaattttgcaaaaatgactgtgtatagctatacgtatatagcgatacaaaaattttgaatgtttagaaatcataagtgtttataatacataatacacatttgttagtagttaaaaatgctaacggtttgaatgtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatggtcactggagttaggcttacattaaaggttaaataaatagtc

SEQ ID NO: 123863 - DNA, 1105 bp, Homo sapiens
ctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtggagagggaaaacctggtgatgtaaagtgagaggagatgattgcacaacagtcctcatgtaagagagaagagataccgaaaagaacgcagaggagccaagacgtttattgacctttgcctgagttcgttattaggggacaccatagcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactccgatccggacacttctctattcatcaatgtttgtagagacataggtatgaatctttgtggggctgagggggtggtggtgagggatttcttctatggcttcaatatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctgggtgaaaaagaaaaagggatgatcaaggacttgggtacttggtcgggatgcatatttggcccaagctgacttgttcctttctctgtacttgccaaaactggtgtgagaagctttagcttaagctttagaatctttgataaattaactaaaga

SEQ ID NO: 123864 - DNA, 1079 bp, Homo sapiens
acaccttgttgtgcttgctctagtctggagctcgtggcatgtctgggtggttgtagggagcatgtgcaattataatggcactctgtccaaagaaaaaacttgagcgtaacctgaggggaaaagtgtttggaattttctatgtgtgtgtctgtattagtttgctcaggctgccataagaaaatacgataggctgggtagcttaaaccacagaaatgtatttcctacacagtctaaaggctgcatgtctgaagaaggcgtcaccggggctggtttgttctgaggcctctctccttggctcgttagatggccgttttctttctgtgtcttcacgtggccttccctctgcgggggtctgtgtccgaatctcctcttctgataaggacaccagtgattttttggattaaggcccactcacatgatctcctttttccttgttcacctctttaaaggccctgtctccaaatatagtcacatgctgagctatggcttaggccttcaacatacaaattttgaggggaaacagttcagtccataacagagtctttaagtgacacattggtaattcttaatatgaatgagtttgtgtgacgatttagtaacatgtgggacactgagcaagtgtgagcttctcttgtgggaaaaggcaggtcatctgtgatcagctattctctagcaggcagccaggggcactgggccctttccacactgagtgcagtaaaccctggtggtgggggccatgttggatggtggtttgggtggtggaagagaaccccagttcagtaactgctgtaactgctgggcaggtgctgtggggttaagacaaaacaaaacttttggctggcacttagaatttgttgtataaagaggaaatgattgactagccttgtgggcaaaaatgcacctggcctgcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgttt

SEQ ID NO: 123865 - DNA, 1050 bp, Homo sapiens
ggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagtgagaacaagagaagtcttcatgctcacagcaaaaccttcggcactttcttccagccagttactactttgaagcgagaggatgtcaagtccatacatttggaactcatttcctgtagatatttttccctagctggctagagagcttgctgttttagatccgtagtgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaatgagtatcaagataatcctttttgcaaagtggtgaccctatggtagagtttggatctggggattgcagaatgtcactgggtgcattgaagctgaaggcgtgca

SEQ ID NO: 123866 - DNA, 1139 bp, Homo sapiens
gatgagtcccagagaacttgtcttgttcacagtcgcatcactaagtcagcagtgcacagggaactagagctccatttctgtcctcctttctgtgagtccccagtgtcacccagagatgttcaggagcctctgggagctgaccacagcccgggagcagaggatcccactcactgctcttgcgttcctcctgcctgcccttttaatcttatctttggagatgctgtacacagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacatgctcatggaacattttcccatgagtacttttggaaatgcggttactattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataaga

SEQ ID NO: 123867 - DNA, 1115 bp, Homo sapiens
accttgcttgtcttctgtggtagcatgcattgcatcctgcactcagtctgcagatgtgtaagaggttgctggtttcttttagcttcacaggccttcacaggggccgagcggggtgtattagcaatggtgttaagcggggtgtactagcaatgatgtaccactctactgcgtcccaagacacaggctggcttcttgatttgggttttcagtttctaatttcatactgtggggcttgggagaattttgccgttcagttctctgtcccccagttgggcctactcttctgaagaagtattgggatgtagtttgtttctgtcacattaaatgagaaacctgagaatctcggtgaatttttgtgctttcagtctgcccgggttccagaaacagcgctggggattgagtgacgaagtggtttgggaactttgagcccttgacttttggcttaatcactatttattctgtgactcagagaaatcagcattgcttttggctaaaatacacttttgttttgttacagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtgggtgagttgtgcctggatggaagatctaggtgatgcttttctagggcatccagtttggaatgagttagaagatctttctgtggttcatctaagcctcctctttctataatcacatgaaggatggtaaaaatttttcattcataactcaaatgtcagtaattgcttgatgcactctggaatcctgaagttggctagagctccctgacatgggctaaagccataactgggaacagaaggaaccacgtggaaaatactacatcatctttttagtttgtaacctgaagaataacattgccagtgtttgtgtacaagtgattttattttattttttaacaactttattgcctagaatcgttcaaaagttatggcttgagtgaagtgtaatctcagctgtagccctagtgtaagaggggcttgcatgcttcgcttccttttgctgtcattgttttggtcccgta

SEQ ID NO: 123868 - DNA, 1527 bp, Homo sapiens
tcctgcttgggttgctaaacaggtttcgttaatttctgctttggatatgagacacattctcaccctttggctgtgtggctgtgctttcaaaagactttgtgtcttggggtagctgaagccctgacagtaggggacaatgtcagtttacagttggtgctgatgcatgttgcaagccatttggtctttcttgccctggaagggcattgtgcatccttcatggcgctttctggctgaacctatggatgaccctggaggaccccaatgtggctgttaatgtctagccaaacgtggcactctagggaaacccatccgctgccttggtgggttcagggggctggagaagggctgcacgtgctgggtttgggctgatttctttctttctttctctttctttcttttttttttaagtcacttctttgtctgcgtgatgatcatttttaaccacatcttctgttttctccccctttctcttccagataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtaaaaattttaaaaaagatgaaatcttttctggcttctgccagaggtcctgcattcttcatatctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcgctgtatcctcttcctcgggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttaccaagtcaaaatttttatggtaacaaatcttaatgtttctcaaagtgtagtattttgtaaatacttttctatgtttcacagttccattaataatttttaggaacttccttgttgacatggtgtggttttactatttttgaacattttccttattgttggattaatagcgcgtttccagtgttgctaattgtgctattatgtatcctctctctacctcccattgaaatatttcctttggataagttcccagctgtgggataaagtcagaagctagggtcattttgtttgtttgttttatatggtaaaatatacaacataacgtaaaatgtaccatcctaactgcttttaagtgtgtagcttggtgacattgttgtgtaataccaccaccatccatctccagaactttttgatcctcccagactgaaactcagttcccattaaacacgagctctccattccctctcttctactttttgtctctacggatttgactgt

SEQ ID NO: 123869 - DNA, 1046 bp, Homo sapiens
aggtgtgttctcacttaatgtcattgctttatgacaagcatttaaatactgatgagacctggtctgaaaactgaaggatgttaggagtttaatttcccagagaaaggagcaggcccatccttgggaaagaagggtggattgaggttatgcctcactattgcgcattttgtgcttctcagtgcctagatatctctgtgcgtatttctgcattctgcgtaactgcagttcaaatgaagtgagttgtctaaaccagcggtgccaagaggagatttgggtcccagtgttcctgctgccgttggagaccttgtgtgggttcctgtggtctgcagcccgggcctggttctggtgactcctcacgtcgctcacgggccctcccttcagtgtggcagccttggagtgcttctgcccctcaggtctttgctgagagaaacgtgtgtttatttcagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggtaggaatgtttgttcctcatcgcgctccctgaggatactcatgcctgtggtgggcctttcatttaagcagagcttgtatcagtctgggtttccagccaaatcatcaccgtcattagatttgccagggtgcctgggcagtattagtattttaagctgtttatttagtgggttgtgcaccttaataacagcccacaagcctgtcagttttgggtacaaaacatacaaaagcataaaaaaaaatcctgaattaacccccacttagcagaggctaaattttcatcctgatttgttactggacagtcttctttttaataaaatgaagggagatgggcagactaagcttttcttcacagtttctcattgggaacattgctctcgtccttttttgaatcctggttttatgtcacgtgtctttctcttt

SEQ ID NO: 123870 - DNA, 1072 bp, Homo sapiens
tgcaagtgttgctggtgagcgtgtgactgagctgatgatggggagtgatgctggctgtggggctgcaggaccaaggtggggcattttcagcagagtgaattctaataactgtctggtcgcctttgggatagcaaccagtcttggccacagcagagcctcggcctttagcttcatcatttaaaacaatgactgtcagtgcagaggcacgggggacagttaaggtccactgcatactgagttcagcgaaggtggagtgtaatcctggtgcgtcatgcgcccagacaagccaactcctggtagtgtgattggtggagcatgttttatttggtagctttacttccccaactacatagaaataaatgagactgaaatgtgtaagctctttaaaagcatatacattttgctttgaaattttagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcaggtgaatctgttttcactgcttgtctcctttgccctcctaattccatgacttagtgggaggaggtggttattctgggacatccagatcaaaggcagcacagctgctcgagagaaaccctctgagtaggagtggggcctccatgtgaactcatctgcctcctgtaggagcagaagtgtgtcacacaggaatcattgttcacatggagaatgctgtgttgcagacttttgatcacacaaagggcagaggaagcaccgaatggttatgtctagcctgaattcaaaagtgtctttaggtgctttcagcagacacctgtgaaaaagagagttttgcttccaaaagctcttgtttctggattgattagggggaaaaaccgatttgggagagttgctgtggatgaaccagattcaagcacacgctctcattcgctgcagttcgtccctgggttgaatgcagtcaccgccagaacatttacccgtctcctgtggt

SEQ ID NO: 123871 - DNA, 1134 bp, Homo sapiens
attgtccattggtctctccttactgtatcttcacaccagagagcataattgacttcatttttacaactataatataataatttttaatggaataacaaatttaagaaatgtagggtaccactttatatttacttgtaattaacatgatttcaatgatacatactttctcataattgaaaatattataacattatgacttctgtgtcttccctctcttatatatggtacattattacatgcagtagatcttacacatttatagatacggggatgtatgaatttaaatgatgtatagatactaaaccttaaaggcagtttatagatactgccctttggacttatgtactaactgtactaacatgccagaaagtggaaagttggcaagttaactaacaaataagaaatgtttaacctagtgggatttggagttgctagggttcttgtctgtggtgagatacgaggcataaatttgtttgtatggctcttaccgtctgacctgcagtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtgagctcagagccatgttgttttgtagctaaaaagggccctggtggctctgtggctggccatgcaccttcctgagtgtaggatgtgcacatcccccgccaccatgggctgtgctgtccaccttgctgcaggagccatcacggtggtcttcctgcgtttgacctcgcagaatacaggggtcccgttatccgtggcttcacttttgtggtatcacatggtccgaaaataataaggtattttgtgagaaagaatgagagaaaccacattcacgtaactgtcattacagatattgttacagttgttctgttttattgttgatctcttgctgtgcctagcttacaaattgagcttcatcctctgtatgtgtgtataggaaacagcatagtatatatagggttctcaatttcaggcattcactgtgggtctcggaacatatccc

SEQ ID NO: 123872 - DNA, 1931 bp, Homo sapiens
ttgcagtgagtgtgtaaacctgtcatcacataggccaccattggagcgagtgtgtaaacctgtcataacacaggccaccgttgcagtgagtgtgtaaacctgtcatcacataggccaccattggagcgagtgtgtaaacctgtcataacacaggccaccgttgcagtgtgtaaacctgttgtaacacaggccactgttgcagtgagtgtgtaaacctgtcataggccactgttgtagcgagtgtgaccactttgttcatgtcgagtccctcgatacacacttggtgccctggtgtcattgctcccacgaacggctgtgaagcttgttgccagtggcagccttgtcctgttgctgcactgtgcttgtgggctgcgccatgaatactgttctgtctcttaaaatctgggccttcttgctttacaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccggtaaggccgtgcggcctaagaactgagaggccggtcaagagtcagtgtgtgtgtgagtggatatgaaggtgtgtttctgtgtgtatgtatatttgtgtgtgtgtggtgtgtatgcttggttatgcaggcagcgtgacatttctgttatatattctctttgaatgatgcctagagttgtaatgtttttcttgaagagaatctgactatatagttaatggttttaagctatcttttgggatcagatacatcttaagaacagagaagaaaatgcagaggaaacacatttcacatgtactgtcagagcttcttatttgagggtgaaaaaaaaagaaaaagatgttaaactccctaagctgtgccctggaagctgacagtgtatacaggagaccttgacctctgggattgaccctgcctgctctgcaacagtggtacttccttgtcaagggcagtgggggtttggcttttttctttaaagagtctttagggactcactatgttgcccaggctggccttgaactcctggtcctaagtgatcctcctgcctcagcctccaaagtagctgactacaggcgcatgccaccaggcccggctgtgaagggcagttttgagggacagagtgggtgtgttttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcacagtcaggaaaccttggacggctgttgacacctctgtcgatgggagaaagaggactttctatttgagcgtttgcaatcctctcccttacattcctggatgccagggtgagttctccttggtctcttgattggcgtctgttcattttattagagcatttgactcaaggtcatcgccttcctcatgcccaaaccacttattctgttcttccaggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcggtgtgtgttcagaccagcaatgagatgttgtccccgggtgactccatttcccatttcccttgaacctctgaatcttctatcttgtttaaaacttgcctgtgttttcgtggagtttcagccattgct

SEQ ID NO: 123873 - DNA, 2092 bp, Homo sapiens
tagaaagctgtttgccaggcgatttgtattatatataaacaaaatcatgtggaaatggcttttaatgcccatttatagctggtatttacctaaccaaaaattgtaaaagtttttttttttttttttgagaccgagttttgctctgttgccaggctggagtgtaatggcgccatctcggctcactgcaacctctgcctcttgggttcaagtgattctcctgcctcagcctcctgagtagctgggactacagggtgcctgccaccatgcccagctaatttttgtatttttagtagagacggggtttcaccatgttggccaggatggtctagatctcttgacctagtaatccacccgcctcagcctcccaaagtgctgggattacaggcgtgagccactgcgcccggccatttgtaaagctttttgcttgaaaatgtgaatgcgtgtgtggttgcagttgcccttcacttcttccatgttcttgaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtaccattgtttgtcgttttccttttgttgcaaaggaatggaattaaaatattaaaatattttgctgaagatgaattttcccttgagtcagaaacatgagtgttctactgtaaaaaaaaaaaaaagcatattaatgatatttcggattttgcttgattttcttaaacagagtacatactgaaggatgttggtagagcatgtctattttattcttagttagccatgccagttactgactctaaggtcatatttctcttctttattacaacgttgggacacagtgagctagccagtgttggatgttctggggtagtacttgatagcattgagtcacagggaatgcatttagtacgaggtttggctgtagaaattacagggcacgctgttggtcattcatgctgtttcagcagttgggcaagatttaaatacatttaggaacttgtaaaaatgaagtcaaagtagctggtggtgagtacgtggacagccctcaggcacagtggagaaagtgacattcccttaggtgatgaggctaaggaatgcctcatgtcatcatacacgggtcagtctgtgacgttgcagcagccttggacaaggggaagcctgattttattcccaaagtgtaatgtgacaggagtgcatggtatggtgctgggaggccagggatactttgtctcacactcttcagggtgtgtggtgtcacatgtcttaggctaagtttgacagcctagggacccgaaccaaaccttgtttaatgttctccttctttacaggtctcctgactcagaagctaacttatgaaaatggcttgttaaaaatgaacttcacggggggggacacttgccataaggtttatcagcgctccacagccatcttcttctactgtgaccgcggcacccagcgggtgagcatgtaccgacggccctcagcggggtcttctccccaccctcaggctgctgggatcatattagaaagaatctgtcctcagatctcatcaaatctcctggttaactgagtttaaaataaccatttacagaaaatatgttgaaactttcatcagttagtattgattttcatgaacgtaaccattctttactattttcattcttaaaactcaaagtataaactaaagttttgcattctcacttttatatatgtgcctcttaacttttttagccagtatttctaaaggagacttcagattgttcctacttgtttgagtggcgaacgcagtatgcctgcccacctttcgatctgactgaatgttcattcaagtaagtccatggatgtgttgtctcttttggacagactaacttggtatgattttgctttaataattagtggtcttgggtgcaggggattagattagtcagttaatttacctaggactcggtt

SEQ ID NO: 123874 - DNA, 2754 bp, Homo sapiens
agctagcccctggctgcctttcagcatcagtgtagtggattgccaggagtctctcacctgcccttgtgctgggcacccagaaaggcacaggcacagtccattggcagcaagaggtgtgctgggcaggctctccccatgcccaccagactcttagtggctgctgtggtatggcccagcagagggtgctgtgagccacgatcttttcagctaaggatgggacatctcatggatcaagggactgacagtctcatgatacagcctggctgttggtggaggatttaggacaggggtcgtggtgagaagtcagaagtcccgatgctgacataatctgtgtgtgagctcgccgatgatgagcctcccaagtctcagctccctggagtcactgtgtccccatcttcttccaccctacaggacacctgtttgatctgagctccttaagtggcagggcgggattcacagctgcttacagcgagaaggggttggtttacatgagcatctgtggggagaatgaaaactgccctcctggcgtgggtgagtgctgtggtctctcgtgtgttgtctgactctcccgtcctctggggttgtcctcagtctctttgcatgctaatggcaaaaaggatgagcagagccaggaagctgagacgcttttgtctcctgcagcagtcaccccatgtgggggacacatggtcatgtgatggaatgaacattcaatgtaaaacaatggttaaagccggattggacacttgaagttataagtgttggctatgaaattgatggtcctgacttgcgaaagttctcatcagaaaattggccatcgagtctgtgattgtgttttctccgcctttcccttgtggtgcaggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccaggccaaccaataggcccatgctcatctccctggacaagcagacatgcactctcttcttctcctggcacacgccgctggcctgcgagcaagcggtgagttttcagatgggcacgggagaagtgcatgtccagtgcctggctgcacccgggccccttcgtcaggttcacttgcccactagtagatgcccagctgaactgtccactcctgatcaccccaataataaagttgactggaagtgcccagtgctatgtaatgaagcattttgacacctttctactttttttgttgttgttattcagcttttaaattcttatggatgacctagtggtgattaggaaaatttttttgtagactcaaagcagtctttcctacttaacagaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagtaagtatgacaaatccaagggtggagataatttttgcaagacttttagtgataacctttgcgttgtttcttgccttcagtggggagttgctcaagcataaaaaaaatggagaaagtaagtgggactgtgtatgttctgggtccgctactggaagattaaaggtttgcacattgaactgttcgctgatgatggtagccagccagtctttgagcatgggaggtaacacgaatatgtgtgtagggactctacttgtcatgagcctcagggttgacccaaatcaagaagtttttaggtgaagtgacaggaaagcacattgccctagcctggtttctttgtgtgaaatgccttgtcttctgtagttaaaacgcttgcgaaatgcaaacagtttctttggcaaggagttataattaagggcaagagtacgtttgctaatagctaaatattttgccttaaaagctttggttttatgcattaaaaaattattttgtagagatgggagtattgctatgtcacccagccaggctggcctcaggctcctggccttaagtgatcctcctgaagttctgggattacaggcatgagccacagtgcctggcttactagcatgttttaatagaaatttggatctttaaaaattgtctccatgagttatattcatattttgtcaaatccttggtatgttttaatatttgaatgtatctcacaagtcgtctgtatttctgtctgtatcatctattatgctttaaagatggatcctcttgtaacatatctagatgtcctttagaaagatggccattatatgtggcagtgatatggggagatgtcaggagtgtgtaaggagatcggccacagcctgaattagcacagctccagctctgtgtgagatggaggcctggacaagctgagtctccccaggaagctctttggtagcgtcctttctgacagcgcagaccggggatcctcgatcgggaatcattgcctggccacccattgtcaaatgttaaaagatgtagaaagttatttaactggagaaggtgtggtgccacgtggtctgaacgtgccccacagtggtgaatgaagagcactgtagctgagaacaaaatcatggggaagctgcttatacacacactc

SEQ ID NO: 123875 - DNA, 1042 bp, Homo sapiens
cctgtcaggtggtgggaggaccgtgtagcatccttagaggtttttcaggttccgggcttccctcatcagctgatgggaggactctgtagtctccttgatgtgactggagagattcctattgcttaggatctttgaaaattgaagatacctagaaatagaaccaaccttagaactaacgttaggatcaaaacgataaccactgacatacggaggttacacagcatctgtcaagccttccaactggagttggtataaacccagtttctttagatgctgctcattctcagaacctatgaggtctggtttttgcaattctgtatcaattcttaattccactaaccttgggaatggttaatttcctgaaatactgtttgccctcgctctttgtttaggatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatggtaagtgtgggcctgtgacgatctagatgctcaactgcgggttagtgagccaaggctagacaaccagaaagtgcgtgtcaggtccaaggatactcttattcaaaatgtctgccttgggtaagatggtacgctagtagtgtgtctgaataatttaaaccactgattgagggctgagtgagctcccccgcagttaacagcatatagaaacttgctgtaatttaaaaacatagaacacaagtatagaaatgacattcagctttgactgctgatgcataaaagtgtcataacttttgtttttactttaacaattactgattttattctaactgggaagtcagaaagacatttgggcagctatagtcactcaggacatagcccagaagttaacaagtaacaaaagacccctggaatcagaatagctacaacaaagtggcaccttttacttataatgaggtattgacttccattttatgtgcattaaaaaaagaataccagcttcc

SEQ ID NO: 123876 - DNA, 1081 bp, Homo sapiens
aattcctgagagctgcctcatctttttttgttgctgttgaatgagggagggaataaataaagtgattctacaatacttggcctatggaatatctggccatgtggcatcttgccccttgaataaatgtctcccgtgtctagagacagtagattggagcacttgtgaggcagggtctcagtttcacagacctctctcatgacatataagccctccccctttcttcctttgaacccgtagcacagaacattgaggctttctctctaagtagaagacaagacctggattcagccagggagctcacaggatgtgtagggggcaagggcagggtgatgtctgtgccttgaagatggcattgggtctttcagctgctgttgtctagcatcccttccctctgagaggccgctgtgggttatgcacagcccctgtagggacgtggtgtgtcactgctatctatccctatgccatggggtttttaagacccgtgctcttcctggcaacagggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtaatgcgttcaccctgggcgttgctggtgcaggtgtaccaggtgccaggtgctgtgaggctgctgggagtgttttggataatgtggtacctgtgagctgagagggtgtatgtggccactgggcagcatcttggtgctctcgtagggcatgccaggtctcaggaaggttcttggattgcgtggccaactcagcgcagctgacacttgcgttgtacctcatggctctgcacttaacgctttttgatgataagtaacctcatgaggcgggtagtgggaccctttgtatcagacagagggcaggtggggcagcccggagacatgaatgtaaggtatccatggggacagggccagctcctgggtggctgaaatctacagggatttaattcctccaacctggttgaagatgatcaaggcagttg

SEQ ID NO: 123877 - DNA, 1881 bp, Homo sapiens
cagagggtggttctgaggtcagagtgggggcaggagctttggtgactggaaacggagcctctggagctggaagaacctgggcggactgagttaggctgggtttgatttgcgtttgtgtgtagctcaggttgtgggaggcgtgtgggttttctcgggtctttggcaggagctccttaggctttgctggctggggtcagcccatggtcctgaccactctgcgtggggagcgcccgcttggccaggtgctcctgcaagacatcaccgaggagcaggggcatggactcacagggtttaagtggttctaagtgaggtgggaaacttgccgagattctagccactgcctctcccagccccggagcccttctttctactgtaccacgctgtgtccagggtggccgcaggtgtggacattccactccgcgtgtgtctggttggtgagctcccttcttcagtgaagacttcttttgccctttttttttttaattggaaaagctattttagtgctacattcagtgatggaatggagcccttagttatcagaacctttctctgaaagtaaagtgaagagccctcctgtgtcagggcagagacgtcacttgcatgccttttacctgcccctttgtgtcgttttctaggtactatataaatctgtgccagaaaatatataaagggcccctgggctgctctgaaagggccagcatttgcagaaggaccacaactggtgacgtccaggtcctgggactcgttcacacgcagaagctgggtgtcataggtaaggcctgtgggtcctggtccttggttcaaggagcagcatctgaaccgggaaggtgagggtgttctcaggatggcaaggagagtgagcatgtgctttggtggaaacctccagatatgattgcctgtcactgtctcacaggcattttggctctcctggcacattaaaataagtgctgctttgtattatatgagactgcaggtcctagtctgtgtgtttagaggggttgggctatctcggggaagtgcgtctatccaggaggaagtctcagaatgttcagagttcctctgaagttcacgttctagctgtagatcaagtgcctaaattggcataaacacacgtgtttgtttaggaaagccaaacagttgcatgaggacttggtacaggtagttcagaggtacatctttgtaaaatgtcttaacaatttttcacgggaaattgatcttgtacttggttgctgagtgaaagttgttttctttcattatttaaaggaggaaaatagaggtttcttagtaagagcaattaggatttgttggagggaccagtaaaggaaaatattcacctttgcctcttaggctggagtggggtttcccgagttgtcctgattcagccacagggctacttcagattagcttgagatgttgagatggagaaagagaattccgagaaaactactgccacccttgataaaaatcacacacagactctgcaggttggtaggtggagggagagctgccatacaggaagtggcgcccagaccgccagcctgagacccgccctccctgggaggttcttactgctttagaggtcagttattgctgccactcccacactgccccagaagggggaaggagggaaggtcgtggagggttgctttttcccctgtaatcttgcagtatatatggatattcgactagtctttccccaacttcagccaactgaaatgactaaaacacttaaggcttcctaaaagtttgaggcaggaggagcaaaagagagtagtgaacacagggggtgacatggaactagatcatctgacttcttagcggtgacctgcaggccacctccatttggagagcaccattttgcaagtccagcctcgcctggcg

SEQ ID NO: 123878 - DNA, 1023 bp, Homo sapiens
ggccccgtcctggcctgtttctaaggccccctgggcccctttcgtgtggagatggtgtctcatggtgggctgcgctcactgcttccagaagaaattctgagaggaaagagctctgaccctggagagaagtgtggtgcttcgggacagcctctgccccagcctagtcctgccgtggattgggccacctagagggggccgcgtccctcctgcctgtctcctctgtgtttgggtgaatgatagttcatggagctggaagcagtgccttcttgtctgctttctgacaaccctgccacaaactcatcatcaggaactttttgcagccctcttccatgtggagtgggacttgtggccttgttttctgggcaggagtaagaatcacatggtgttgggaaagtcagagctgctcttgccttggggactcaggtctcaggttgtggctgtggcagcaggaccaccctgtgacacggctccttttctgtgacgtccttgcagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggaggtaagcgggtggcagggcgaggtggggcgggtggatgcatgcctcccatagctaatcttggggtcagttttgtggggttttatttatttgtttttaagccctacagcagcgaaggctcgaggttcttagtccaaaactctctggaagcagtccccagcgttgtggtttttaaatgcctgcatttctgtctgaccaaggccgaggccctcgcacatcacccgtgcctgcggcttctaggaccgtggtcctttgtgtccaaagatgagtagaacattaaacggcacctttcatgggtgccttttcccactgagcagctgacccctctgccctcctcacatcataaatgcaggagtttattaagcgcctgctatgtaccag

SEQ ID NO: 123879 - DNA, 2774 bp, Homo sapiens
actggagtccctcctttgacattcctcccctgccatgcagtgggcacctttcagtctatgagtagcccggaagagccccttctcccccagctgcgctgggggatcactggtctgcttttcggtccaggccatcccgaacgccttctgcttggtcccacccttggctgtgagactcctgccaaatgaccccactgccaccctcccaaaccctcctgccttggtgcagtctcattaggaacaggaaggtgttgccagccctcgtcttcctttccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagtttagagtccagtgagtcaataaagcttttttttgtgcaacctgatctaacatggagatgttttctcttgagtaaactcactgagttttccatcttaaattactcagcagtgactgagagctacctgcatggaagcaggaagttactccagtgttataaacaaacttcttagactcaacatcctatt

SEQ ID NO: 123880 - DNA, 1020 bp, Homo sapiens
tcctgcttaaagaaaattcacacctgtaactgtagttagaactgaacacaggagccatattcttgcttgtcatcattcagttggcccaaacaaatttgttttatttttataagctgtgaagaaattagttgcctcttttaattctgagatagttctgggtacttctaaggaacaacttctctgaataatggtacagggtgtaatgagaattcctttggttccttttgaatacatctagtatttttagaaattttgtcagaaagtttattataaatttgttaacggatcagttttcgagcaattttgatacctttttctttaaaattaatagtgaacacttaacggttaaaataggccattgtctttatttctattaacccatttaatcttttcaacaactctatgaggtaggtcctgttatactctctttttgacagatgaggaaactgaggcacacagtttaagtatcttgtccagggtttcacagctggtaatgaagaaaggtctggctgcacagcccatgtctttaaccaccatgaagaattcattatccaaatgggcggatcagaaattagaattctgtataaccctactccggaaagaaatggacatgagcattcttaggtaaaagcgagaagggcagagaaatgaaaatgtgctgcaaaaatgactgctgcttcagtggtaaaaaaaaaaaaaaacttgacttttcagtcaggcttctgtctgtgttataataaaaataggtcaggataatgggtttcatccaactgtaagtgaacagcagtgtacggaacaagaagatctcaatatttttcttagcaacattgcagttaattttacaatagaaaaatctgtaaaacagattacttgacaaagctgttgttttctcttttttatgtcctcgttgtcaccacctgctcttcaatacatagaactgacctctgacagaattactgtagatctttggtaaaagatgtagggggtctatccagttgttcatttgaactttttttttta

SEQ ID NO: 123881 - DNA, 1143 bp, Homo sapiens
ctttcttgaaaataagagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaagctgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctagagaaggctaagcatttcttctgacttgacaactcatcaataacaacatgacagataaacctaattattttctagcacttctttttttaaaaggtgaaagaacaaatctttgtgattgtttcggggaccaccatctgggaaatctcaaagacagttttaggtgcaaatgatatttatgatttgattttggtaaggtaaaatattaaaagttgccaggagatttgaaaacttcaattaagataggatcgtgggttaccaagaaataatagatgactttatatttaacccaagtgacaataaatattttgaaagtaaacataagtggtaacatgatcgtcaagaaactttcctgaaggagaaacttgttccttaaataatcaaggacataataagttggcagaaaccataggttttcatagtaaaacagagaatcttgctgtttgtgcagataatgtagaaaagtaaagaataacttttacagtctattaagagcaaaccagtaatctgataaacatttgacgttgaaacagagaaaacacgattttagttttgtatcagtataacatttgatactaaaggtctttttaaaaaccttatttaaaaccaccaaacttatccagtcttgaccatgacaaataaaattccctttccatgaacc

SEQ ID NO: 123882 - DNA, 1073 bp, Homo sapiens
agtatttaaatgaaaacatgaatattagagaaaaaagatgtaaaaaagatccaaatggaacttctgaaaatgaaaaatacgttacgtgaaatgatagatatgctgggtgggatatcaacagattagacactgcagaaaaacatcagtgaatttagggatatagcagtagaaactatgcaaaatgcaatgcagagagaacaaagactggaaaagtgtaccagaataccagtgacatgtggaatagtgtcaggcggttagcgtgtgtattgagttttaggagaaaagaaagaggagaaccgaaaaaatttttttaagaagtagtggttgtaaatgtttcaaatttgataaatgctgtcaaccatagattcaaaaagttcagtgagtttaaagtagggtcaacacagaagaaaccctgtcactggaagatcactgcttaaatctcttgttcctctatagtttttacctttgttgcctgtcttaaaaatagttttgttcttgtagtggtttttttccttctacttttacatctctggtgttacattttggaaacattcttcctttctctcatttaccacagtttcttccatgtttgcttaacatctctttctttctatttttgagacggagtctctctcgcccaggctggagtgcagtggcgcgagctcagctcactgcaacctccgcctcccagttcaagcaattctcctgcgtcagtctcccgagtagctggaattacaggcgtgtgctaccacacccagctaatttttgtatttttctagtagagacagggtttcaccatgttggcttggccggtcttgaactcctgacctcaagtgatccacccgcattggccttccttagtgttgggattacaggcgtgagctgtggaccacgcccagcctttctttcagaaggcttttttattgtgtttagtcgtaaccttgattatgaaccatttaaggagttttctaattattcttattaactgttactagataaaatgttaatttatgttaaccatttaaaaaaaatttttttaaactcaaatttgtccgaataattaaccatttttg

SEQ ID NO: 123883 - DNA, 1042 bp, Homo sapiens
acgtagtctgttcctgctcctgcctgctgcttctgggactcggattcactccgcctgccccaccctgggttgtcatgggctcctttcactctcagatgagccctgctctctcctgtctcagatcctctgcacatgctgtaccttctgtcttagcagccccccactttctgcctcctttttctgtgcaatttcttcggaacttttatgtgtcagttgaaatgctccttcttcagagaagccttctttgttaccatcttcctagttctccaggttaggtcctatctgctggtgggctttgtcccagcactttgttccctgtaatcttcctccatagcataattcataagtatacttgaaatacacttgtgtatgtaattctgtgctaactctccagttctctgtagattgaaagctccatgagggcaggaacagtaatgtgttttttcctctactcctagcacacctcttgtctggtggggtcattgttgaatgaaataaagacatgactgtgatttcccttgaggtgctaatagtgtaatttgacacacaatgtggtatgaaacagataatgtgtattttcacctgtaagtaaatcaatcaaattattagaataaagacccaagaaaacaaaaaaaaacaaaagtgaataaaagaaaatggtgtacatttaacacatttatatcttctttgtctcatcccttatagaatcctgttttcaatgaaaaagaaaaaagaagagttgttgttaattcaaaattaccgttccctagtttgaaaggctgttttctatttcaacacacgcacaccggcacacacccaggctcatgtgaaaggaacggagactcaagcctgatctgatgaggctgtgttagaagtgctgcacattgaccttcctggaacgcagagtgtaatccctgcatttggtacggaagataaatagctatctgaaggagacgatttcagttagaccttttatttgacatatacagataaataaaccaggcagaatccccactttttctctcatttaacttgtagccaa

SEQ ID NO: 123884 - DNA, 1008 bp, Homo sapiens
ttctataaggttctggtaaagatgaaatgagactgtatgatatcgagcatagtacttaccaagcatggtaagtactccgtgcctaacggtagcaattatactgttacagtgaaaattcttcataacttaatgggtaacaaattacagagctgattgaaaacataaacaagtataaatgttttattcccatttaacataattttattgttttttgaccattgtcttaattttgagtcttcgttcatctgtctttttccagctttatatgaaaaggtagcactggagtttaactagtacagaatttttcaatcttccaccatctgtgtaacaccttataatttttgctgtatccttgtaccacctatcctattattttcctttttttaaaatttattctctttttaggcagtctattttagaaggaaactttatcatgatagtaaacatggaaaacctaaataattttgccataaatagaaaataattgtaacaataaatgactgtaagcacattatacatgtgcctccagaagtcttttaaataccacattatgaaaaacattgcatgtggtcttccatcatgctaacctaaagccgttaatcagtatgtttaggttatgcttcttcactcagcctcctggaggaggaatgctaacttctccatgaggatggaagagcagaatttgccgttaaaataggaagaaaagacatgatttatggcagttgatcagactctgtttatggcactggtgcatggatcagatgctgctatgatgattgttacaataaatatttccaagccctgtttcagactctctggtcagaatttcttgtggaagatactgaaatctgtatttttaacaggaaggtcaaaaattctgatgcacataccagttttggcagtcactgttttaaatggcattttttcagcctatcattttgaagttgtttacaaccacaattaccagtgtatctgtaaagaattgcttaattttataattttacattt

SEQ ID NO: 123885 - DNA, 1028 bp, Homo sapiens
attttctcatccaggtgtccgtcagatctcccatgctgtttcttcctccttaaattgaaggtgattacttacggaaatttggttaaatgatttgataactatgctttgtagcatagagagaaataaacagctagtttaggtaattagttgtgaatataagagaatacagcaaatactggaaaaatggataattttttttaaaatatagaaaatgtcatatatattttttgattcctttaatttttaggatatggtatgcttttttttcttccattagcagtctgaaaatataaatatgtgtgaataccagttttattgaaaatattgagagtagcttcatattttagagttatataatgttctgtttatttttttttttaatagaaaaaatgaatgcaccaaatcagcctccacataaagacactggaaaaacagtggagaatgtggaagaatacagctataagcaggagaaaaagatccgagcagctcttagaacaacagagcgtgatcgtaaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccact

SEQ ID NO: 123886 - DNA, 1031 bp, Homo sapiens
catgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggaggtaggtttccagtaggtattaatacaatgatatccttagttccatttatttattgcaaattataatgttggtgttatgtactttcatattctaatatttttgaacacaaatggcagttataaattgcacatttaagcatttctgtaaagtactatgattaaatagatctatgaaaactgcatgaaatttagtgaattaagtgcagggtggtatgtggagggaataagttcaaccacgtaaatacaggatggcaaaggacaggctgggtataaacaaaaatggaaggaagaaagccatagtcatggatgaccacaagctgcatgtgagtcaggaaaaaagtccac

SEQ ID NO: 123887 - DNA, 1025 bp, Homo sapiens
tccagatcccctactttatggggaaaggtgtaaggaatttgagaggaacagctaaaagaacgggggtgggggcggacaacgcaacactagggttcccgggaagcatcacaaaacggataactgagtcatgccaaccaggttgatcttaacgattttttaatttttctgtcagcatcgttcattacagctcaggggaacaaatggacagaagaattagtggaactgattagtttttatgttttcataaatggctacttaggatgagctgttatttgattttgtaatgttttctctaatttcagtaattctctggtttttttcccagtctagagatagttgtcgatagtactgtatataacctgaaaaataaagtgttctgatcattttaagtgtgaggcaaaaatgttaaagatgaacctgattctttttctaatatacttctttgatcaaagtattgcaatttggttttggttctcattatggtttccagcattcttagaactttttggatctatgttgaaaatgttgaagttattaaattcattaaattattaaatattcttttccctgtaaaattagaatttttgtagatttgttagcacattgtagagaataagagtttataaccacaaccgtagaacgttgtctcgtatgctcttttaatctgtgcctgttgaatttttgttatagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcaggtttgcttcaaagactctttaaaatatttagcaattattatattatcctacaggcttatcatttttattttgagagttcctttttttttctt

SEQ ID NO: 123888 - DNA, 1054 bp, Homo sapiens
ttctcactctcacaccatttactcactgattctctcctatgtgtttgtatgtttagttacatgaaaattgcagttatccatatctcatatgtgcaccctcttccaagttttgagtggtgtttctcagtcaggggtgattttttccccttggggacattgggcagtatctggagacacttgatggtcatgactgggaagatgctcctggcagcgagtgggcggggggagggaggctgccgcacattcacggcacacagaacagccccacaacagaattatccactcagatgtcagctttgaacttgagaacttctgccctagaataaactctttttccccctaataaaaggaaggagattgtaagtccttcaagagtagaatatacccgcgtatatcagtcttggtggggacatgcagaacttaagaagtattttaagcatttttactgccactgtttggggaatgtagtgctcatcacagactctctttatgaattgggtgtatatagggtgaaggaatagaagtgtaaacaagggggaatcatgaagagagcagtgcagagtcgcagggctggtctgtcagttctaggaaatgaacatcttgcatgcaagcttgggatcgctgggcacaggccgcgtctccgtggtctttgctggtggccactgcacctcggacttgctttggctcagatgaggatcagtgtccttctgtgctttagattctgctgctgtcttttggcaccaccttctcccacttgtctcatcaggcattttattttttctgtatcccttttataaagtctcattcataagagcatgcctattctagtcctagaccccattgcattttgtctcttgtattagagcagcagcttctgctgcctaccctgtctcctggtcccgtcagcgtgacttctgcaggactctagctttagctttgttcttgactctgccgatttctcctatgttcagtctcggaatctcgtatccacttctctgttctaatggccagttctttttacatcctctctctttatttggagtggacagtgaac

SEQ ID NO: 123889 - DNA, 1082 bp, Homo sapiens
ccatgccttcaatgggtctgaaactgtgccttcggggttggtctttctcctcctccgacaagcctagcacttacctcctgctgcatctgatattagttctgtgcttacctgctctctgttactagatcctaagtttttttccttgaacatcctaagtcagtaaactgtggttgaattttacttcactcatttagattcattttatatactggggtgtacattttaacactagtatttagaattgtgtactcaatgagaaggatcagccagatagagtgtttcatgtttattgactatacaaagctaattgtgggggaaatttgtaaaaacagttgaatttaaggaattccctttccctcttatcctatcatttagtttgaggccattttatggaaaatttccatttagatggaaataacatttgtgtactaattccatagctactatgaatacagtttaagattttaaggtttatattgagatactgtggtagtagaacaaaggtaggtacatgtcataatccagattcctatttttccacgtccagggttttatattaaaagaagagaaatttttcatttttgatttttaaaccattagagcagtagctgagcctttcaagtttctcagtcaagaattaggctatgagtagggacagttttcttctctgttttatttttatttttgttcccttagtgacattgcaggaatgctgctgaaatctacaggaagttttttagaatttggcttacaggagagctgtgctgaattttggactagtgcggatgacagcagtgcttccgacgaaatcaggttggagttgtgcttcctttccccttccacttcttatctcgtagtttccttcctcatggtgagatcctagaaggagccttgttcaaaccaaattgtgttggcctggaagaatttgggcagtagatgtaaagggatttatttataactgccttgtcttttcatgtgatttcttagttatggttttatgtgaaattttctttgaaggggaacttagaatttatttagtgtgataaaaatagtgccaactggctgggcgcggtggctcacgc

SEQ ID NO: 123890 - DNA, 1198 bp, Homo sapiens
gtactcaggtttactggttatttaattttaattttttgtagtgaaggctatcccctccctacctaacagggacctcgtgacagtttctataactcattagttataaactatgagaagctttctcatttatctgtgttcagcttaggaacagtcatggtgagtgttcatatgcaccttgagctcagcctcaccagaactgagtatacactggcctgctgtatccctcaccccaacaactctgcttttatattccgtctcagtgaatggttccgcgttcactcacatgtttaaaccagaagtgtgacagctaatataaattcagcctcccatctttccagttaataccttgccctggaaagccagaagcatttccagtaaatgatcctttccctgcatccccagagcagctgctgtagtcagcactttaccatccctctcctgaactattgcagtttctgactttgagtttccctgcttcaaacctcaccttctgtctctccaattctgtgtttgtttttgtgcttctagaatgatcattataatacatctgattgcatcacagatctacttaaaatactgcaaagattcttcatctcttaagaacaaaagtaataaagtcttgatttcttaatgttttatataaggcccctcatcttatttctgtcttattcctacattttccttcttcatatgctgctccaatacacacacacatgcacacatacacacacacactcacacacactctgcactggcagtactgaactacttgaagttctaggatatctcaaagatgtcatgcctgcagtcccaaagggttcttctccgtggtgctgaatatcccagctgtcaatgcccactgaagcgtgttgctgtgtaggagaagctttgcttaaaaatgactttctgattagatggttgttggcctggtatccctgagattggcattgtttttggactggtgttgaactagaataacaactagtaactgggttggtttttatgtcctgtgcttgattttcctcccaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaaggtattacactgtcctctac

SEQ ID NO: 123891 - DNA, 1079 bp, Homo sapiens
ttaagcaatttctccaagttagagaaaacacatttgctgcatctgagattcaaagtaggaactttgtgttacaaaactcataaatacttgttgaattacaaataaataattgttgaattacagatggcacctatcatgtctaaaatcctcttccatgcttcccattggtttcaaaacaaaattaaattttaaaaaattattctcctttccaaaaggtcacgctgtaaacttactgaacccaagcaaaaaaaagtgtcttgtcctaaatagtaattataattatgttacttttcagtattgtacagtctaaaactgctacagcgttttcttggttgttatgtgattactgaactttttcgtgtaccaggtgggcgactcaaggatttgattttctacaagcaattgaacctgcctttatttcagctttaccagaagatgacttcttggtatggattattctaaagtttttttcattataaaataagccagtcactccttattttctggttgtatatgttttatatgtaatagtggtttttttcatgagatattaatctcagcatatcatgtaatgataatgctgagaaattaaagtactcctcatagcagagtaagattttttttctttttgtaacattagtgttcaactaagtcaatgtctggtttgtaaaccctggcccttctaaaatatttgtgagatttatatttttactgccatcatagctgctgctttggggcagaacaaggattagctcttttacctcagtgtgcatcattttgagagcatcatgctcgtgttaaatattatcactgttagtctgataagtgtcatcagattagcatgatattgctcaaagtgtgaattcatttattttattctcccagtagtagagacgattacatgaaaagttctttgcttgtacacgttattgtgttatgggaaattgacagctaatttgcttttacttataaaaatgaaatacactgtattattttaaattacatacaatttgtgtttatacctattttcttttaaactaactgaaaatattttgggtagcatgtttttaaaaatatac

SEQ ID NO: 123892 - DNA, 1027 bp, Homo sapiens
ttttcccccttaccatcttttctgatggggaggaaagactggaagagggcgttgtctgccaagcaacaggaactgcccctgctgcaggtggctgcagatcacttccctgtcccccgttcctcacctttgaggagagcagtgtccatttctccacagctttcccaagtacccatcttcccaccagctgtagtaaattctgatttggttttactgtttaaaaaatcaagttaagttatgctgctatatatattacttcaattacaatttttggttacagtttatgtacaattttacagtaacaatgaatgattaacacttttatagtatatgttgaaatgttgaaaacaaaatatatgtcaaaaaaagctgtgtcttatgccgttcttgagatagtttgtaaataaaacaaaactgtatttgtaagtaataaacacccaagaaagaaacttagaaattttatgcaatttaaattacacaaaatataattcataaatggtaaatttattgaacactaactgtatttcatatagggtacttgctggctgcagaaaattcagtagaatgggttttaattgttggttttttaatcttcagtttatacctctttttctcccaaggttgtcgtgaaaatgaaagttaacatttgtaagactatttgagcattttatataaagcatgctattgtcttatcaggttattgcttaagctgtgaataattttgattttctgatatcctaaaacacttctctaagaacacatgatcgataattcagtaagaattactttaaaatattttattagataaggaatcattttcattgtggaaaaatcacaacatagaaaaagtatctagaaaaatatggaagatgttcatttagaaaatttatcaatgtagaaaaagattacaaaagacaaaataaaaatgactcatacttcctgaatccaaaggtagtcccgggtaacatctgagtcgctcatctttcaatatgcctgccactccaaactgcagtgggacagttaattaata

SEQ ID NO: 123893 - DNA, 1046 bp, Homo sapiens
ttgttgccatttttgctggcagccattcatcggaacagcccccgtcctatgaaggtacctcgatgccatagtgaccctcctaacccacacctcattatccccactccagagggattcaggtatttggtgcttatctagtcatttgctttacagagtgccctccgatatgcatgctcatacttttgaaactactagatgcttgctctgagagctaaataccttttctgcattgttcgtacgtaaaagctcttacttgcattatcttgaaacctttagtcgcaaaagaaaaagacatgcaaatttaaaacagacctgtgcctttcaagataacttcgtttctcagcttatttataacctcaagctactacatgctttctggctgtggagtcattttttcctttcctgcctttgaaaaataaccttcagaaaacaaatttgaatatggatagtgtagtcaacatttgaaaacatactaaatatcactaaaagtggagaaaaactggaatgagctttccagattcaatttttatctgcatatgtaattacaaagcaacttaaacactaagtgaattcagaaactatagtacattcacgataactgccttgaatgtggtggcatttctgcatcttgaggtagtgagcaccttctctcgcctgtataatcagtttttaaaagtttaattttatttgacaatatttgctagataaggaccacagttttttgttttttttttaaagctttgaggggaccggggtgcggtgactcacgcctgtaattccagcactttaggaggacgaggcgggaggatcacttgagcccaggagaacagcctgggcaacgtagcaaaacatcatctctacaaaaaatacaacaaagataatagctgggtatggtggccgtgcctgtagtcccagctactcaggaggctgaggcaaggaggatcacttgagcccaggaggtcaaggctgcagtgagctatgattgcgccactgcactccagcctggacaacagggtgcgatgctgtctcaaaaaaaagaaaagctt

SEQ ID NO: 123894 - DNA, 1036 bp, Homo sapiens
ctagatttgagggcttagggaaataccagaaaaaaatgcatattttataatttgtaaatgtctgtgcaatagatcatgttgccttcaacctatcaatgtataataagagcataaatgctaccatacttcattataccattcacttaaaaatatatactaaatgactttaataaactaatgccatatttatttgaggttctttgattattcgaattacaattttaacacattccctatttagttttaatttttactctttatgggttcattctggttgctgaacatttcactttattctggaaaagcacctcattaactttgttctttaatatattaagcttcctgctcttttgcacttttgcttggctactgcttgagaaacctttaggtattcccttccattttcttactgagagatttggaatcttttggaccatgaaatgattttagtactttaaatgtaattaagtacataaatataatttgatggtaactttaaagatcagcaagatttggttaataacagttttattcaccctgggcttaagttatggagcttttcacatgtcagtaacatttcaatagtgttgtgtttttatttctgttgttaatataagacaaggttttatgcaggcaggtgctctcaggctcgggtgttggctatggagagatgaaaatggagccctccttccagactctagagctctaacagactccagaggacggtctccacagcagcgctgttcacttagggggctgattctggtgggtctgtcctgtgcgttttccgctgcccactagatgccagtagcaccctcccaaaagtgtctaatacattgctggaggcagagttgttcctggcaggcagagttgcccccagttgagaattattgctctagaaaaatctcgcagatctttcattttaagttctattgaattgatagctcaattattaaaaatattaaaacaggggttccagcgttcctgaaaatgatcgattggcttccatagctgctgaattgcagtttaggtccct

SEQ ID NO: 123895 - DNA, 1256 bp, Homo sapiens
ctcagcctcccaagtagctgggactacaggcacacaccaccacacctggctaacttttgtatttttttgtagagatggggttttgccattttgcccagtctggtcttgaactcctaggctcaagtgatctgcccacctcacctcccaaagtgctgggattacaagaatgagtcactgctccaggcctcgtgaattaaatttatgtaggacagtaacatgatcacattttatgttttaataatatggcaaacaagagtgtggaatggagagaggagaaactagagacatgtatattactgcaagattttagccaacgttcttgggaaaggaaatcatttttgtgtgactagcttatattttatgtgtgtactgtataaggggtggcatatgctggaatgagtagcgtttgaagaactttaattcacctgctgtttatctgaatagataataagctttgctgtaatggagtgctaatatatattgctctatttttattggtttgtcttttggaaactgacttgataacagtgattgggactaatgaggttttggttctctctgcagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggtaaggaaattaaggagcatgatgtcaagatagtccctgttagaagtagcaatagttatacttctttaggttgaatcctatagagttggcccttttttcttgtagacatagcaagtatgcattgttatctttttgcaaagtggtctggattttttttggttgtttaatttgtaaaatgtattctaagagcaatacaaaatgagattttagaatgagaaagagatttctaaatgattcattgcattggattcttttgcttaataaccctggaatttgccagtggagaggtaccaaaatttgacccatttgttctagtttctctctctctctctacacacgcgcgcgcacacacacacacacacacacacacacacgcagaacgtgatttgaagagagactggatacaaatgagggcaagacagtcttcttttctaaaacattgcctcattaattaatttccaggtggaattgcttcatgtaaaatagtcgtaaattatgtg

SEQ ID NO: 123896 - DNA, 1877 bp, Homo sapiens
gattaattattgttatcagtcttgtccaggcacatatcctcttgctttaatgtcccagaaggtatgttaggggaatgtttgctcccacacactcctggacatgtgccagtgaggaagacaatggtcaggcttagtcctggctgttttctgctgctcccagccccagccaagatctccttgaggggtgtgagggctcagaggtgtgcaccaaggctgcttttattggtcattttcatgcttctcctggaatttaccaaagtcggttctgctctatttaaagatacttgtaggtaagacatattaaagagattgcctaaaactttagttatcagggaacatttagaaaaattttggatcttgcaatagtaaactgcagtaaacataattatagatatataaatatacgtccaaaataattggacagtattattacaagtttaaggaatgtaagacagccccctgcagtggctggaagtgcagcttgtttgcattgttcacaggagaaggccagtatgggaaggtgtacacctgcatcagcgtcgacaccggggagctgatggccatgaaagaggtgagtcacctggctccgtggggcctttgggcctggcggctctgggtgatagaaattccgtatagacgctggtcgtgattcagttctctgtgcgtagagctgtcttcagcaccagcactgcgacagtcaggaccaaccaggcagatgcactgagataacacacacagacagtgaaggggcttacgattccagagaggataataagtcacagacagttctaacagcacaggtgtgagaagggcctatgagggtggcagagctgagtctgatgaaggcttagaggagaggattaacagtagtgtcttatggggacacattgggggagaagataacatttatgataagcttcagaaacaagtggcattgaaaccgctggaggtaggatggggaaagggccagggaacctgaagtagaaacaggactcactgctgtctgtggagacatccggtttgacgtggaaggaggagaggagtggagaggggaggctccagcgtcttgcacttgccgtggagccgcgtcctcctccacatggcgctcctcactccctctcggagcagggcctcttcctcctctgtgcccgggacctacccgcacttctatgacttcactctagcttggctaaaaacttcctttttacttaattttttgttgtttttaattgacaaatcatgattacatatatttatggggtgcaaaatgatgtttcagtgtatgtgtataatgtagagtgattaaatcaagccagttaacatttttgtcacctcactttacagattcgatttcaacctaatgaccataagactatcaaggaaactgcagacgaattgaaaatattcgaaggcatcaaacaccccaatctggttcggtattttggtgtggagctccatagagtaagccgaccctaatgccactctttgtgtgaggaatcagtgagggcacagaatggagtcctgttctacatcacaggtcttctcatttcagagcacagtaactttgcctaattctcaggaaatctccatgagttacatcatttctgccttctctctgaaactagaggagttcctcctaaaatgtaagttgtagactgtagtcattaacccgacatcataaagcactgaaacccatcctgccattcagaagattcttctaaaacgccccttacaccacttcttgtgactttttttccgtttttttgctgaaccactgttgagtacactgttaagtaatactggtttttttcttgtatgtatttagggagccattgtgaaatgagagaaaattcaaacctcaaattgagtttcctcct

SEQ ID NO: 123897 - DNA, 1072 bp, Homo sapiens
ctgcccctcgtagtcaattgtggggagcatcaactctaggagcactgagttatgaggattcgctgttgacctcagctcatcagatggctgcttgtctaactccattggctctgtgttgttgcttttcgaaggaggtaccatagaacacaatgccagagatgtgtgacttagttggagcaataatatcttgcagcctagagcaaaaggccaagctgtcctgagagatgaacagtattcccaaattctaactagactacaagttaagcatatatgttgcttgtaggaatatttgaaaattgcagaacagttttcagtcacgtcatataaatgcaagggcctcagctgggactctgaagaactgcagtgcgtgtgcagctctcatctacatgtcgcttcctgtttcagacgctgctgattgtacacatctctcattctccagactgccaccacaacaagcacttgtgttttgtatgcagtttctttttaagtatctctgtgggttattaatgttagaatgtatgcatgtatttcagttcagaatttattggtcaaggctacctgcactggtgttaaaattttgttgctttttattaaaatttgtgaataaggcttacaaatcttcctatgattacactttgtaagtcaagtttcataagcctttcgattgtttagcttgtgaatgaagttcctggtcgtttagattaccatgtaaccttgcccacattgtgtttcagaggctgcgtaacaactacttcttttctttttaggtgccaatatcttccttacctcatctggattaatcaaactgggagattttggatgttcagtaaagctcaaaaacaatgcccagaccatgcctggtgaagtgaacagcaccctggggacagcaggtagggaccagcctggttgttctttgcactctgacttcatgcagcctgcttggggcctgcatgttcccttcacctttgtttgtcagtagagatgggagagcaggtaaaggttttcagtcgtgagaaggaccacttcctcacacacttgggctcccacgcaagagcagctgtcacattggtga

SEQ ID NO: 123898 - DNA, 1160 bp, Homo sapiens
gctctgtcgccaggcaggagtgcaagtggcatgatctcggctcactgcaacctccgcctcccgggttcaagcaattcttctgcctcagcctcccaagtagctgggattacaggcacctgccaccatgcctggctaagttttgtactttggtagagacagggtttcactgtgttggccaggctggtctcgaactcctgacctcatgatccgcctgcctcagcctcccgaagtgctgagtgacatttttaaagattgagaatactatcttttagagagtatataaagaaacacacatgttttggacagaaattccatgtggtagggctgctccggagacatttccaatctctatcaaaattttaaatgtgcatagcacttaaaccaagaagttttctgcttctgaaaatgtatcttatgatgataatattaatgagcagttatacaaatgtaaaaagacacgcatgaactgcacatggtagcttaccgtacacatacagtattatagcaaaaaagttagaaaccttcatttctaagttaaaagttagtgttaagttactagtaggaaatcagttaattataatgtagctatgccttgcagctgctgaaacagatcacatataagtgctcagtaaatattagctagcattatttctattagcattaaaatagaaaggcagttgtgatatctgtgttattccagtaaagccacacataaaagaacaggttctcatattgaagaatacatattggcaatgacgaaacaatagtttagaaattagaatgccatacacacttagttccttcccctgtgaatctcatttttcataggatcataatgaaataagctttgcactaatgcaatttttatttttcaataaggtagcatattaaccatccctataagagaattgggttttatagacttttttatgtcattttatatattttttagttgcatgatgatggcttctagatactgttggactaaatagtgcaccccaaatggagtaggcaaactatgctggccacctgttttataaataaagttttgttggaacagtcatattcatttatgtgttgtccatagctgctaccatgctgccatgagattagtgaatagttgtgatagagatcatatggcctgtcaacctaaaatattg

SEQ ID NO: 123899 - DNA, 1019 bp, Homo sapiens
gaacagcggcatttaagagttagagtgccgtggctgacccctgattggatgtgaaaggtgagtgaggggaggagtctagagtggctcccaggtttctggtttgtgtcatcaggtcacagactctatttgccagggtagggaaagaagcagctgggtgaggggtgggtcgggaggtggtgggtcctctttggtggatgaagcttggggtacatttggagcatctgcttggagatttcacatgggcatttggatacctggggctggcactcaagagggattttgggtagggcacaggtgtgggagacagaagtattgctgggagggtccacagaggacaaggggatgagaacagagccctggagaaaagagccttgcaagggccctgcaggagagagtccctgggaaaggaaaggaaggggcagaagagtggggtgatgctcttattggtaagtgggagtaaggggcaagcagcaggatcagctatggagacattagggatttgtaattaaataacaatttatgtcttagttatgaagtgcataacaatttatattgacctgagagtgcatataggcgttttagaaaatgctttcattagtcagttcccaggcttaactttagagcagtaacttacctctgccattgttcattacatttcttaagccttgccctctgtgcccagtacagtgctgggagcatcaggatgagtggatggggccttccccgtaagactcatactgcgcgtatgcacaagcacacacctggctctgcaagagctcagctctctcctgcttcctcacaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggcca

SEQ ID NO: 123900 - DNA, 1133 bp, Homo sapiens
ctggcgcttgtgatttgcggccacgggccttctcacttgctctgtgggaaaacggccctgtagtctgtttgggctactcctaactctgctctccttgtctctgcagcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcatctgtggtgtatgttgacatggaccgctgcccctccatcctgcccttgcccgtggctttggtgtttcagatcctactcacgggaggcagctgccgcggaggtgtgggcagctgagaggggtgggcaggccagcacagctcctggcaggagacacaggtccaggagcccgtgagcatttgtgagagcagagatggcaagcacgtgcgtggagaccaacgaagcgtgtccctggcacacagcaagggagagtttcgctcggtctctgcagtgcagtctcctggcgtaagtcttgaagatggacccaactccctgaagaaatggatcttgaaattgaacacaaacatcatgaacgtacagcctgggcattctgcagtgatttgtgagatgagcttgcatcgactgttcctctcagcagtgacagccaaagtcacccctgataaaatgcagtttcactttataaaatgcc

SEQ ID NO: 123901 - DNA, 1002 bp, Homo sapiens
gcaccaaaggatgaaaggggaacttgtccccttcggtccccagccctgccctcccctgcagcctaaaataccctttctatgatcacagaacaaagttcacactcaccacacagccattctcacacacactcgcacaaaaagaaaaccaaagcccactaaagcacatggggaaaaaaagattacaaaacatcttcctccccatccggccttgagaccagactccctggctggagaggtcgtgacttccgccgtgcccagcaggggctcacccagcctttgtcaccgtgtcccactaaggaggatatgcagaggccaccagttccccaaggttcccttcggatggtgacacctccctgagtcagtcattcagtttctgcttgctgtcagagttgccgtaggcagagcccttgtcaatttccgtcacaccaatcatccatcgaactcccacggaggctgcagagacaaggagagcagagttaggagtagcccaaacagactacagggccgttttcccacagagcaagtgagaaggcccgtggccgcaaatcacaagcgccagctcagagctggctggcgggtttgaggtgccatcatcctgccggctttacaatcatccttgagtgtggacatccatgtgacattaagacaaagcaaggctgctctggtgggggttttcctccttggaccctgaaggtgaatgatttggcaagccatgcacagccgttcgcagggactcagagaaatccctggcttcctctgctgacccccaggtaaagaggattcttttgtgaataagggacaggaagttaacagggcatgttcagcgaagttttataaagaacagaccaggagcctggaagacgcaagagctcgagtatcgagtgcccaacacgtttcagcactgcttttggtgcaagcgttagagcagtgagaaaatccccgccctctcctctgacggcaggatttgcctacaccagagaatgggcaggaccctcgtgggag

SEQ ID NO: 123902 - DNA, 1034 bp, Homo sapiens
cctcaaggctaaccaagaggccagaggaatcatttgatgggagataatctgccattaccagtaagttggttacttggctaagaagaaattactaggttattgtctctgatgcatcgattctgtgtatattggattgtctcgtgtggaaactgaggcagtgttgtcctctttggaagaggcaaatatcaggttttgggggcctttttgtgaggtgggagggaagacggaatgaggcaggtgtcccctgttctcacagcatctgtctgtgccattgaattggcccctgggttgttccttcgtgggtcataattgcatttttgcctgtttctccagtgtggatgtggaacgccccttctttctatcacttgcattactctcttcagttccacattatttaggtgacccagataaaaacaaaaaacggcagcaccgttactggaaactgtatgttgtaggggggcatcacctcctctctgctagctgctctctgcctttgcaggaggatcccactggaagacatccctgaagacgatgacgagtgctcggcctggctgcacaagctctaccaggagaaggtcagtgcactgggtgccaggggtcccttcacgttgcagctgtgggtgcgccgtgtggctgtgttgtgtggtagcaggcctttctccggtgggcgagatctcacagagccagttattagtgagtctggagctgaccctctcttggcaatgaagaacatgacaaaatattttttaaggagggttcacacacacacaatgaagctattctctaggtgtagtggaccaagggagaagtaatggccccaatcgcccctgctcgtattttcctgcctctggtcctaaggcaggatgtgcttgtggggtggatgttctccgcagcaatggacatggtcttgattgcttctggatcaacaatttggttgtcaatctgatctcaaagcatctccagaataagcaggataaagccctacaaggatccaccttggtcttggctgggttcgaacctgctgtggtgccccc

SEQ ID NO: 123903 - DNA, 1096 bp, Homo sapiens
cacctaggaatgctacattttctagcgtttgacattttcagcgatcaagaattactatattttgtaatatcacaaaactcagtgagatctgcagaaaagaggtgcacaaattagtgtcacacagctgcacggtgggcttagcgagtatgtgacggtgataacctagaaaccgtttggatggtggtgggagcatcgtcaggaccctgaatacctgtgactgctcgctgctgccttcttgactcctgccgtctgcgctgagaaccagggtgcccctgccccctgctcccacactggcagggcaagcacaacctggacctctagctgaaaggtggggagggcaccagggtccatggcctcgacagcatgtgttctgggactgtcccgaggcgtctggtgtgaacgtcccctcctctttttctacttcagtctccaacagccccggcaggtggctctgacgtctccttcatgggcacctgggctccttcttctgtttcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttgtatgtaggcaccagagcagctgtgtcccaagggctcctgcaggactgtgaccgtgggacccccatgtgacttccacaggacacgtgactgtgtggtcctgtgcgactccagggctgtgtgtgaccatagggctgtgtataacctcagggatgtatgtgaccatggggccgtgtgtgaccgtggggccacgtatgactgtggggccgtgtatgaccatggggccgtgtgtgaccccagggctgtgtgtgaccccagggctgtgtgtgaccatggggccgtgtgtgatcatgtggccatatgtgaccctggggctatgtgtgaccccagggctgtgtgtgaccccagggctatgtgtgacctcagggctgtatgtaaccatggggccctgtgtgatcgtgtggccatatgtgcccctggggctgtgtgtgaccccaggg

SEQ ID NO: 123904 - DNA, 1050 bp, Homo sapiens
tttgatggagtttataagtatcccaattagtcattttccaggatattaagaattctatacctcatctcacgctgcctttcagagctctgtaaacacaagggcatgaattcttgacggattctggctttctgatttattttcccccaagatacttaatcaaggagtaagtcatttaccttctccaagtatccttctcttcttccctggagaatgttgtgaagtctttctcgtgtttccttccgcttctgaaccctttcaaggaccaaggtctgtgctgcaacgatccagaactttgcccgtagaagttgctttctcccctagctgggagggcagagccctgctctcagcagggctcccaggacaaggctgcatgtagtaaacatctgtctgttgtggtttgttccagagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaataaactgctttttattcttgctgggagtcagtcttaacagcttcttatgggcaatcataagaggtactcaacaattgctacctgccggccattttacatatgattcatttatttaatccttacagcaacatgaatagatgatgtgccacactccattttttaaaaactaagttatatagagcttaatattcggctcagagtcacacagctgtaattagatttggatttcactcccatccatatttcttaattccatgctctactgcctccttggctaacaggcagacatcacctctgcattttgatcgttgaaggcttaagaactttgagtccataagtgag

SEQ ID NO: 123905 - DNA, 1033 bp, Homo sapiens
gtgtacaatacatgtgggttctctcttcaccccgattcctcaatgccttcctcctcttccctgctcctccatcctgttcgtgccccttccctggaccccacccatcacctgagctgtgacctcagggcaccctgctggtcttggcacactcattagacttcaccacaagagccagatggggaggaggcaggacagtccgcagatgggaaagcctcctaattcctggccttggtcttcccagggctgccagacaatccgggtttagcaacactgttgcatgcccactcaccagcctcatagcttgattagataaagctcacctggtagatgaaaccctggcaaaatgatttatcagggatgttttaaagatggggatataaaataggcacagatttattacttcaaaattactaagattctaagaaacacgtgttctgcacgtgcacgaggccagcaaagcaagaggactgagccctcagcatcagggtcagcagcagctggtacaggaattctgcccccagaatgggcatgaccttgggaaagccatctctcttccatttgccattggtgaaatgagatagcgatgccgatctcaccaggtggctctcgggattctagggaatgatgtttacggaagccccattcgacggccgctggctgctcaacccagaggtgccctgttcagttcctccccaagctgccctcccagaggcacggccgtgcttgttaccatggtgactgctgggttaacaaggactggaatcgccagatttaacaaataaaaattcagcacacccagctaaatttaaatttcatatacacatgattttttagtatgtgtcccagatattgcatgcctcataatgtcgtttagtattgcgtgggacatacttatgctaaaaaataaagtgtaatttatctgaaattcaaatgtaatggggtaccttgtattttacctggtcatcttaatagggacagaatattacgttgttggaaacactgggaagtttcacttgaaacaagtgatgtaagg

SEQ ID NO: 123906 - DNA, 1051 bp, Homo sapiens
gtctcgaactcttgacctcaagtgatccgcctgactcggcctcccaaaatgctgggattacaggcattgagtcaccacgcgtgaccctctccttgcttcttaacacattagattgaactgtgacttgtaactctagtctttgccctaactctgttgcttcagacctatttcagaccctggataggaccacagtcctacccctcactgacttaatcatccccaacccaggcactaggtgttatttgatgtgacttatctgttgggtttgccctgactgcctcttttttttccttttcaaacactttcatagtttccaggacaccttttctgcagatttccctccagcccctagcctctccagttcctggctttttcttaacattgctgttctttggtaaagtgtcaccactcagtgtctgatgccttaacttactaggtcccatttcttttctcctagaaagacagtgctcttaagatggcgaaccacaccattctagaaagaggtcagggttatatttctgtcttgggatggtgggtcattaagcctcattaagttatgcaaatcctaaagtcctggcaccttcaggggctctagaatatccagcacgtgaatcacagagccttgtgggtgtgagctgcctctgcacacggtggggagagcctgatcaatgtcaggaagctttgggaaaagataggatcggagcggaccttgagaacattcacattcaagacttgccctaatgccaacgctagacaatcagcctgcctgctggccctgacacctgccccagagagcagtgtagagccatgcctgtgtgacgagccccgagggtgtggcatgcctccctaaatgtctccaggttctctgcatgtgtagttttggatctgagagacagagggtggccttcttagagttctttcctcttcggagtagtcaaaggtgactgaggcatgacacagcctgatgcaaggtctctttctccttctgcagctttgatcacatgatgaagttctgcaacatttgcttttatactacaggcatcatgggctt

SEQ ID NO: 123907 - DNA, 1142 bp, Homo sapiens
tctgcattgtaacaagttgcaatgatgcaaatgcacattagagtttgagaagccctgctgaagaagacagaggctctgtattgcaggagagttcctgggacatcgcagatagagctcatggtggggaaatttggatgacagccttgaaaaccagaagtaactaattaaagaacagaaaaccatttctcctggtttttacaaatgactttcttacttctaggttctatttttaacctcaagtgctctttgaataaaaataagactgaaaaaaaaggtaaattggttcctgtaatttccttttcttctggtactttaacctctctcttgggactgtagagctcattaatccagtcccagagaaaattgtcatttttcattaatggcttcttaaccttcaccttatctgattaggtacagaattaagtctctcttgaacagcctccaatccccactcccctgccagctcattttctccagaaaggacctggaggatcaatattgcagaggaacctgagttgatcaatgggacaagatttcctttgcaacaccgcacggctcatgatgacttcctcggctgagctgtaatcgtggtggcaggctagagagcaagatgatgcatttgcaggaagctgtcgttctgcctgttgctctgatggaaaggatcacaggctggcccagctttgcagtgaccccaggctgaaatgtgttgttttagctccagccaaaatgcaaagtgtgattgggatctgccattctaaaatgaggcaatagagggtatctgtgtttatgagtttggatggatcagaaattgtggccaaatagaataaccttctcagagacaagagccatcctgcgggggcagtgtaacacatggaccgtatggcttcaggaacagatggagcctcatttgaattccaatatgtcacttgtttgtccccgattctttacaaagagcagaggagggacctatggtgtccctagtcaacatagtaaatatgattattgaagaaaagaagaggtgccaataattctttctagagtaatcctgagcaatcaaaaaatgagattacgctaccctgtggttatgcccaagcacacacactgtttttccccttgtccagaccaactatgattagatactg

SEQ ID NO: 123908 - DNA, 1013 bp, Homo sapiens
cctcatagaggagtggtaatgaagcccttttatccagctccatggctcatacagtgtcacagctgttggtgaaattgataggtgcccatggattaattcaagcccagtagagaagaaagcagccatcacctccaagcaagcctttgggattcctcattgtggctttctgctcagctcttctccagagggtgctggagtgggggaactcatgtcactcatcaaagttccacttcgatgaggaatgcctcattctagcaccaaagtgatgtctgcccacttatcaccaggtttcaagctgatttatgggcaacccaacttctttcatttggtttacacttttttttccttgaaagtcagcctttcctgttcgatgtgcgttttcttccccagtaattaacacaaggtcatgattgccgttttagggactctttctggtgtgggtttgcttgtgttccccaatggtagttctgattacattgtttcacctgattattaatgatttttttcctgttaggcagctgtgcatttcatcctggccttcggcttgaattgttacaaattatgaattgatagacttcaaatcaaattttattgtgccttatgtaaatacttgggaaataattttttatttaaataaatcagcaccaaatagttttcttttgaacacatagacttcttttgcatttcttttttctgaattgtttttctgttgctgtgaatcttgaagatctaagtgatgaatgatagttacctttttttaaccaagttgttcattgcaagtatttttttgctatcgttgttttaagtgaattcaaatttgacctaaggagacagtggttatcatatgcgttattgggttttgtcttaaactttgtgaacattatggaaaaaaaaaatgcttaaacctgcagatgttgggggtgggtgtgtgtgcgtgcatttgtatacataagtgtgtacatgagtttaattgagctgttaagaacaagaagccttcaaggtgggaacaaaag

SEQ ID NO: 123909 - DNA, 1007 bp, Homo sapiens
gttgggaaagaatgaggaaagaacgattgcccggaagcgtttcactgtcctgaggagagtgagcctgaagattgtagaaggcagttgcagaggttgtctgtcatcctggacaagagacgcacttgttgcagacgtttgcttgaggacagaagagactggggctgctgttgcctattctgtttcatggctttactctgagagccctgaaagcattgaccctttgcttcagtcatccattgagttattcccacccaaccccaacgtgggttcagaaccctttcagagacatctccaacttgtatttgtgtctaagagtgttagtctcctttgtcagactatgaagaagccttgtcaaggcaggagggaaaagtgctcttggcagcctcacaaatctggctttagctgaaaggtattttttgtttgttttctttaatcctcgtcaactggacatggtgcggttaagagaggcaagtatgtgtgagcctggacagctttccagctctaggggcagaggaggtttgatagcccttcatggcagggtgcatgcgaagagttttgcttgccggcatagataaacttgactatgtctgctctactcaatttgatgtatagtttgaaaggtaatgctgtattacgaataaaataatgggtatatctacctaaaaaggagaaattacaatgggttggtggctggtaggacttttagagtttgagctatcaacaggaaacttggatcttgtgtttttgtgttttctttttttttttttttatggtaagggaggttattctactgtgtggttcaagcagatatacccctcagccactgcaaggatatcagtgtttcaagcatgtgctaggcttcagaatataaagactagaatgttttaggttcaaaaagagcttgttatacatttaaaatatgggttttgcctgtaatgtgtgccagagagacagacctgagaaccacactcatgctgaaggaccaggatatctgaacctgattaccg

SEQ ID NO: 123910 - DNA, 1085 bp, Homo sapiens
atatagatagcttggcactgacatttgtgggaatatttgcaccatagaaatcggcagaactataaatcagggctttttttcctcccacctactgcctcccctgccacacaagagctggttgttaaccattttccagcacagcaccattggcaccgtcactgtggacgggggtagagagctacagtcatcttgtgcaggttgtatgtccaccccagggcatgtggttctcttgccagaagaacaaggcaccaactcatcagacacagacaccagccatcacagggcattcccggtgaatgcatacgtgttcaattggtctttgcaggcatcacatagaacatgctctacgctacaaggtgagttgggagatgaggaagagaccttgtccttcaacccagtcacagtctagtgatggtgagttctgcatgttatccaaacaagaacaaacccagagctggtgtgtgcagggccccgcgggagcagaggcaccagctgtgctgcctgtgagtcctgtcccagggcagtggcctgggcaggcggggtcaggggaggaggtttctggctggactccctgatccaattccagggctttgaggatttctgaatatgccatgcctctcccagccagtcctttcaccagggtaattatgatgttcataaatgagattgttcatgtacaatttctacaccagtagccaatttctttaaatggaaaggaacagattatatatacctatgtctccaactagagctgaacatgattagtgagagaaaatgcaggcataacgccaatgccttcatactggattaccatgcacctgatggactcccccagggacacacagggagaagcatgtcttttgggcttggatatcgcctgcaacgttgtgacaggctgttaacacaggtctccaccacagcctctcccaatgcgtcctccatctgacacaccataaggctttttaaagcacgctcaaacagtgagatgccctttcattcaacttggtagacatctattgagcaccttctgttaccatgtaccaggcattgatgggagcccagttctgacccaaggctaggttttc

SEQ ID NO: 123911 - DNA, 1184 bp, Homo sapiens
tagcaagccttgtgtattttgagtaataatccatttattttttaaatgtatctatctgcctgcctgtctgtctgtctgtctgtctgcctgcctgcctgcctgcctgcctgcctgccgcctgcctgcctgcctgcctgcctgcctgcctgcctgcctgcctatctatctatctatctatctatctatctatctatctatctatctatctctgtctatcttttttactgtgaatctgtgtccctggtacaagaaatgaccttacgttttaaatagggaatttagtcactctaaatttcaaacaggtggccctaaagaatcagcaagtttaggaatacacatgtgatactgaattgtatgaatggatgcttggcttaagtcaagttgtcttagctattcatatggtttataaataaattaattcgcaaagtgcccatttgtttttggaagcattaaatttcacttctgacttaagttacggcttttaaattaggttgtgagtttgactttggtgtcttgtaaggttataaggcgatcgtgtgtggtcttcatggtgcagtggatatttccaggaggtaaacaagacaagccattggggtatagaaaaaacaaacctgagagcttctatttatgttccttttatctcatctcgtatcatgccatcatattctatcatatcataaatgtctggataggacattttatatattttttaaattatataaaatacaaattttacatatataaaagttgtatatgctaatggtgcatatttaattttttttttaaggaatcaaaaacattgaaagaccactgccttagctatgggttttggtttcaccatactggagatagaatttatatagcacacttaaagtaagggggaaatagttttatgaaaacaagctctaaagcaaggaaatcctaatggcaaaaaatatttttgtatttttctctatttcagtttatcttgggcccagatgggatctgaggcattgtcaaacattttgagaactcccttctctggtcctattctggttctcctgaaaggagggaaaatattagattaaaagtattctccaattccacagtctgttttgaaggaaaaatcctagaaacgctttggtagatacagtgttttatcatactgtttggtagatacagtgttttatcatactgtttggtag

SEQ ID NO: 123912 - DNA, 1027 bp, Homo sapiens
gttgactgagatttaaaagatgtttataattttaaatgtctttttaccctctagcagttggtctctatttaagcagaatttaaatttaacaaagcaatactgattacgctttttcattgaaacctgcatttatgtgacttgcatacacctatggagattccaaaatctgttagtttgcagtgtgaaatcctgtatgtttctactgtcataacccctacccaaatttcaagtggatggttacgaattggatttctcatttggagttaagaaataagaaacaggatttggaatcagagtccacaagagtactatatttttttttgattgatggtaaagacttgctaagtttatggcaggattgtggagatatttttctcaggatgcattagtgtatttgtttctggtggaaattaagatgggcaacaaattcagaaagcaaggcagatttttatccatcacaaattaattaaattatttagaacaaactccaaatgaaactcaagaattaaccatctaagacaactggcatctcaatgccgggtgcaatgaagggtaggtagtctaatgtcactgaaggacctagaagcacctccatccaggtatacccagtgatgctctgtgccttcttccccagaggaagcacctccatccagatgcaccccagcaatgacctttgcctatgtccccggaggaaggcttcctagggctttgggccaagcgatagtggaagcatttttaaacaatccgaagcgggaagggaagattcctccctctagaggaggagtcctggctactggaaaaagagaatacagtagaaagggagggtgatgatcctgggtggctcgtgggcacctcatggtgataagccagtgcaaactatccccaggtttgagagaatcctcgccaggattctccgtttctggtatccccataggtgttagcagggctgttcgcttttcctggttccttttccttgctctaaataattgacagacttcctctgtcaattatttcacagtaaccaagg

SEQ ID NO: 123913 - DNA, 1087 bp, Homo sapiens
atttggaaatccatttaaatcttcacagaggactgtaaccaaaaataagtgtaagatggattgagtagctaaaaacaaaattaactatagaaaaactagataaaatgagtgaacatttatcagttttctgcaggataagaaataagcgtagaaggaagccctaagtttaaacattatgaaagaaattacagttcttacttcatcgtaatttaaacctccaataagctaagaataaaaataaacaaactgaaaaagttggtcactctaaatggaataggcgagatgttattctatttaagaaagcaatatgcaagggataaaggcacaatcaataaaaaagtcatggaggggaaacagcatttaataaatactttaaaacatgcagcttcatggccattcagaaatgcagtttaatgtaagactgtataaagatttaattttgcttttcattgtttttaaatgagaattcttattgctgacaaacatgtagtgaaatgggtatttatatatattgctagtaagaatataaacagctacaaatattttggcaatatttggcaatacaagcaatttgtcaatattcactaggtaccttaaaatgtttgtttctggaatgcagaaatgttgtttctgggaatatattgcaaagaaataacccaaaattcaggaaaaaaaaaggtttgtgcccagaattgctaaacattgcactatttattcttgaaaaaacacaaagaagcctaaatataataatgaggcaattaggtaataattatgatatgtctagtataattatgagaaggatatttatattctaatatggcaactgaatatgatttcacattaaaggctagaaaagagcatataaaatagatttaaaataaaatctcaactactgtatatttatttttaacttttattttaagttcagggatacatgtgcaggtttgttatataggtaaacttgtgtcatggggcttcttgtacagattattttgtcaccaggtattaaagctactacctcttagttatttttcctgatcctctccctactcccaccctccgccatctgataggcctcagtgtgtat

SEQ ID NO: 123914 - DNA, 1147 bp, Homo sapiens
tcccaacatatataggtggtgaagtccaaagctgaagttgccccagataagagaactctcctgttttctaggactgtgagaggttattgctctcttgtgtcaattttagttgtgttttttctttctgtattttgcttgtcttatgattcaagacatgaacataaatatacatttgaaaatttccaccaagaggtggaaaagtttatagattcagagaagataactttgtacaaaacaaaagtctaaaaatggttgttggatactctcaggtatttggagaatctgccaacccgtttgcaggaaatttgttttcaaatgggaaaggatagaacagcctgaagatgggagtgcagtcattttgagttacttccgttattgcagccaagggaagtcactttttagggaagacaatggacgtagagttttcatctctgaactgccactctcagtctttgaggtctcatggaggaaaaaaagtgtcataagactggagataagtaaaattccttgtttttaaaagttgagaagtgtaaatactagaactttcattctggcacgcaggagttttttccttccaagtgttttaacgtaggaagtaataaatgatcccatggagccaggatgtgtgcgccaaaactaaatcatgttgagttaacctcacttatttcattggtaccgttactgggtgagtcagttgagaaagtgccagagcaagggtgatcctgtaaagtaaacatttgacagactgcgtcaccacatccttgtgtatatgatggtgacctggggattgggaccagatgggttcatagctaatggaacaacagaataagcttgtattcacttccatatgaaatagaaggtgggactaacgctgtctttcctttttttttcttctctttctccttcttgtccacattcctttttaatttccatgaagaaaattaatttaaattgacttctcatatttcaagaaccctttgatcatttttttgatgttggatttcagcagttttaaaaacttctgtcttcatttaattttttaatggcattactaagatataatttacataccataaattcacccattttaagtgtatagttcaatgagttttggtaaatttggcgttgtgtaaccatcaccaaaatc

SEQ ID NO: 123915 - DNA, 1033 bp, Homo sapiens
tgtcctgcgtcccaggagtaagtcatcaggctcatttcttttcttgtctcttttctgctgggggaagggcaggttgcaaggcggatggtgagcagattcttcggccttttgtgtgggtagcctgcataggaaccatttctatgcctgtgagtccatttctagcatctgcctccagcctctgctttcctgacgctctcccatcaccccattcacccttcataaaacagtcactctttctagatgcataattacatgccatgacaatgattacagtcctctcttcataactgcactgggtgctcattcatggcatggaggtatgatcgcatcgtttgtagcatagagcagagtacccagcactgaatatgtgttgtggcctagagaagagatgggcacaagaagtcaggtcatcagggttgcctcatcgctggcctcctggccagggcctcaagggtgacattccttgagggcgaggtgtttctcaatctcgatgttgagattttgggcccattaatcctttattgtggaagaggccaacctgtgcagaatcggatgctcagccacattcctggcctctaactgttacatgccaggagtagtcaccccactcctacttgtgacagccaaaaatcccctagagggacaaacttgcccacagctgagaaccactgcttgagggggaattcccggctctgtcaggtacactcaggaatccggttggtccgatcaaagcaaacccatttctgaggactaatagggtcctaaccaaagtggcaattcattaatttaaatgaagaaatactttacatgggaattgaaaaataatagtaaaccaacttaaaagtagacacgtggccgtaaagtattcaaatatttagtgctttctgccctgataagtctgcgtgggggtcatgctggcaccaaggcagcccggtgcagtgaggaaatgggccaggctcggtggcctgataggaccccttccacacccagatctgtgcagacaggccctcctcgttcccctccccacccacca

SEQ ID NO: 123916 - DNA, 1004 bp, Homo sapiens
tgggggtatgactttttttggggggtgggcagggtctcgctctgtcacccaggctggagggcagtggcgccatcatggctcactgcaacctctaactcctaagctcaagcatcctcctgcctcagcccccctcccccagcagctgggactgcaggcgtgagccaccgcgcctgccctggcggtatcacttctaatagaagcatttattggccaatgaaacaggatacttctttcattgaacaattttataaattgttcacacacagcataaactgtgctgggcagggagggatcaagtggttagctgttgactgttgtccattttatatattttttgtaccttccatgctggttgagcataaggatggtaaacatttgttaattaactaaatgggaagagtggaatttctaacgcaggagacacagaggaagagaaggcttgtgtattctctttctgaaagaacaatctgagagagagaatctctcaaggttcccattcatagtgaattactcatagatttccaggtgacaacagctccccccacatcgactcaaagtatagcattttaaaaaagaaaaactacctgcgtccaattacatacccattagttcactgaatatcctcatgtcctttggagctgatttcccataatacactgcaagtctctgtcttgttctgataaaaacaagtgggtttcaaccccctacagctttcttaatagtaacagcagtgcatccagaaactagtggtggctctagagacccaacacgaacagtgttgagacctcgttgcagcactttctctgtgttttctgatgtcatgaaactcttcttagtagaattattttcccccacttaagttccaccgtcagcctggaaattatatggacaacatgacaaagttcctctggaaaaccacactcctctgcttggctgaccttgggagaaaacatttagcaagttcttctttttcttggttattttaaactcagatgatatcagca

SEQ ID NO: 123917 - DNA, 1621 bp, Homo sapiens
gaccgaggagaggtgaggggagagttttgagggtgggcatattgatcctacgcttgctgaattaaaaatgagccaactgaggacaatttccaggttgcaacacagacggagccggagtctgggttgaggttagaggagccgttagggcgcagggatgcaacaggatttgggagaaaggggagagaaagcaaggccacttccagggggctttcattttttttttatcctggcagcttcccgagccagatttcaaaagcgatttcaaacgtgaagccaactgaagcactgccttacactaattggaaggggaagggagtgactcatattacaccagctcgctcttccctctcggcaactgctaacttgtagctttaaaaggaagtgacatgggtggggagagacgtcagctgaggaccactttttttttttttttcttcctgaagggtccaccccatgggtggagtctcgctttttctttccagtgttggctgacttacagctcttataaactagtggcaatttctgaacccagccggctccatctcagcttctggtttctaagtccatgtgccaaaggctgccaggaaggaggtatgtggtcctggtgccgttcgcaggcaccttccccgctgggtgtggctgatgtttgcattcctcttcccagcatatttttctctcctgggctggatttccttaggacctctggaaggggtaggctccgggggcggggggggagtgcaaggcgggcgggggaaaggtgcagggggcgcctggagggaggcgaagagaggctctgctggtacaaaaggaccctcgctttgtgctgggccgggtgagcgtccctttctgggctgtgatttcaagctgctgttcctggcttcatttacccacccacccagccccctcccggggctaaagcattttctctgctatagacgaagctgggcggggggtggtggtggggggaatgttcctattacatattgctctcttttgtgtcatgcaacatgttcttccgtcgctgacgtttctatggcaaccacaaaaatactacacaatatgcagccccgatatacattgatttatttgtattttgtgtctagtttgcagctttctgctctgcttcttgctttggtttgctaaaatccagcatggcttgtggctacccctcctcactttcattttggtttttccctatcacaggaggggtgggggaggggagttgtcaaggaaacaggcattggtaattacctctctatttacctaattttcggcctatgaatttctccatatcgaggaattaaaaaaagaatgctttgatgtttatgtaagtcttcagtgtctggtctttttttagaaaacctaaacacttcttaagataagatattgatcctgtggtcaagctaagggggaattaattccttacaggaggtgagatcattgaaataaagttttagagagcattggagaattcgcactgataaatgtgatattgcctgcccaggtttgcctaaaagcttaaatatttaaaagatgggtctttgctctcatctgcacttatttagctccaaatcttaagttcaacaagtatgagtaacaaattaactgccgggcaggattc

SEQ ID NO: 123918 - DNA, 1038 bp, Homo sapiens
ctattttgccccagcatctcaccgcagagccgtctctcagccattgactgccttcacacacaaatgcagtcccagtattgggagatgggtgtaatttattattcccggagatctagatccccggttatttgggagtgtattttctgaactgcttgttggtttaagtaaagcaggtttgatgccacttctcttgaatccatgaccctggacccgccgcctaagtggatgtgcagatgggatggaacggctgcgacagatctccattaaagccagcgcgtcgttcgggctcggccttgcgctgtgaaaagctgagtcagtgccaggacagcacccgcccctctgcagtgcgtttccaaggcactcagcttgtgtgcgaaggtttgctctggggcagcagaaatggcccttggcaggtcgtcaaaggcccggtttcatttcctcctcttccaggcaagttgctcaaaggctcacagccttttcgtcgcctgccacacagagccagtaagatctaccaagctataaataatgaaatgagtgtgtgtttcgccgtttgtaagttgcaaagtattacaaaatggtgaaacttgggggtttgggtttttaaggctgaatgctaaaactgtcaggcactgtggagagaggaaaggaaagataagattgactgggattgaaagacaagtgaaggcatgcttgcgtgggtacacacacagtgacaccacacgcctgcccctggaggccgatcctgaccatgcagacctggggctggggctctccaagcgctctcctgcactgcagaaacccttcttctcttctggactgtcactccagcacggcagagcaccaaggctctgcaacgcacttccctggggtgcagcttccggccaggggcgtcctccctctgcaggagcctcagcacccccggggggttccctccacccccaggagttctgccttgaggggcatggcctgcgggtcccctgagctcgctcacctgtgggggtcacggcctgcgggtcccctgagctcactcacctgtag

SEQ ID NO: 123919 - DNA, 1224 bp, Homo sapiens
agaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggactgtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccag

SEQ ID NO: 123920 - DNA, 1041 bp, Homo sapiens
agcccctagtcactgggtcccctttccctggacctagtctctttacaatgaggtcccagataccagcctctaatcatcaggacaaacggctatcccccaactccagtttcctccccacccatcacctccctcctaagccagcgtgagtcacagacgcagatccttaaccctctcttgctttttgtcaccttgtccctcgcgttcagatctgttcaagctcatcctcaaaatagctggccttggttttattctgttttaaaaccttgccttcttcaccctttttccccataacccctatcactcctcaaaataaaactttacccccaaaaaactgttcagagtcccagtcccagccttatatggtctgaccctgtcctgcagctcagacccggtttgtttctcaagatcatgaccacattcaccatccaactcctgtctgtgcaacctgcctaaagagtccttgcccagttggataaataaatatctttcatttgcagaaatcttgagaaagcaaggactctggggttttgttttgtttttttccactctctctactcctttttctttggttctctcattcattcagtcatttgttctttaaatctattgtttatttacagttcctgagatcctagttgcaccaggaaatatactagataataaggttacaaagaaatacatttctgctttgagaagatcgtaattcctggggtcctaaaatacagctgttacagttacacaaccaccaacttttcatagaccttaatgattcccaaaatgctggcacgttggttgtctcaattagtcctctctacaaccctgtcaggaaggtattctatttgtcaccattttatagaggagggaacaaaaggtcaggaaagttaaataatttccccaagatagcccagctttcagtgatggatctgggagataagcccacctcccatgctcgttgtaaagtagtgctttccccgccttctcatgagatgtcttacaggggaaagtcattcttaagttaaaaacaacagcagcagcaaggcc

SEQ ID NO: 123921 - DNA, 1025 bp, Homo sapiens
ctcttgctaacagaacagattttttttttttttcaagtgtggaccagtttgggaaatgacctcattttccgggtcagtagtgagttctgagtagtctaaaccagtcttgctaatcccttgacccttactagtgatcaggtttcagaagatccaggcccttctagagttcattgccctactgagttcatcagctctgaagccactccatggttggactgcctgtcatgggatatgatacatttcctttctatttaagccagttaaattggggctttctgtttctccaatcaaaatctcttaatgggcacacaggcatttatttctcttaataatgaccaaaggaattcatttactaaggactttgggcagatattggggaaaaaaaagaagtatttgatgagagcgttttagtagcaaacaaaatcacctccagattattatattccataatatggttgtgtccactgtaactgtaatcagcaataaaaaaaaaaaatctttttgttcctctctggctaaatggattgtagtaggctccattatattattctgacgttagttccgtggtgtgtggccagttcctaagactgcagtggcttaaggggatgggagtttatttctctctctcataaaatgtctggagctgggatgctccactccaccaagcctttagttgccctcatctacatggtgcaaggtggctcagccccaggtccacttttcaaccagaaacaaaggggaaagagaagaggacattcccagtctctttaaaggtcaaatctggaagtagcacacaacatcgtactcgtattccgacagagaaaagttacttgtgaggctacatggccagcccccaaagcagttgggaaatatctgtattcggggtgcgatgtgcccagctagaaactgttcctatgaagaaaagggcaaatggatgatgagcggacaaatgtcagcctctgcctcatctggtgtcttttctgtctccttttatcattactcaaataccattcacttgtgtgcag

SEQ ID NO: 123922 - DNA, 1048 bp, Homo sapiens
tgatttggatctcttttccagaagattccacaactactagaagatgagatgctttttggcattgggtcacctgaaatatctggaaaaaaaaaaaccaaaaacttcttaaactgtgcttccggatatgatctgttgcttgttttttttgtttactggtttttttttttttttttaggtcttgtttgatgttgcctctttgcatttgatttcagccatcttgatagttttttctatgcaattaacaaggtccagccctttctctagccaattcacttcatcagtagctgacagatgttcagggatgaagaaaacattattagcaacagaatagagaagaaaaacagcagggtcatgggggccaccacttaggctgtcacagatgctctcaggctaactacctgcaaatgaaaaaaaaaggaagatgaagattactgacaatctaaggagtgcttcttttttgaaaaaaatttctaatgcgtatagaaaatgggacattatctgcatagcaaggagaaatggctaaatcataagctgatgttcctctctgacgttattatagtttttttaatccaaagaggaagttctataataaactatttttcattagtttctaaaagatggcagaggaatagtgagctgaattttcttttttttttttttgagaaagtctcattctgttgcccaagctagagtgcagtggtgtgatcacagctcactgaagccttgaacttctaggctcaaatgatcctctcacctcagcctcctgagtagctgggactacaggtacatgccaccatgcccaggtaatttttttttaattttttgtcgaaatggggtcttgctgtgttgcctaggctggcctcaaactcctggtctcaaacgatcctcccacgtcagcctcccaaagtgcttggattacagacatgagtcactatacctgactgaattttttttaatagaagggaataagagaaagaggcagctgggtattgtggaaagcgtggtcttgaaagtttcagccttagttctaatgcagcactgtgggttc

SEQ ID NO: 123923 - DNA, 1036 bp, Homo sapiens
cttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactag

SEQ ID NO: 123924 - DNA, 1030 bp, Homo sapiens
atatatataaataaaacccaagataaaggaaggcaggggattcagtaagaaaattccagaaagacagcttggaagcggatctgaaaaggaaggagtcaacttagagcagtcagttaacgagacactgaatgagctgggagagctgagcactcccgtggggaatccctgtgttgcttctgtcaacaagaagaaggaaaggcagctttgacactcaggaaaagcaaaagtctacaccagaaacctgtccatagacatacagcaaaaagatttttcaaagttagtgtaaggaataattattcgtttgatctgaatttcagaaaattcctcctggggtgacccaggtttaggaacacaagaatgagactgtaccttcaggctccagccagcaaacgtagttagttagtgtcacgagtgtgtctatttcacttccagcatccactcagaggcaaggcatgtaatcatggttgttaacagaataaaacgtaaatgtaacaaatcttgaaaatgtaacaataatggtatagttgaaaaaaagctgggaagtggagggagacgaggtgaaaataccgcccaggctcctgtttctttattttacgtggtggatattcaaggtggggaccaaacttcgcagatggagatgtagctaagcattaaacaaaatttaagtccgtgtaagagttaaaaattagaatgtcaatcagaaattgggaggggaagaatgcagcagcagagccatccacaccttgacctccacggctgcagtcctatcctgactccccccacatcagacctcccattcccttgccttttgtcctctgcatctcaaggtctgtctctgcagctcggcctctgcacaaccccatcttgctggccacacgctcttcttgacccacacccccatccccagtccctgtttcccaagaggatacagagatggtgttggctgaatctgcgacttggcacatcccaagttcaggctttcacagaggcccaccccctgcggtcttacctcacagggaatgtgttttta

SEQ ID NO: 123925 - DNA, 1030 bp, Homo sapiens
ctgggcaattctcctgcctcagcctccctgggaggattacaggtgcctgctaccatgccaggctaattttttgtatttttagtagagatggggtttcaccatgttggccaggctggtctcaaagtcctgacttcaggtgatccacccgcctcgtccacccaaactgctgggattataggcatgagccaccgcacccggcctatcccatgtctttaaaacaaaataacatattactttttaaaattctgagggttatgaatttggaaagggccccatgaggacagtgtggtgctcttcctgtatgagttctgctggagatgtggtgtctcagagacctcatctgcttaggtgtctggagctcagctaggaggtgaggatggctggcagccaactggaatggcttgactggggctgtagtcctggggcctcagttcttgggtcagctgggttctgtgctcttctccatgtagcctccagggctctctatctccacgtggcccctccataccacctctccacgtgctgtgttcttcttgcagctgtacttcttagttcaggggtgtccaggagtgcaaatgcaggacctaccagcactcctgaggccaagttctgaagcgtccgtcacattctcttggtgaaggccagtcacaggcccagctcagattcacgagggtgggggggtacaggggcatgccttttgccaagaatggtttactggtgaccaccagtagagcagactacaagaagattatttctgcttttgttacgttgccatagaaatagtttaaacattttattggtagtcagaggtttgcacctactactttatggcttctggttttaacgtccgctcaaggaagatatcaccagtgcaatcttagaaaatttttcatcatccaactttttttttttttttttaggacagattctcctctgtcgtccaggctggagtgcagtggtgtgatctccactcactgcaactgctgcctcctgggttcaagcaattctcctgcctcagcctcccaagtag

SEQ ID NO: 123926 - DNA, 1073 bp, Homo sapiens
aaattgttaaaagtataattttttaaaacaaagtcatgactctcaggcaaatataaatgaacacatcaaagattttatttaaattttgaggaaactagtcagatgttaaaaaccagttcaaaggaattgcaaagggaagtcatctctaggcaatcacaaatgctgaaacgtatctgacaataaatgcaaagtggtttttgttgaggaggaaagaatcactcacatttctaaaacatagacaaaatctatttgtgtctctacagacacaaataatttgcattaattttaaagttatacagtggctcaaacactgtaagtggcacatacccataaatcagatgacaggattggcatttcataacacacccactcatcttgtttctttcgtttcaacgtccttcaaaatttcttcttactttctatcccaatttatgattataataatctcaaaatttaataatcacaaaaaatattggactcatttgtttgggcctaattagttatatggtggtggtaggactgttaatttactatataggcctccttgactttacttcttccatctagaaccatacaatgtaactactaaaaccacaaatgtttttataaggaatttcaaattgtgttttaaaattgctcttatttattattctgtgactataaaactaagctcaaggctgtctttactaggttatacctgtataacatgtaaatttgggtaaactctcttgaagtcctgaaaatgtattaatgcttctaatgtgccaggattttacctgtcttcccatctgtatcgctggagcctggtaagccagtttccctgagagtgttctgtggacccatgcaaaatcaacagttgttccttaagagcagaatgtcagatctgatgaaataagaaccattctcaaatgtgatgctttatattgacctagattgcccaatttattttatattgacctaggttgcccaatttattttatattgacctaggttgtccaattatttttctggtaaaaagtaggacagatttttactgatttctgtgcagactattacattgccatgaaaagtaa

SEQ ID NO: 123927 - DNA, 1045 bp, Homo sapiens
tcttcatgagcattacggtggctccgccgcctcggatgctgtcaggctttcattctggtgcctgtgcactggcattccattcagactcactgacaatgttatgtgctttcttacgtgctggttagtgattcatatttttcttttcgtgatgtctcttcttgtattttgttcactttcaaattaggttcattaggaaatgtatatattgttctggaagctttgatctatttattacatatcagtactttatcaggtgtatgttttggaactattttcttatagtctggagtttggtaattcattttcttcatattttttatgaacagatgttttaatttctaagtttattactttttaatgatattgtggtctctaacctgtcaaagaaacctttgcctaatcccaactcatgaaatattctcctatttttttttccagaagctccatagttttggcattcacatttaggtttaggatccaacatatgtaaattttatgatagtgtgaggtatggatatctatatggatatgcagttgttacttttttatttggatgactatgatacatttgttgaaaatcaaatgaccatgtcatgtatgtgtaggtctatttctgagccctaaattccaaataagcctgtttctatataaagacagagtaaagataccattagtagcaatacccacttaggtttagacatggtacatttggcagattttctaggttttttgacataaagatttggaatttccagagtaattgtacattcctggaaaatgtttagtttctaatatatgtaaaaattagtattaccattttttctggagaaataggcctctagtgtcctagtaaacttggtagaaaattttagatttagagatgattaagcttggtgagatcattttaatttaaaaaataaaagaaaattttagatggcacataggcttctgatattgttctgtaactcactagcctttctgctatacttcattataataaatatttcaatataaatacaattactggattccaaatggtagcagt

SEQ ID NO: 123928 - DNA, 1026 bp, Homo sapiens
tatccagctacctgcgtaaatgcatcagtaaagccgggtgggaaacggagaggttaattgactttacttgggtcacccggcgagaaagaaaccaaactgagagtttaatctggggaacttgagctcagattcttgctgaaagcactcacattgagtcacattagttttcttataaggttgagggagagttgacacttactctgcaggctttccctgaaaagagtaaaattcactggactctgttttctaaagtggggattaagattctagaactggattagaagtgaaacatggagttttcccttgctgaaaagaaaatggaagagtattgcgtactgggaaaaaggaaattatgaaaattaaaagggaaatgctcatagaatatgatttgtaaagtgactagttagccaagtgggtttgttgtagggcacgatactcactgatgccagagtctatggcatgcactgggcatggtccacttgaatctctgagtatgattaaaacccttcagtcatttgttggtatgattgaactacgggttctcccacggctagtttcaaagaattatatttctgtctagtgtcagaatgaccctattttttttaatgtgttatgaatcttcagttgtgcatacagaatttcatattaatttagaatgccatgctaataagcgtacactcagagatggccataatttaaagctagcagtagtatctcatggagaaatgaactctactcctcccataatgtgctacaaacaaatgagaaccatgctctttgtctttgtctctgaataggatatttttatttaaagtactttaggtaaaggtcagtataaaccaatatgacataatatgtctattgttcaatgttatcataaaaatataaactttgcataaacagagttcatgaaataaatggagtatgaccaaaaaattaagtcttgattatttgggtccccctgttctgggctcccttattagattcatttccttggggcagggaccatactttggtgcttagcat

SEQ ID NO: 123929 - DNA, 1140 bp, Homo sapiens
ccaaaggcatacctaactgactacctaatgttgagtgtttacattagttgaaaaataagcatgctgatgaattatttacaatgaatttttgtgtatttgtgtatgtattatgtatttacaatgcaatatcttgcaatttgtctctcttaatttcctctaatttatattaggcaaatgttagtatattagtgattggaattggatgctaaagagcaaactgtgtaagcatcccaagcctattttcatttgaaataatgtattttccttattggtttgttaggacaatttaatgagataatgaatgttacgcacttgtattgtgcctaacacacaataagcccttattggggaaaattttaagtgagttaataatttgttgttgtgtaagtaaccacatcagaacttagagcattaaaacagctattatagtttgcacatggttttgtgggtcaacaatttaggctggttgagtggttcatctttaatcaactgcagcaacggacgatgaagagaacacttccaaagggcctaattcattcttattttccacaacagtagttctcaactttctttgtgtattaatattacagatgcttgggctcctccacccccaaagattctgatctttgatgaagagaagtaccacacatttatattattttaaaagctccctagacaattctaatgtacagcagaaccaatttactagtttactttatttttccttttaaaacaaatatgtttgtttcttatttcgtaattacacactattataaaaaaatcaatttgtgacttaatcaggaaatatttcttgagtgccaaggatgaagactgtgtaaagaataaaacaaagcttacttatgaaacacacttaaaaataaccaccttaaacattttggtgtattacctaccagtcttcctacttttataacttagtgttcttttgtgacaagtgcttcgtaatacacttaaccgtttattctatatttggatttttaagtttctttttcagtatttaagtactaaatgtagcatgctgatcaatggcattgaaaagtcacctgtttgtgttttttcaattcgtttttgctttcacaaatgttatatctttggcctgcctggattgatgctatgtttata

SEQ ID NO: 123930 - DNA, 1076 bp, Homo sapiens
tctctttacttaggatgatattcattgtcagttgttgttttcataaaccccaagcaagtcagtacattgattcattgcatattgcatagaaaactatttaaatctatgctagtgttattttcttcctaagttcagtaaattagtgttgtgacagatatgtggcactgtagctttttcaattctgagattggtttttaatctatgatgcaaaccttgggcagttcaggggagtatcattgatttatgaatctcttctgcctcagtgtttaacaaagcttgtttgattttaatgggcaaaaagaaaactcttcttaagtaagatgtttctaatctcttgaagtattagtaccagagaccccaggcaaaagcaattctcaaaagctctctaggaggtagttttatatgagattatagcacatctaatattgtgcaaatattaaagaggtttaaaactcttaaattcattgattttttttcatcctaaggcaaatgataaaagtgcaaacatactgctttaggataagcctgtgggtaaatgtatcatgcaaaatatttacattaaaatgctgcatgacttaattttgcctgacttataatccctgggaacgctgaatatcatttcttcaaaaattctttctactttatgattcgtgtatttaatttgtcttctaacataactattatttttgtcttaatttgttgtaacttcaacaatagaggacatcaaaggatgcaagcttccttttgcttctaagcttcgtctcctccctactcagcattcattcagaggattagaatgtgaatgttaggattttacaagttattcatcctgcagtaaaggaatttggactccttctatgagcggcctctgatttgctggcttatgttttactgagctctgattggctattatgtgtgccgtcaccattagacatgaccacggatgtttgcaaagatctccattgctttacagtctctaagaataaggttttcaacaaatttataaaatgtatacaatttgtttgacttactctttttcaaatatgactctttacctaaagaaaataatattttaa

SEQ ID NO: 123931 - DNA, 1021 bp, Homo sapiens
atcattgcttcaaaaattctattagcatattttgtagtgtgcaccctagtatagtaatacttttgtgtaacttaaaaataaataaataaatgaatctatatttggggtccctgctcaagtcgactttttaattaacttccattttaaattgtggacacagagaacaaggtatttacatcatttagaaaagacagggattctgccttggggagataattgaatgcaatgttaccttattgacgtagtctatatttatttgagagtgacttctgcgtctgcttagtcataaaacattaccctgcaaaaaaggtttagattgagtttgaaactataaaatcatattttagattttgattggaatctcaatacaacctaccaatttttctttctccatctgtgttcatctgtctgtctctgtcccttatacctgcgcacacacatgcatacacgcacatatgtgcacacgtacgtacacgcatatttcacagacaggctggggcggaacccagcacaggcacggggatgtgcagggcagcctcctgagggccagcccagtgctggacccaaaccattctgggagtccagggaacaccaagctcagccttaccagacccaccagaggaatcagcaagatgaagagaacccacctctgacaagtacgagtggactttctcatgtttctgttttgtggcaggagcagagacaagatttcacattaggtgaaaatatttcagttacataacatatagtttcacataaactatagggttaaaaatgagtttaatttttagtataaatatacttttaaacttgacataaaattatatgtttttattatataccacgtgctgttttgaagtagacagacactgtggcacggttaaatttagcaaattatcaaatgtattacctcacttagttagcattttgctgggagaacacaccatccagtctctcagcattttccacaatacatcgtcattaactgtagtccccatgcatgcagtgtaatttaagtcag

SEQ ID NO: 123932 - DNA, 1047 bp, Homo sapiens
agtgtccacatctgtccatttggaataacaatggcaacgatcttacatggttgcagtgaaggttgagtaagtgaatgcatgaaaagtgttgagtttggtgcctggcacataaaaagcccttgctaaatggtagctgtcattaatcaaagtgaattggataaaaatcatacctagggaaaaatgatgctccttgtgtaaagctggttctaaatccctgtcttgatgttcagcccagcaggagggtccattccattgcttgcttgttgttgccatctttttatttgttgctttgtagttgtatatttacattcaggtgagttagtttgctagggccgccataccacagactgcgtggtttatatgttctcccaggtctggagtctagaactctgagatcactcggggtttactctgagtgcacagtgccagcaggtggtttttcctgaggcctgtctccttggcttgcggatggcacattctcactacacccccgcgtagcgtttcttctgggctcctgcaacgccagtatctctcctgtcctaatcttgccttcctataaggacaccattcagattagattcgggtccaccctaatgggttcattttaacttgatcacctctttaaaggccgtgtcccccaaaacattctgaggtatctgagtttagagctttagcatgtaaatgttgggggtgacacggttcacttcatagcacctggcatctgcattcccatcaccacacaccgtggactagatgatgagttccttggaggcagaatgtatcttattcttctctcgaagtcttgtccataagagaccctcaaaggagtatttactgtgcattgaattcatacagatgtccaagcatgtgtgagggcgacttagagaaacccctgcaggtgattttgatgcttggtctctgtgactggacataggcatgttttcgggaagttgtttctcttttgtaagatctgccattacagaaatagtctattccatgttctcactagagatttaggatgtttagaaaaataatactgaaagtctg

SEQ ID NO: 123933 - DNA, 1039 bp, Homo sapiens
agacatcaatgactttagagattgttttctgtatagtgagaatgacacgtgacagatacttggacagatatgtccagaaattctaaggtctttagtatcatttttaatttttttttttttttttgagccagagtttcactcttgtcacccaggctggagtgcaatggcgcaatctcggctcactgcaacctctgcctcctgggttcaagtgattctcgtgcctcagcctccagagtagctgggattacaggcacccaccaccatgcccagctaatttttatatttttagtagaggcggggtttaaccatgttggccaggctggtctcgaactcctgacctcaggtgatcacctgcctcagcctccctgagtgctgggcttacggacatgagccaccacgcccagccagttaatatactcttataattttaacttggggaaactgagttgacttacattgtttcaacttttggcacctttttcaggattgtattctgcctacctatattattggggttgtaataaacattaatgggatctttgaatttatttaaattcatggccgggcatggtggcttaggaggctgaggcaggagaattgcttgaacccgtgaggcagagattgcagcgagctgagatcacaccattgcacttcagcctgtgtgacagagcaagactctatctcaaaaaataaaaaataaaaaataaaataaattcagctgggtgcagtggctcacgcctgtaatcccagcactttgggaggccaaggcgggtggatcacctgaggtcaggagttcgagagcagcttggccaacctggtgaaaccccgtctgtactaaaaatacaaaaattagctgggcatggtggtgggcgcctataatcccagctactcgggaggttgaggtaggagaaccacttgaacctggaggttgcagtgagctgagatcaggccattgcactctagcctgggcgacagagggagactccatctcaaaacaaaacaaaataaaataaattcgcaacaatttttttttgagaaa

SEQ ID NO: 123934 - DNA, 1029 bp, Homo sapiens
aggacctgaagtcaatgtcattacctcacacgccactccagtgggctgcgtgacatggcaccgtcgcagcatgacacacagggaagtgtttctagtttccagaacatttctgaaacccacatcttccttctacatctttgtaagaacttaaatatggtgtgatgttattgcacatccaccagagacttgacgctttctgtttaaaacctaacatatgcttagatattaataaaatagactctagaaccaactcctctgaaatgggcctgtaacagatgctgtactgctcagaaactttaccaagtagctgtagagcccagcctcgcctggtgacttacatacccctaggagagtctttaaccaaagactgacaaggatgggggtgtttacttcagctcctccttctcccaactctcatcatctgcccatcccccaaacgggacaactctgagaagtgtctctagagttctcttgtagcaatgagccaaaataacccttcataagaatttacctaatgacacacccttgttgggcttccttcctttccctgtctagcccccagacgctctatttctttctcccttgggacagcccttcctaataattcacttccacttagtgtctgcttctaggaaatcctacctaagacaggcttcgttccacctaaaggccgaagctactgtgatattttacaatccttgacttttagctacatactcattattattatcattcttactttatcctttacactaccttgatcactggagtaaccttaacctatctgcacatagatctttattttctattgtgaaggtgatattattaggaaccaccaactgaaattttaccacctctataaaacaccagacaaacggtgagacatatttagcttcatcatccactgtgtggctttttctttttgttttacattaatccctattaaagagattattggctgggtgcggtggctcacgcctgcaatcccagcactttgggaggccgaggcagatgatcacctgagggcag

SEQ ID NO: 123935 - DNA, 1252 bp, Homo sapiens
tttttcctaacatgcctttttttttttttctagcagttcagtacataggaatttgaatgtgggtcagaatatcactaattttgattattattacaaaggattattattattacaaaggattattattacttacttatttcacacttgctgtataattgtcaaaattgttatccttcattgtagaaacattttaaattactgctgagttagcttaactgaagtttaacctaaattcttaatgtattcaatacctcaaggtgaaccccctcccacccattgtattgattgtggaaaaaaaagcttatatattaggtgatatttggtattaaaattttcagagtacacagaagagatgaacatgagtccatttaaatgttccttttagtcatttttttcttcacaagaataatcttacaattgcatcgtttaagaatacttgatgtgatagatgtcctaaataccctgacttcatcattacacattcaatgcacgtaacaacatatcacatgggcaccataaatatgtacaactattatgtatccgtgaaaaattttttaaatttaatttaaaaaaattaagaagaggatactcagcacttagcaaagcagaacacgacatgtggccagtttagatgatactaacaaaaatgtacctataaagaaaaacaaagttctgatgtgacacttacaaaaaaaaaagaaagtatcattctgcctgtgtattcctagctgtgtttgcctacctctgtcccttgcctctatccttaaatttggagccatttgtaatggtttcctaacaaccatctggggcttgtagcctaatctcagcctgatgcatcttgagcacagcctgatgggaaggagtgcgccattcaggaatctggctcctgttccttcagaggagggccccccatgagacagtgaccacctgtgtctatgatatcatcagacctggtgactttgaactagagtagctcccaagctgagaggctagttgatacgaggcctggagaggatagtctgtggggccagccattcccacgttgccagaatgatcatcatgaggctgttgtgtgcccagagtatgtgctcctaagtgacacgttgcgtctgtgccgggtcatggcggtgttttgtttttgttttgttttttcaccaattcactcataataaaaaagtattccagagtactgatgaaagcttgatgagtctgtaggttatgtcagtgtttcttacgggtttcattgtggctt

SEQ ID NO: 123936 - DNA, 1139 bp, Homo sapiens
tttcacatgaggaatatataaataaagtttataagtttgatggaatggctttcattattgatattgatagattgttttccagatatgtagcattccaccaagggcttctcaggttcttttcaaaagcacaaaatagacgtgccatccagttgcatatgatcagtttatttcacctgtcattgattagtgaacctaaatttttctgtttctttcatatgcaaccagttgttctagaaagatgcccaattgccctcgatagctttgctgattgtacttgcctctgggtctttctgactttacttctatattcctgggctgtgctcttatacttcctaattaacccctaattctgtttcgtatataattgctttccacattcagacagtagaagagttaatgctttagctgacatcgtatccagcagcacttgtctctccttggtctggttgtcatcatttcgcgtagtgtccttctgtaaatggtccctgccttgcatgtctgtgattgttcagaggatttaaaggttatgtcctgtgggctttgtaatcgtgatgtgttagctgactttggaagtatctttgacatacattctgagatcgcattacatttcatccttttacagcttgtacaccacacattatttttttcttataataaagtatatttttaaaattaatgttgatccttttctatgtcccactcttttgatccttctgaatcttttaaaatttttgttgacatctacataaagctgttgtgtcaaggttgaagagaactagggtacctacttggttttatttctccatcaaataaccatatatccagtctgtggttatctaatgtacagggcaaaaagtgaacacacctcttttggttgtgtctgttttactctttgcagattctgaagcagtggtgtttggaagcaggcaggtgataagtcagtaggtacatgatgagcagttccaatactgatcggcacaatgctggactgtacaaatccccacagaacccaaatggggacaagtaaccagatattcatcataaagctgaatctgaagaggttgccagaaaatgcatccctgaaacaagtattcataaattgtgtttaatgagttcaaagataaatacatctaattgga

SEQ ID NO: 123937 - DNA, 1019 bp, Homo sapiens
tccccttgcttcccagcttttaattcatgacactctgtttgcctgaaacattctgccttgtccatcccacaacccttacctgccttctcttctctcttctctccctctcaacgccacctcatctggctaaagcctttaggacccagggtgctcccagaggttgtttctccctggattcttttctgactctttgggactacgcggaggtgctctctcctgcacgctccctgggcaccatgcggggatacccgtcctagcatttatgacatggggatgtatgtgactgcctgctgtattagctgtaccacaccctctgctcttcaactacggagtgaatagtttgtgtgttcctgtactcccaatccttggcacaaaatagatgtttgataaatatttgttgaataaatgagtcttcaggtgagaaaacacatgatagattggaacactgccttgtcaaaacttgcagtttgttaaagatacgataaattcataaatgacactgatggaatcacaattcttccctgaaaatctgataaatatgcaatatgtatagtaaaatctaggggtgtcttattaatattttctgagcattcaccctttaaatatactcctcatatataaaaatgtactcctcatatataaaaatgtactcctcatatataaaaatgtactgctcatatatgaaaagtacaattgttttttatataagatcctagctatacttcagaaaacattttaaattcattgtcttatgagagaaagttgggaagagggttcgaggaaagggaaacatggcccctctctaacctaaaagaaacgaaaacatatgtccacggaagtacttgtgcaagactgcccatcagcagcaagatagaggaacgaactaattatacacacaacaatggatgaacctcagaaatcatcatgcggagtaagagaagccttaaacaaatattacatactttatacttttatacatatgaatttctaaaacaaaacccatttaccgtggtttgaat

SEQ ID NO: 123938 - DNA, 1063 bp, Homo sapiens
tgttaatttctagaaatatgctctaaaatttatgaatcaatcaggtttcttattacatgtgggaacatatatggtagatgataatttggctggctttacgaagagtctgcagtgcttttccaatcaatattctgtgcttcatgctgtcttagccctggaaggcaaactgagtgggggaagctacaggggaaagcaaggtatttgacttggatggttttcattcagcacaggctgcgaaacaaataaggattaccacaggtgcctcagagaatacccaaggggatcagtgctgagaccctttaaaacggtgctcagtgattctttttgaggtggaaattaagatagatttgccatttcttgccctgatttatgaaagcaggtacttgccatgtacaaggagtacatgaagctttactgttaagagaggaaaggttgctgtggtcagacaggtgcaattgctgcggtgcagtgtggtcctcaggtcgaactcacacacctgtctctgcattcaagtcaggcaacagagggaggtgttgacttggttaataactctgctgaaaagtgttcgtgagcctctgcttggtatccatcctcgcagtgttaaggatctgaacttcttttaaatgcctcatgaaactcctctgaaatatctgtcctctaaaatctgagtctgttggtggggtctggcagatctcccttaaatggttttctaacagtttaatcagcttccgcaggatccctttcagaaatgtgacagcccttcccatctgtggatggcacgtgcgggtggtttccagcgtgctctactctctcaagcagctcatgaattttatacatctcagtaaaaagaagatatgggaagttgctttggggaatttaaaacttttcttttgcaatttcaatgtttgatcattgttattcgtttcagtaaatttagaaaacaggatactttagatgttatttttcagcatcgcttagagcagggacctgcatgtgttttggtaagggatacgtggtaaatattttcagctttgggggccgtaaggttctttgtcccatctac

SEQ ID NO: 123939 - DNA, 1257 bp, Homo sapiens
gaatgctcatcatcaacttgggaacctgcttccaaatacaagtgtaagacagtatcatgcttacaatgtattgatatctgattacatttttggtgaaagggaagatgtggacaaaatggcctcttaaaatggtgacagaattcaaggctcttttctatgaaattgactggaaatattacagataaagatatctttgcttctgattgtgaatgctgtatacaagattcatgatagaatcagttattggaggtagaagaatcttaaatccccattacatgttcttcactagatagaagtcatgttctagaaacaggattttagataatgattacctctggcacatccaatgtatattacgttgtcaacgattgatgttaatgtcgatggctgcttgtaatcaggcagaatgctcagatttgggattgtttcaaaagaactctaattactaaattccattagcagtttgggcagcctgggaaatcaaagtaattgatagcagcttttctgaagatctgtgcagcattagtacgaagaaaacctgttagcttggcaggacagtataaagcttagggaagaatttatagttggtagttaaaagggcctttcagataccaattattttatatactcagtaatctttttggcttttatacactattactgtatgactaaggtggtaaatcaatgtgtgcaccgtaagagtaagaacttgtttgattcgaaaagtatggatcttttatttcagcaaacacctttagcacctacttgtgcagaccatcgtgcacagttgacgcatgtgatgaatcagtcataatcctggcccagtaggattttacactgcagctaggtagtttatccaattggataaagaagtagaatgtaatgaaagtattctgaggaggatagaagcaagcattttattgggaattatatacttcaatttcaattttaattttctgccattttctctgacatgctattcagtcattatacttttaaaacataataattattctagattctgtgacaaaattcagatttaattctaacattgtttaaagcacatgtcccaaattagatatggcttatatgaaatacatcatttttttaaacagctaattgctttctatatcagaaactgttattacaacattttaatgcctgactgcagcattgcgtgtcgtaggctaccagactttaatgaagaattttaaaatgttgactaaaagaaaattattcaatattttggtctgctga

SEQ ID NO: 123940 - DNA, 1029 bp, Homo sapiens
ttgacttaaaagtactgagagtgggttgtgtttctctatatcccgaattagttcttgctcttaaattaatacatatgtagctgaaaagttgccagtagagagaatgtttctgtaactgctcttgttagcgaatgccacctatgtgcttggtactgttgtaaatgtacgctctactttgtgccatttagtccttgaatgtagattagcatttagaatcatatagattgatattggacctattctgttcaagaataatttatataatttgggcctaataggcctttttatactgggttgttaatctgaaatgaggtgaattcctggtgtatagggaccctgaggataacattgtgtcatgccccttaatattctaaattactattaatgaataattaaaagtcagtttacatttcactcagcatagttatctctcatttatgtgtgtatgtgtgtttgtaattattggtttgcagctcatattttatgtaaatagatggtagcagaagctcagaggaggaaatgccatatggtattacagttaatgatgacccaagtgtggctctcattttctgtatatctatctcacagtgccaaagaccttccaagtaattgaatctttcctttctgtgattgaattccaaaggggatttccataattcctttttttccctgttaaaaccatcaaattaaagtaattctggcagtactgtaacttactaaaatttcttttggagcaaattatatatgaacactcataagagctagggagaaaaacatgcttttctgacttgctaattagtgttaatttgtatatactctctctttgtatatacgcttaaaaaaataaaggagacacgattgtttctggaagaccacacagttatactaggctgccagataaagtttctggaggcaaaaatccctacggtttacttgtgaaagtgttggaatacaattacgaatcaaaaaactaccaaggaaattcttaaatactcatgggttaatccaattgtgattttccttttttat

SEQ ID NO: 123941 - DNA, 1050 bp, Homo sapiens
agcaagacttgtttttaatattaaactaagaaaaacaaattgctaaggtaaatttgtcacgcacagaaatataatctgtgccaatagaaagaattgttaaattatccactgtttaggattagccagctttctgaattagcatggataattgaagcttgacagttcttagtagtattatcaagaatgtctttcaaatgataattttctttattgtacttgattaatttgtaagtaattagagtttagcagtaacctgatgtgttcagtcttcttattaatgtaggtttatattcataatcctaagtactttgtaaactcatttgaatacgtcatctgtattccaccttgtaaattcaatgtttgtttataatggaaacaagaattagtcaatttgcttgtcctgaaactctgattgttataagctcttacttgttaaattttaatatgcaggttatagataccaaggtagctcatagtaccaagaaacctcattgtattaattattttcctgaagtactgtagtgctttaacataattaccaacatagcctaaaaatgagtgttctatttttaaaccttgacataatttaaaaatgggagtttgtacaacattttttgtgggaaaatgattaatctcaaatttatttttgacataaaagcattataaaatgttactccatgtgaacaaccttaattcacctcctgaatttatgttcttattttctctgcttttcttggcttccaggacatttcgctctcctaggactaatatcttagcgctctgtggagataggaaatttgagtcctgtaacttgtttcttaaaagtaattgcagagcatttgtatatacaatgccatttttaaaaaatgatattttagttcacatctgttttccaaggaattatagcttctttgcagatttacttattttccccagatcagtggaaaatccaggatatttattcactagtctcattgttatttatataccattataatgatcctcagacttataaagcatgccgcattctaaccacagtgtatctcacat

SEQ ID NO: 123942 - DNA, 1099 bp, Homo sapiens
aattagctaggcatgatggtgtgcgcctgtagttccaactacttgggaggctgaagtgggagcacggtgtgagcccaggaagtggaggttgcagtgagccaagatcctgccattgcaagccagaccctgttttaaaaaagaaaactacattttatcatactttgttgtaaactgcttctgttttttttcaaagtgagtgagtgtaagttacaaatccttagttaactttttattttcactccgttaagtacttgttgaccgtgtcctctgtggcaggtgctgttctgggcattgttctgggcaccagctacacaccgtttctgcctcgaagcacctcatgtgggcttcagggcaggcactatcattcagtgtttacagattaatttgcaaatattctgggaactctttttcaaaattaggaaaataggagaaataaatggatgggcagtgactatatttaatatgtataaaaatgaaaaagtatgaatatgtttataacttacatattgaatgctttgctcttggctattaaacttgtttcccattttcatctttccagcaatatttcattgaacattcctgttgctagaccactgtccacatccacaatcttttctgtaagatatattcttataagtgtagttactgtgttaccttgacatagtcatttcaagacatttgatatgtattgacagtgataagtaaaatatttatatctctgctgtagattgttttaaaatcagaaagaggcctgtaacaaatattagagtagacctctggcagataagttttcacatgattattcatgtgtgtctgtatatctatacacatgcatacacacacacacacacacacacacacacacacacttttcccccaaaactttctataatgaatgcataaaataaagagaaaagaattttggtttactacagaatttacaaactttctaaaatttgaaaaaacataaatgagtatttgtttttaaatataatatttaatcagttttaatgattaaccttagatgcctcatagttttatagaagatagagtatatcaacttcattgtatcttctttaaagtacaaaagttaaacatg

SEQ ID NO: 123943 - DNA, 1056 bp, Homo sapiens
ttctgaaacagtaaaggggattttcaagggtatcactttaaggggtgaggaggggagaggcagtctaagaaagggtctgacccctcaaacaaccaatttgtgtctgtctgacacatcaggcaggtgtgaagggtttccatcatagatattggaaagttggaagagccagtttttagtagttattactaaagtctcttactattttaacattttttatttctgagctaaggatagcaattttttttaaaaaagcaaaggaacattacctacgaagtaatatataaaatacatgtttaccattgaagctacacttcttatatttttaaaatataaatctctacacacttggtaaatgcagcaaaattatttgacttagtttaaaactgattaagaaaaatactgtttttcttgtagatttttataatataaacaaaatccgaagtccatttgtttcacgattcagatgtgaccatcctcgggcacacctgctgtgtgttagagcccaccggacccatctagctacaataactcattcagtattccttaagaagtagttttcatcatccctaattcttagacgagtcaatgaagacttggttttttaatttagaacacatttttattcacaaatatttataaattgtaacattaactaaaatttcttagctgattgtccctgggaagtcacatttaaggtgcatgtttgcaactcaaatgcatttctgctaaagacattttaaggcatcagtgaaatattccaatgagctttgacacatagtttaagtacacctaatagaacagactgaggcattcatgtatctaattattttttaaagaaacccaagatagaacagtgaagccaggaatttgattggtgatgacctggtttcatccctggtgctcaatcttctaaggagtctgggggagaggtgacagggttagtacctggggaggagtgccagcacagaggctttggcttcctaaaggaaggttaaggcagacgttcccatagagtgccacactcccaggctgcacattctgcctacaacccccccg

SEQ ID NO: 123944 - DNA, 1050 bp, Homo sapiens
ttcttttttcttttttttttttttgagatggagtttcactcttgttgcccaggctggagtgcaatggtgcaatctcggctcatcgcaacctctatcacctgggttcaagctattctcctgcctcagcctcccaagtagctggaattacaggcatgcgccaccacacccagctaattttgtatttttagtagagacggggtttctccacgttggtcaggctggtctcgaactcctgacctcaggtgatctgcctgcctcagcctcccaaagtgctgggattagcgacgtgagccaccgcacccagccaagattttaattgtcatactgtaaaattaaggtgggtggggttatcctaaggagacctttatcttctcaatattcatatctattactatgaatctcttgagaagcattaacccttccaatggaaaacatctttcaaatgctttccatttgcagtaagttgcataacattttactaaacatcattcaatactttttaaaaatcaacaaattatagcattggattggaggtaatttagtgtttagaaatcatcttcatagaaataatcactgtagacttgttattaatttttatttttgaagagttgcttgggtaatgattaagtaatttatatatgcacaaaaagacttcatttacataaatttttatttatatattttaaatgcattatgagaagtgctagtgtattagattggtaatattaaaaccacaagtcaaaaaatacaaaagttaagatttttataattctatttgggaatctctagctttttctgttggtgtgggctataatttcaacactgcattattctaacttattacatttaataaactaacaattgggactagcttcaaatctcaagcagcaatttagtagatggttcatttcatgagaaagaaatatggactatggtgactatgactgtactattgcagaaatggaagaaagtgaaagtaaaatgtattggttagttgcaatattaccagtaatattttgtctggccaataatattagaatgtagatcaat

SEQ ID NO: 123945 - DNA, 1034 bp, Homo sapiens
ttctttcatccatcacacatttcagaaggttgcaatttattaagtgcagtgaaaatcactggtgatataggcctttgtgcagtgtatacaattagtcataagtacagtcatgagctgcataatgtggttttggtgaacgatgaactgcatattcgatggtgggaccgtaagattataacagatctgaaaaattcatattacctagcaatgacatagccattggaacgttcagcaacatatgttgccttttctcttcagagataaggatgttctttttctccgggtataggaagggcacccctcacatatgagggtcttatgaccggctttaggaaaacaaggtgggagaatgtgtgagagaacttcctgcttcttccatttttaaagatgtggcatatttggggatcgctgtcctgaccctgtcatcactcaatccctactttggactttagattatcttgcaatgccttctcattattatttattcaaatgggaccctaacacaaaaccaatgtggtatagaaagttaacagcaagaagggctagtgtctctgaggctgcagtaaacaggaggaagggcgtggtccactctcagaatgctgtcatggttcagagctgagggatttaatattgtttgggtatttttttctcttctctcaccctcttgccccattcctcactttatagcaacaccgatgtatttaccaacctcaagtgtactaacttgagcagtttggggaatcggggattaagatcttgtgcttcttggggccctggggacaatggttgaactgtgtcaggcagccagactggaatcaggtggagtcactggcaggttagaagcccttaattttgtcatgcctctcacttcctgtgaccctgacctgcccctacccactcacccacatggctccagccatactggcttccttgattttccaagaaaacaaaactcccaggtctcccgctggccttcatcaggaatgagtttctccaactcttggccaacttcccctcttcagggctgtgctccg

SEQ ID NO: 123946 - DNA, 1058 bp, Homo sapiens
cacgccgggcgatcagtgcacggcatgggagtgggtttctcacggtgagcgtgcacgggtgggggcatttttgaccctgcgtgatgggaatctagaagggcccagggatcccagcacgagaggctgaggcgaatgcagctgcagggccgtggaggctggacacaggtccctgcaggggaggccgtggtgggttcgggccgagccgtagccgcctccacctggctgtcctcggctcctggggcagcccaggagtccaggcagccacggctcctgtgtcactcccgccctcctgacctcagcggcggggaattcctacacagaggcagggagaggcgaggcgacacagcccgtccctctgcgagctcctagcccggagcccgtccgcgctgggcggggagagaaggtctgagagtgaagcaagctgagcgttcccatcagtctctagaagagcacgtgcgactcaaggagcctgggaactcaggggagggcagaacaatttactcaccctcactacccacccctgcgaggggttccgcagtggcacggaaaggctcctccatccagtcaagcttagcttttgtctctcaccccctttaaacggaccttttaacgatggcatgaatagtggtattcagcataacaattacacttggtgacattcttactttctctgcaatgtccacaaagagacctttaaaaagtcattagttggtgctcatggaagatttgcatataaaggaaaatcagaatgaactctcaattatcagcaaatccagaataggtgatattttaggggacttaaaaactacaaattatgagctgactgaatagagaagcctccttaaattaaagctttagaaattgctatttgctttcttgctcagattaagtaaaactttctgttgcataaatagaaaagaacgctattttctcttgggcgaatatgtgcatgcctgctcacttggggcccattttgagcgtttaaatacattaaagcatattatacagatttctctaggcagatctgtaaggccttagctgaattggtcgcaatctct

SEQ ID NO: 123947 - DNA, 1395 bp, Homo sapiens
gcatgactaggtttgattatacaaaaagtaacaacaaatgctggtgtagttcctggcattctagctcacaaatcactttgatttgcattgtctcatttaatcctcattacactgtgaaaagaaatatacaacctccagtttatgaatgagaaaaccaaggcttggagtgatcaaatgatttgtctaagatgtaagatttagctggaaagggatagagaccagaatcaaaccaaggcattcagactccagactctgggctgttttcacaaatcgtctctcatggtgggttgggtgggaccagtggtctccaagccagaactcactgagatgtagcatcaatagcagtaaagctcagagctgaagcatgaggcatcagctacctttcaacatcagcagggctcagaggggatggggaaaagagggtgggaggggtccccaatctctctacctgctctagtctttcattgtgaaagtgatcctttgcagacacaactcctctgtttttttcagactttacatctgtacctgatgttactgcctggagctcaccaaatcaaagggatgcagagagaaaaatgcttatatctgtgcttactttttttttcttttgagagagagtctcgctctgtcgcccaggctggagtgcagtggcgtgatcttggctcactgcaacctccatctcccaggatcaagtgattctcatgcctcagcctcctgagtagctgggattacaggcatgcgccaccatgcccaactaatttttgtatttttagtagagatggggtttcaccatgttggctaggctggtctcgaactcctgacctcaggtgatccactcacctcagcctcccaaagtgctgggattacaggtatgagccactgaacccggcctgtattacctttaacatcatcctttacaatttttattcgtgtgttttcattatgcaaacgttagtactgtaatatacattacatattactaacccacgttgttgcagtaatataactgtgtgtgtgtgtgtgtgtgtgtatgtatgtgtgtgtatgtgtgttgcttttcatgcataattttttaaactgatggagtgagtgcatggtcagtcaaaagatttaaaaactacttttcccttttttttttttttttgttttgagacggagtctcactctgtctcccaggttgaagtgcagtggtgcgatctcggttcactgcaatctctgcctcccaggtttaagctattctcctgccccagactcccatgtagctgggattataggcatgcaccaccacacctggctaatttttgtatttttagtagatatggggtttcaccgtgttggccaggctggtctcaaactcctgacctcaggacccacctcggcctcccaaagtgctag

SEQ ID NO: 123948 - DNA, 1125 bp, Homo sapiens
gcctgtgtggtgagcattttccttctgtctggttgtttcttcctttgttctccattaatagggaaaagtgtcacttatgaaagaataggaatgttttacactttgtgacttatatcaagattgcacaatttttattgttgaagcaactgtgagcaggaaaagagaaccagtgaagtgttagtatctttgttctgatcaccttctgtgtccaagaacagtcatgactgcctaaagaaataaagaggccgttcaaaggaaaaggtgagattctctatgcagactatagaagaaacccccacaagttggggggtggggggcaggtaagacggagaaactgacatcttacaattgctcttaacgggtctacttgtgttttgttgtttctttgtgtaaggttactttgactagaagcccaaatctctgaactagataaataaacagaatagactcattacctgggctatgcaccagagaactgaaacacaaactgtgctttagattgggaatgattcgagtatctgagattggaaatacaaaattgaaaaggcccatttatcttttgatccactatgacccagaggcaaaagcttgggttatgagttaaaaatgctgggattcctcagtggaaattgagcctgagaagcagagctcctcctcctcctcctcctcctcctcctcctcctcctttgacaggtgctgctcagatctccctggactcacactccttgatgtttcacagtatcacaggccaggcctcaggaaaccctggttccacctgcagctcacctgctcccgacattccgtccctccccactcccccttatgcaccccagcagctgctcaccacttcccagcacctagagcttttacacaaccccggggataccagaaagcctcagtggcatcccaccagaaagaactgttaccacaatccctcaggagcagtagagtcacaggtggctgggggggagtgatgtcctttaaccactccccccagccttcacaggtcccactcccccgcaagccaaccccaaatgaatgcatcatttgagtaaacactctatgctccctctgcaaacaaacaaagcttcaacagaagtctcttcaggtccctcccaaacagat

SEQ ID NO: 123949 - DNA, 1037 bp, Homo sapiens
acagagtatcactgttgcccaggctagagtacagtggcgtaatcatagctcactgcagccttgaattcctgggctcaagcgatcctcctgcctcagcctcccgaagtgctgggatgacaagtgtgagccactgcacctggtcctcattgaaactttttagcagtgttttccatactctatttattataggtgtatgataatctatgtaacaacctatgcaaactcattcagtgcacagtatacaagctgtgtctcgaactagttagtagaacatcttgtgaaggcttcgtgatattttaacgaacatacttgtcactaaacacaaatggagagaactgttcatcttcacaaggatcagctcggtgagggactcactcctggctttctactggagaagtgggcgtgcctaggaaatgcatcaaaaccagaatctctagcacaaagctcagtctcttaaacagagatgctggtcagcagccacagcaaaacccaaaattatgtatggcttggaaaggatcacaatgaccagagctgatcactggataatgcaagtaatttcaaagtcaatgtcgtcttcagaaagaccacttcaagtcagtgtaaccactggataaactacacaggtaatagccagccaggcatgtgtccagcacacaggaacctcccaggagggctcggctgggacactggacggggtgcctggcggttcctgcctgtgtggcctcgggcaaggagacttgctggtctggtctgcgagaatgtcatctgtaagtgaacgggggagaatgagacagtaactcagagcttatacttggatcccaccataacacttataaaggcttacagagtggatgggaactcataggccatgcaagaaaactagtgatgtaagaaaattttttttttttttttttgagacagatcttgctctcttgctccggctggagtgcagtggcacaatctggctcactgcagcatcaaactgccaggctcagatatctgattctcccatctcggcctcccgagtagcagggact

SEQ ID NO: 123950 - DNA, 1092 bp, Homo sapiens
gtaggatctctttcggatgttttgtccattaaatagtgaatattttattacactaaaaaattctatgcatgtagacttacagtaagtactccatatacattttaggctgataaattggaataactggtattctaaggggcataatttcctaacataaggacacagttacctgtgctacaatgaagagattaaaaattggttattgaatgctttatcttaaaggagtgctgtgtagtaaagaagattcatatttgctaagctctttaaaaactgtaatgcatggtgcaaatgttacatatatagacgtacattctctttgcaaagagctttcacaaaggacaatgtactatgaagatggccacttggaagtaaataggactttgaggcgtttctgatgccactgtagagaatgtcaacaatggcagtattaaatttgctgttttttattatttatttcaatgcccagaagcaaactgttgaataatttcaccatcaggttacaattgaattaggttctaaattataggaggttagtgggactctgtggacctgaaattgacctctgctgtcgcctggagacagttctgggcatcttgctgacaactgccgctaaaggaattgtggagcctgttggtcctcatgagaggaagtcagcgctttcctcatccatcttttcttccttcttaagaaaaattcttctgtcccaaatttcttcccagaggagggttctcctagaactattcaagggtctcttccaacagcatttgacaggtgtggaattactacttaaaaaagtcacgagactaactaactgaaggggaacgatggtgcttgactacgaatgccacatttgtgctcaggtgcaggttattcaagctgtggctgaatgtctttggaaccattactggagcaaagcctgcagacaactccttgctaaaccataaaatgatgattctggcaagcaaagatcagatgcaatctgagtgctctgagaagcagaagaatcagtgctttgaaagggatcacaaatactggattttttgttgtggtggtggtggtggttttgtcttttttagaggcagaaggcagagg

SEQ ID NO: 123951 - DNA, 1039 bp, Homo sapiens
aaattagccggcaatggtggcaggcgcttgtagtcccagctactcgggaggctgaggcaggagaatggcgtgaacctgggaggcggagcttgcagtgagccgagatggcgccactgcactccagcctgggtgacagcgagaatccatctcaaaaaaaaaaaaaaaatcaatagtctcatattataatgttcgtaagaactatgacaccttgggagagggtcttggagaactggctaccaacaatttttattaacacttctggcaaaagcactagctttcggtatcaacatcattatgataaaaatgtgtttatgaaatgcctctaataatcactaatgctttggtgtggttccaaatagttcttgtccccgaggaactaacaacacaaagttgtagattgtgtcagattttgcagttcataaatcgtctccacatcaatggtcatggggcagcattattagacccatttttacaaatgaggaatctgatacctgacaagaataggaatttacataaggtcattaagcaaccaagacaggcacagacagaacttgaactcaggagtcctgatcccaaccccgtgctcctttcaacgtgccacactgactcaacacccagcaactaacaacattcagcaaaagcatgagaagacatgatgttctatgctaagactggctaataactgctatggggagagattggaaagggttcttctggaatccccatgctccccaatgccacttcctaacaattatccccattcaccgtgtagaaccccattgctcctttaacattcaggccagttagtggtatcgtcctgtgtccctctcacttgtgtcacctgctgacctcttcagccactgaaccatactgattctagcatctggcccagaagcctccatctctgtcatccgaggtgacctggtgtccatacggaagacagctccgaattcttccttgacctcttcggctccactggtcatttgggcatcacttcagccatccagacccacagcctcagcctcactttggacctcag

SEQ ID NO: 123952 - DNA, 1056 bp, Homo sapiens
cgcgcgtcgagcccggtcgccacgccccttccgagggtcgctccgcccccgtcgggccccgcgagcgcgcggtgggggaggggagggccccggagcgcgcctgcgtggggcgggggcggcagccgactaggggctgggtctggccgtttagggccgggtcttggcccgtcgcccacggtgcggagggctggtgggctttccttggccgtcgggcccgccacggcgcgggtcttggctgcggggcggaggtggggcgggagagccgaggataagagtttgaggcttttcgaggcgcgtgccgcggcgtccgcctctgcgggactctgcgccgggcgccctcggccggcgcgcccggctcccgctttgtcgccgagggaagcacgcgcgacgcccctcccgtcgccgccgtggcttctttcggtgttcgtgatttgctgagaggctggaaagcagcacggcggagaggagccttgcactcgccaggcgggaagcctgcgcggacacgcgtgcgcacccacggggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacagatgaagaaagaatacggaggcaagaggtctttctctgcagtttggtggatttccaacatttagacttgtttggaagaatttcctcagctgcaccaatgaagtccttgatctatagaagtcggcagtccctaaatctacgtctgcattttgttgcaaatcctttataacattccattaaaataatgcagagttatttaatatccagttggccatcgtgagagtaattcgcggctgagattttgttaatcattctgtcttctgacttaacagtga

SEQ ID NO: 123953 - DNA, 6714 bp, Homo sapiens
aggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaaggtgagcgtctccagggccccggccccggcccgacccccgccggggcggcccctttccccgcttgggatggtggggagggcgggaaggtcacggccgggcgggaccgagcgccggggggactgggaggccaggagggcgcacaaaggaggtgccgggccgggcttgcggcgggcgggcgggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcgaaataaaattgagccaaagtttccaaaaagctgtatggagcgctgtggggagtgaagaatgacaagaagattaatgttgaccaactttggaatttccttaagaagttctcatagcagtacctgaagtattaatttctagtagctgtgggtttctgtggacgcctagagaaaaaaaagaccacaaaaaaagtctgtttcgaaaatcgactggccaggagtttgtttgtttttttttcctgcttagaggcaccaccggaggactgtgtaaaggaaactgaaaactacaggttgaagagatgaacaatggagtttagatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacatacagcactcaccaacgttgaaatgggcattttccgctgttggaacagcaaatctgttaatttcaagttgctccagagaaaacctgagctgtccctttaaggggttctgcttttcctatttgtgttggcatttgaaagattgtggaggcagaaaactttctggaatgtcaaaaaaaaaaaaaaaatgctggaactcttaaattgagtatttccaaatgtgagcgctaaggggcgccagttattttttaaccatggaaatggttggaacaaaatgtgtaacatactcaatctgactgacctatattaaatttagttgaaacttaagttatagattatttgatttgtcataatgtgtttatatagtgttttcgaacattgaaaatactttccttaaaattattggcacaactttatgacgtttcaaaataacactcttactgtcttctccttggcatattttggttaagttaaagttttagtagtattagtaacaatttctggtgaaagtttgttttcttgagtgcagttgtttagaaggaatcctttatcgacgataaaatgaaaataggccttggcaatatttagggttaattaaaattaaattgcattcctgaaatgtcgaattcaaagactataggagattccaaaaaaaagtttgaaaatactttcaccttatgtatactatttaaaaagctgcatacttttgcgttctttagttttaaaaggcttcttgtgcttttatgttgatctaaaatctctaaatttagagctgattccttgttatcaagtttccaaccttaggctttaataatttttaatctttcaaatccagaaatttcaattatgtcattgtctctgacaaaggcttatttctctctggttggaaatagtactcgtttgcgttttaaatgtaagagaccactatgatatctcctagataatgtttgtttccccttccccttttaatgtggtttactccatctcttgtcttgctatctttagttttagccttgtcaattccccagtgtaaagattgcttctgtgtggcatatagtatgtttaaaatgggcaatataatgacgaggaagtttgattgttttttatcagaccagtacaaacatgcaggaaaaagggctattccttagtgtggaataagcggcttcctgtaattgttagccttgttataaacttaatttgacttaagaaaaatattggtttctgaagtccatcacatttttttttctggatgatttaattgtgaaatttggcatcttgtgctttacccctttgtggtttgtcattgtccaaaacaaattgatcatgacttttgtttctggttaggcattacttttttttttttgcctataatgcttggctgaaaaattacttttaaatttagataaaatttagtaaaaattttactttagtgattggtttgatgaagttaacatcgtgcttagagtagatgtattttctgataattaggaattttaaatgagattttaaattttttattttaaaatatttttcaaagaataagctttttaaaaatatgcttgtcagcctaagaatttccatttggctagttacaaatttgaggattaagtgtgctggttttcccagttgatgaagacttggatgttttagaatgagtattttaattccttgccaagttaacctttagtctgtatcttgactgtggacagtccttttgttttactgcttgtttttgttttgttttgttttttgctgttgctggtggtgggggtgtgtgtgccagctcttccactgaagtatcttcaacacggttgttttttaaagttgtgaatacattttaggttgggcccatcataaaatataaaggacataaacttgagtttgaaaccttttattgaagatagagatgattataggattacacataaaacctaggtcttaaactgctctacctttagagagacgttttcaactgaacccttagagcagttaatatatggtttttaaaaaaacagacttttcttgtcatgagaatgaaacaacagtagttgaatgcaaattgttataataaagttttgtaatttagaatcgagaaggtgaagagtacggtctattagacttaacaatcctgtattaggggaaaatggagaactagtattttaaaagctgattttgagttttcaattttttaggtggaggtgggcttaaagctgctgatagggaaataaaaaatgtgtaatgaggaagaacagtcaatctttttatcgtggatatcagaaaaattagtgtgtggctcagaaaaagagagcagatggattagaatgccgtattactgatttgaaaatatattttcattttctgatggtctttttgtgtttacagtaaactttctgtctgacctcagtttagtttataccctgcctgctccctctcctttaaatatatgagtaaaaatatttcgttaaaacttgcttaaatagttgctattttttcatgttaatgtttattttcacttcttctgcctctgttattggatgtatcataaggttttcttaccataatttttttttttcctgagaattcatttacaaaagccttgacttaagaattatatggtggttggtattgagaggactcttgctatacagatttcttacaaaaaggttttctttttgtctgaagaagcaattactgttgtcagtaatcatcatctgtaacaaacagattttaaggtgaaataatctgttctttagaaactaagatattgcttttgtacacagtccttgaattagttgtagcaagaaggaagctactatttataatcacttctttccattatcttttctcacccaggaggtgtcagcagctatatattggcagtcacggaaaagatcagttgtatcattatggggcatttattaaacattcattctgtacttttaaagctaaattcccctgtaggtggaacgtgattcctttggaaactgtatccagtttacatgttttgtagtaaaagttgtatccgactgtaacacagttgagttgatagaaataggtctctttgctagtcacatttacgagtgtattttgggatgaacactttttcttaaatgactgagaatgtcaagttaaatcaagttaatttgacttcttaaatgctttatgcacattatatttctgttaatgcttcactagtcactgtcgctgtcctggagctgattgaaattggtcagtttcccataagagcaaatggtttttggtttcctttttcagggaaatagatttctgtgatgaaagaagtgaagtataataaaaccctcatgctttgacctggccttcaccgaagcatgattcagattctttttttgaggccaatatacttagacatgtaagggcttttcttttcttttcttttttttttttttttttggtggtttttttctttccttttttttttttatggtttggtttggtttttatatcaagggaattacaccagtgtgatcataggagcaactttttataaactggaactacagtttaatttacttgagaaattcggtgtagctaatacatttgtttgatttatttgtttgatgttgcagttgtaagcaaaacttgcccttctctgttggagatggaaaatgctgtgacattgttggtttttgtttgttgataacttaaaaggcagcccactgagcaactttctgctattggtatgtcagctgttatgaacatatccaaggttctattttaaggccaagggatggggagtggtgagtgggcctatgttaggaggtcacacagatatataccagctttttatttacatgatcaacgggacttcatttttttctccagtccctcctgtgtttgacattaagacagcttaatgtgaattttaagtgcaataatgtgttgtttacccttaatgataacttttagggaatatttatacccctttaaaaaagttttgggcccacaatagctagattatttcgtgttttacagttatattttttacttaacagaaaatcacaactaacaataaacttttatggtgaatatagtttgttatcttagtgggactgttaagaaatttgtttataaccccagtctgtgttaggtactaccttctatggagtgatcattatagttagcattggaatattattacctgtctgccctcttaaaattactttcttgaaggtgcctaccttagagcctggcatacacttctcagatgtttgttgaattaaacatgttgacatcttacctccttttttgatttctagtttctcaaagatagggtatgtgcacatggtttaaaaaaaaatgaaaatctgaaagtgacattagaaatattgtctaataattttaagaaatgaagcagttgtgtgattgttgatagttttgtgcccttagaggaaaaggcacttatatgttttcttaaaaacaacttaaaaacatgtcatgttatttgtagtacttgctgccaaggtgcttaattttactttactgtcattgttgggaaggagatttaggaagataaaattgctttacttaaatagtatagtttcttgtcagtccttataccaaagggtatcaattcataagcagagaaaaactaccagtgctcatctcagctcttggaaaattttggcatttat

SEQ ID NO: 123954 - DNA, 1787 bp, Homo sapiens
atttttaaaaaatatattgcagaagtgatttatctagaattcttacaattagcaagaaaaggactgcacttaatgttttcgtcttcagtttcttgatgcggaaactctagtttgaaaatccggcaatcctatcaagtctaacaaaataaattatgttcataaagttgcttcatgtattagtctaatatttttgtagaactaaattttgaggctggggaaatgaatcgattgtaagatttatatcacattatttattataagcagaatgtgtcatattctgcttagcagataagcagatattgaagtatcggaaagaacataattagtcggatgtggtggtgtgtgcctgtagtcccagctacttgggacgctaaggagcgaggattgcttgagcccaggaggtcaaggctgcagtgttatgatcatgctactgcgctccaccttgggcaacagtgagaccctgtcttaaaaaataaaacatcaaaatgcagttacatccataaagtggctccacataatggtcacaatgtaagtaaagggcatgtgtgtgcaggcatttatatctgtaagtgaagacatgcagtgaatgtgagctgggctttgtgagtactggggctggttaagttccagctgagaaaggttggccccgggattgaataagtagctggccttaagtaagcacctcgcttttgctttagtgcaggagaggtcattgtagagactgggcctgatctcctggtcagtagcaaatcattggggagcccttggtttttaagctgattttatagtttgaaatatataggaaaaaacaaacaaaaaataatacattttaagagtagaattagggaaatgcatagtaagaaaacaaacatgcaattttaaaatttgaaaccgagcctggtgaggtggctcatgcctgtaatcccagcactttgggaggccgaggcaggtggatcacgaggtcaagatttcgagactagcctggccaatatggtgaaaccctgtctctgctaaaaattagccgggcatggtagagtgtgcctacagtgccagctacttgggaggctgaagcagaagaatcgcttgaacctggtaggcggcggttgcagggagaggagattgcgccactgcactccagcctgggtgacagagcgagattccatctcaaaaacaaataaaatttggaaccttttttgtaaactcttcaatgtcatagttttacagggtctcaaacttactttgcagattatatcagagaattgtgttttagagctgcaggggacctgagagttgggagtatatgttcatttcataggtgcaaagacaagtgggcagcagagctagagcaagacactcacttctgccctctgttccattttgtggcgtgcctctccacaaggggaactggagggaaaaacctggaatatttccatatgctaaaaatctgctgctgttgcctcaagttgtgaaggtaaagaagacaaaccaaatgattttttgctaattctgtgatatgctggttttgaacaaatgatggtcagattcttagaactagaatttatttttaacgataactttctaattaagaggctaaaagtgagaaagccatttttagaggatttcagctcattcacttctttgtaagcaaaggctagagcctcagttttttgaataatgtaaaaattgttgctgctattatttttactactcaagaggaaacatttttggctgggtgatttaatagagaagtatgctattgctaagtgattcaagttaggaatgtatac

SEQ ID NO: 123955 - DNA, 1062 bp, Homo sapiens
ttttaccaagtttgatgcgggcttttaaaatttaattgtattaatttttgtgtttattttaggtaaatgagagatatcttgacattctatccctagagagatacatatttgtgtatctttaaaagttaacacttccttacatagtgacattacactgagcaagatggattaatcctacagataacgtaataaccagtccatattcagatttctgtagtggatcccctgatattctttatagctggattgttcaaaccagaatcttactcaatactgctcattaaatctggttgttacgcctttttaaatctagaaccatctctttttttttttttttcaaatgacattgatttaacttgttcagggcttgttcctttatgccctgtgtatctattaacattggaagctagttctaaagtaggttcaagaatagcatcttccactggagtacttcataggtgctgctgtgtactttgttatcttacatcaggaggcacagtaactggctctgccatcagataaggaaagattgatacctggattagagtggtgatagatggatccttgtactttaaaggtagttttttttgttttgttttgttttgtttccccacttggaaccagaaggtgccccatcgaccaaaggtgccccgtcaacattcacacctggttttgaccagttttttgcctgaatcagtttcatcagagcttgcaccatgatgatactttaattctgccattctttctgcaattacttggcatcctttgaaaggtacagctttctgaccccaacacggaaatacattgcgattttgaagtgagtttctaatggggcaagccagatatatgctgctgcttattattacttggttctcaaagtaaagtgttggtttgctagttgcttcaaatggagaccaatgaattttttctctcttttctaatcatctttgtagactcatggatttcatagattcaatgtacttaagtcaactataattaattttgatgttaaaattattacaactttagccattgataattaaactggctcctgtgtctgtt

SEQ ID NO: 123956 - DNA, 2002 bp, Homo sapiens
taaggaacttatgttccagcagatggggatgttagtacacaaaagagagcactcagtgattaaaatgtgttgagaaataacccttttgccagaataggaaaatgttctcctttaaattgtaagggaagagttgctcaggaatgtgacaaataacagttacctaattgagtattttcattggcatgtgaaaaagttgtcatagttctttaaagaacttgtctttttaagagactatatgttggtatgttgaccatattaaatgtaactagtttagtacatcagattgattgcagctattttctgaaatagtttctgcctttacaactcagttgtttgaagggtttttgttttggtgggtgactgagtcacatatattgagaggtatcctgtttgtacgttttctttgtaattataaagtctttaggcagtttatttctgtttattaaaataaatcagaagaaaatgtgtcatagtttactatatgttatatgaagagaaagttcttttggggatcatagttttatcatagtaataaaaaattatcagcagtaaaaaagatagtcttatctcacttttattatagtttatagcattacgacatactgttagcttttttagtaggtaaatactacatagattgctttaacatatgctttgcaattgttgaaatactgctcatttaagttccttcttagatgtgattcagaagtgtactttaatgtatttaagttatattttcctagttcagttatattgagctttttttttttttaaactgtcaaggcaatttaaaatactcttgccttcagtgacttgaaattgaactctgcacaggagagaagaatatgtcttgtttctatatagagaaccaaggaggaagagattgactttgccacctttgtaactgataataacttgcattttagtccctgctccccagccccacttttttccttttctgttattcctaaaatgtagagaattggagatcgatccacagattttcagttcatctttggcagtagcatggtttgtaacttttttcattcctggaagaagcagtggtgagggcacagagatagcgtagcacattgtctttgaaccttaatgggaattacttcttttcagggaaatatagcaatggccaattttgtctatacattttaagattgtttcttatagttgttagagattttatgagaagcttgaatttctttcagtaatcctaaagaactgttataaagaacttatttatcagaagaaatattccttattgggaaaaactaaaatatatcaattaaaaagttaaaagtactcatcatgcactgatagctgctcttaatgtttccttgtagtccccccccaccagtgtttatggatgtagcaaaattggaattacggtttttaaaaaaaattatatcatgagcaaaatttttccttgccatttcatattctttgcaaatataatgtttatagtaatatatttcatgctgtcgaggtatattataatttacttaactaatctgttggacttgccactttgctttcaggaaatgtgtgtaatgatagcattaagtggctttagaagttacttttttaaaagccttaagttacaaaatactgtaactgggaattatgaataccaaactcttatttttgcaatgcagttaatctgaaataagcattttatgttgcattgcagtagaaactggttgttaggatgcaacgtgattttcgaataatgtcagagttgcatatttcatgtattagtttttagtgacttaacatacttaattgaaacttttcattctattctaggctgtttggttgtatgctattaatatgtgtgcgatgttatgagggacacactaaagcttcaaattcattccttcaagttatctcagtagttggaaagaatatgaaaataagagtaacaaaggaaatagaaacataccaagaagactaaagactggtgctaaagagggtgtttttggctgaggag

SEQ ID NO: 123957 - DNA, 1526 bp, Homo sapiens
aggtctaggaacaattcactgaatatttgcctaagggttttcactttccatgttttacacaatataaataatttaaaatcccccccctttttttttttttaaagagatggggtttcaccctgtctaggctagagggcagtggtgctatcatagctcactgcatcctctaactcctgggctcaagcgatcctcctgcctcagcctccagagaggtaggactgcaggggtgagccaccatgcctggataattaaaaaaaattttttttttggtaagagacagggtctcacgatattgcccagcctggtcttaaacttaaggcctcaagtgatcctcctgtgtcaggtgtcagccagtaatttaaaatgttttgttaagagtagtctctctctttccccactttgttatagatctgagtcatttgctttggaataatgtgataaaagtctaagataaaggattgctagactaatatttagacatgtttgtgttgatgttctgtacaggttgtagttttataggctagaatagactaaattttgaagggtgattagttaagaatagactaaattttgaagggtgatctgaaaagactttatattgttcttttgtaaatcttgagtaaaagaaaataaccaaacagggtagtgagtagagagataaatgaatcccttaagagaatgatagtaataaaggcaggtggaagtaagatcagagttagaaaatcttagatttgttttaggttataggaaaattgatttattttacatgttggtaaaaggcacaagaggcttctttttacattttactttatcaaagtgaaactttttcatttgatttttaaattggaacacattaactgaatggcataggatatatcatagtgatgttgtttaggtacatggtaactgcagataggtctcaagttgaccacatttgaatgttacattattactttgtggatatttaaagacagatggcttgaagcctgagaagggggaaggagtgaaagtataggagcaagtggtggtaatttaagaagatcctcaagtagaagtctgattttgtgatttcagagtctctttaattgttaatgttactattattaaataacaggtacatatatcctaacagtataaatatgaaccagaaaaatagtataagaatgaaccacaggccgggcacggtggctcatgcctgtaatcccagcattttgggagaccgaggtgggcagatcacgaggtcaggagtttgaggccagcctggccaacatagtgaaatcccatctctactaaaaatatacaaaaattagccgggtgtggtggcacgtgcctgtagtcccagctactggggaggctgaggtgggagaatcgcttgaacctgggaggcagaggttgcagtgagctgagaccacgccattgcactccagcctgggcaacagagtgagactcctctcataaaaaaaaaagaatgaaccacgaaaggtagcatgccttgcacttttaaaatgctacctataaggttaaat

SEQ ID NO: 123958 - DNA, 1665 bp, Homo sapiens
aaagtttcatgaaataatacttgtctgtactgcctgtgatgcagtatactatttttctattctgtttcatttttaaaaaggttggttgtgattgataatattgatttagtggcttgtgtgctgtgcagtcttagcaaaaccgatgtcgattcctgctgtaatttagttttcaacaaacttttttttttaatccagctctttgctgggtgctggggggatacaaagatggataagacatagtctagtgctcaaggagccacacaatggcatggagagtaatgaaaatagaagctgcaatgctgtaactgccctaacagaggcatgcccagcctgagatggaaggggccacatcatttcctagcaggaagatggcagtttcttctaggttcacagattactactgcgtataatctgataatccctcttatgacgggcttaccttgatgggaaagttagttttttacctagattttataaaaactaaacaataatcaagtttacttgaaaataagatatttttgaacttttagcttactggccaagtttgttaaaaaataaatattaatcttggcactttgggaggctgaggcgggcggatcatgaggtcaggagatcgagaccatcctggctaacacagtgaaaccccctctctactaaaaatacaaaaaattagccgggcgtggtggtgggcgcctgtaatcccagctacttgggatgttgaggcaggaaaatggtgtgaacccaggaggcggagcttgcagtgagccaggatcgtgccactgcactccagcctgggcaacagtgtgagactctcaaaaaaaaaattaataaataagataaatgttaattatatagataatctttaaaaaaattaaattttacaaatgagtaatattttcctaaatatgtcataggaactagctttaatattattattggagaaatacttctttcctgactttttcccccctcagtattgtgacttattaagaaaggtaaagtcaggtagaagtttaatataaaaatatatttgattatttgtacagatggtaaattaaactgtaaaataaaccattaacttttaaataatggaataaaagatgggtacttaattatccaacacttaaaaatgatttttttaaaaaattgcaacttgtgtatattctgtatattgactttttatctcacagtgaattcacaataatactgaatctagacgttaatagattagttgcatattatccaaaaaacataaagcatgacatttctatagaatttagtttctgtaagttacgcaattgttacaggtttttcctgtgaaggataggctgctacctcaggttgaagaagctaatgttggagtgaatgtggtggttgccttagaatgattttgccggcagcagtgaaaaatgttttccttatagttcttgtgcagcaggccatggagtaaagcacatttttataataaaggtgatgaatttaatcgcaaactggcagcctaatggaaattgcagaccttgatactgggagaaaattgcctataaagcaactcttgagagaacaggctttaaatttatccacccattttgacattgaggagaacattggaatcatagggtattttgcttggcctgcttagttcagatgaatgacacttgagtattc

SEQ ID NO: 123959 - DNA, 1053 bp, Homo sapiens
atcgattatcaaagtataattagctgaatataattatttgtttatgagatgatactaaattcagttcccatagatactggtggtgatttactttttaaaaagagtttttcttgttatgtgcttaaatccacacccgaaatgtagccataatttagttcaagattgtttatgccacagtctggaaaacacctgaagtaattgagatttttgagtggttgtgaatggattttagaatcatgtgttgaacagtgacatcactaaattagccatagtaatgttactgtttcacattgagggtttcaggtgtgatgcttttcagttttttgtttttgtttagataactattttagggtttgagttatagttatgcaaatttacattacggtaatgcaaatataccttccaaacttgtgtcaatatgtattagacgctaaaatgccctcccctcccatctctgtttccctcaaattattcatttgtggttaaactaattttaaactccggaaaagtggttaagccaaaaaaggtcagatcctggaagaaaaagctctgaccttttaaaaagagtgttggaaaagtatttgacggtcattttcataagctaaatgtactgtgaggtttgtgtttgagtagcttttaaggttttctggattatgtggttgaattttaaggaggaacttagtaaaaatgagttgggaaaattaacctgttacattctaccttccttttgctatgtatagtagatctacatgtgagaagtcatttgcaaacagcatttgttaggtgtcttttctaagtattttttatgcctacaaagtctgggaaaagaccattttcagatttcagataatatttcagataaataatgatcagatcagtagatactgtctttcagatctatcagaacacagtatttccagaatataattttacatcacagtcatcatttataatgacattgatgaccagtactattattattttaaagagaaagatatatatacacatacacataaagtcatgcattgcttaaagacagtgatagattctgat

SEQ ID NO: 123960 - DNA, 1021 bp, Homo sapiens
ttttttttgaaacagagtctcactctgttgcccaggctggagtacagtggcttggctcactgcaacctccatctccagggtgtgagcaattctcatgtctcagcctcccgagtagcaggtaatacaagtgtgtgccaccacgcccagctaatttgtgtatttttagtaaagattgagttttgccatgttgaccaggctgatctcgaactcctgatctcaagtgatctgcctgccttggcctcccaaagtgctggaattacagacgtgagctactgtgcctggcctagaataatcttagaagtcctcatggatgagtaaatatggatggtgaaaagcttaaatgagaatgtcttgtctgattttcattccacttttaatttgaatataccatttcctttcccccctcattgtatatgtctctacttttttgttctttactttattcatagttctaatttctactcactgccccatcttttccttcttctctatctagctcttaccatctgtcatcactgcttttcccactatcatgatcactcactctagcagcaaccaaatttaactttggggatggagcagtagtgctggagaggccaaatggtatgagtaaaagaatacagcttttggagtcagctagattttcatctttatgtggtctttggtgaaagtacttaatccccaaatctctctttcctaactatgaaatgaaggtgaaaatattacttacctgtaagggaatctacctgataataatggaataaaatgctgacttccaccacagagttcttggggaggctttttatgtggaaagacattagacttcattactctgaattctggatttgtatctcctagccatatagactgaatgactgtagaatccaacataatgcttttaatattggcataacttccttagtttaagttatatgatgagatgtagaaactcaataaaaggtaaaattattctttgtgttatgaagtatgtttagaggtttcttttaagaggtcttatttt

SEQ ID NO: 123961 - DNA, 1501 bp, Homo sapiens
gctgcgtgctatgtgatattgcaacagattgaattcaagagaagagagaatctagctgtctttattaaaacagacatttaaaagattgcaaaagtataaaactgaccttttcagtaatttgtttagttggaaaataggttattttctgtaaaatgtgcatttttggttaatatataataagtttactagtattttaaaatgaaaaaataatttaaacatttttagttttaatttctagcgtggtaagttttattagacataactttcatgaacagggatctctttgggctcctccaattaatttttagagagtggagtcctgaaaccaaaaagtttgaacagaggagtgacatctcacttggatttcagcaggctaactccaaagaataaagaatagactgaccaaggtagtggtggaagcaggtagaccggttaggttaagattaggtaggaaatgattgtggttagagctgtaatgttagggcttgtgatggtgaagtgaaattggggatatagtctgaaagttgagtacacagtatttgctagtggatggaatatgaagtgtgagaatggacttgacattgtgtcattgcccgagatcaggaggaacaaattttggggaaggcttaggagtttagtcttgaatgtatcagataggttgagaagggagttggtgataggatttcattgtggagggttggtctggaatgtccattaccagggtttttgttggattgtattagtaatatatattttttaaatatagtatttagcttctaatcagttatacttttacaatctcaacacagagggctgtattctgcattgaaaaactgattaaatttgctttccaagtatgttattatatgatagaatgtacacttgaagaggcagtaaaaaagtaataaatgtagatttgccagtagcatgacatgacttagattttctgaatctttgtgaagtaaaccaactgtggtttaattaaaggagatcatattgcttaccatattaaaataatgttttcaataccaattactttgacatttgaaggcactgtgtaatatgttggtcttgttacagaccaagatatttttgctgaattttatttttcgaattcaatgtcagtgcttgttgtagttccttttggaatattgtgtatagtagattgtttcttaagcctttaaaaaactcttcaccgggtacagtggctcacgcctgtaatcccagcactttgggaggccaaggcgggtggattacgaggtcaggagttcaaaaccagcctggccaagatggtgaaatgctgtctctgctaaaaatacaaaaattagtcggtgtggtggcgggtgcctgtattcccagctacttgggagactgaggcagataatggcttgaatccgggaggcagaggttgcagtgagccaagattgcgccactacattccagcctgggcgagactccgtctcaaaacaataacaacaacaacaacaacaactcctcttgg

SEQ ID NO: 123962 - DNA, 1465 bp, Homo sapiens
gctggagtgcaggggcaccatctcggctcactccaggctccgcctcccgggttcatgccattctcctacctcagcctcttgagtagctgggactacaggcgcccgccaccacgcccagctaattttttgtatttttagtagagaagggatttcactgtgttagccaggatggtctcgatctcctgacctcctcatccgtccacctcggcctcccaaagtgctgggattacaggcgtgagccatcgagcccgaccgttgtggggtatatgtcttaatactggtaatattaactttgattagttggttaaggcgatgtctgtcagatttctccactgtagtttctccttttttccttagtaattaataaatgccttacaggggagatactctgaaaccgtacagctatcctttcatatttttgctaactaatttagcattcattgaatgatttttgtttgcattgatttttactaattaaaattctttaaggaagagctgtcccctttcccccttgtatttatttattcagttatttatatcaatcttttcttatgggttgtaattcattactatcactatataagtaaaaacttttaagaaaagtttctgaaaagttaatacattgagataattcaaaattcagagactcgtaagagtacattttcttctatccctgttatcttgggtacccgtttccattgctaagagtttatttttattctttcagaaatattaaaggattgggaaaagagttgttaataataattgctggattctcaggtatttctttttacctggattctgatgatatcaaactaacttgctgttgcatcttcttcggatattcattaaaatgttacttaactagttcgccattagatttaaatttacatttcagtacagtgactattatatatagatggggactggcttcccctgagtatcctaagaaacgacatgaccagaagaccacattttctattaaataaataatagttaaatattaacgtgtaaaagtaaacaggtttaaaagtaaactcttttttggtaagttgaaacaaaagtcagtttaaatgagaaaggctgcctatccaattaagtaactggtttttcaaaagtgaatgaaggccctccccaccaagtcccccgctctgttctgttcttttcagtgacctattttactttctgtgtctactggcagtatccgtttattcattcaggatgtcactttaggaacctagacctggagttcatctacagaactgtgttctgttaaaatggagtgaaagaaaagggctaaaaagactttctttcacacgctattaaaacagtgaacatactggtctacacttattatagtacagccagcaatacatcaaaaggtggcttattccattttatttccattctctaattaccgtttcttaaaatgaattttaagagtttcttatgccaggaaatcctc

SEQ ID NO: 123963 - DNA, 1047 bp, Homo sapiens
ctgtagtgcagtggcatgatctcagcttactgcagcctctgtctcccgagtttaagcaattctcctgcctcagcctcccgagtagctgggatgacaggtgcctgccaccacacctggccaatttttgtatttttagtagagatggggttttgccatgttggccaggctggtcttgaactcctaacttcaagtgatctgcccacctcggcctcccaaattgttgggattacaggcgtgatccaccacaaccggcccagtaattcagatattaaaaggatatgtacaaaagtagcagagtgcacgtacaataatttggatacagtaaaagagtagtggtaatggaaaagccaaagacaaacatgagctgaggctgttgaaacatgaaacctaagaattactttaaaaccttttagtgaaatccatagttgggtgaattaaggggaaagaaaaaagaataaaggtcacataaaacagaactgtgcagtgacatcggagcagaattaactgacagttgagccttagtttggaaaagaaaaaaaatcaagataattaaagcagagaaatgtgacgaggcagtaagtagtaacaggttttcaggcctaaacaaaaaatagttttcagcgtagtgaaattcgaaaaaaaaaaagtaaattcaaaaaattgtaggaaatgggaggagcctaaatgctgtaaaggcaaatactccccaaagctgaaaaatgtatatgctaaatttgatggcataacctgtagattcctaagcagattatttcctatttaaactggtggctccagaaggaggttctggtcccattgtagcttgggatttcatcaagtagtagataaagatgtgcctgtattttgggatctgggccaaagaaatctgtgctctataaaattacggttggattcttgactcggagactattcatccttaaagaataaagaatatcagctgatagattaatatcagtctgctgaagggatatgtgtagcagaaaataaccaggaaaaaaattgaaatcttctgttggtgtctaaacaaac

SEQ ID NO: 123964 - DNA, 1056 bp, Homo sapiens
aagatatttaaataataattatatggaaagtgcttttttagtccagagacctggctaaaggatgtatgtgtgattttaattagattaaatttttctaatgtcccttggttaattacttgctgtaattatgtaaatgatgtaaaggagtttaaattgttgcttggttgttgaaaacttgatttgagaattgctgtcatatgctaatttaagataaacaccaagttgatactggacattattaggaaagatttaattatgaagctagaagtataaaaagaaccttaggaaataataaaattctgcccttatcatgtagtcaaatccaaggtaatctctagatttttgttgattttatttgctattcagagaaaagcatttcgtaagctttgacaaacaaattgttatttaagagataaaatttgtaatatgaatattggtatcactgaagcagaaaatgtattacagtgccttttttaattgattaagattttataactgagtaagagtacctttgatcctgcctttttgctgtgttggattttatttaaccgaaactgatttaaataactagttagaaaaattaaagagtgccttcatatttgatagttcctaaggaactatcaataaattgaacttccccatgtttggaaagcatacaaaatacatttaaaaaatacattttatttttaaatactaatggatgcaagcctttctcccaaggaggacacagtctgtaggatagagagacattacatctgcatctggctaaccttaataatgacaacccttattgggcagtatgttccaaaggacaggagcctgtcttctggtgcatactagaagcttaataatttttgaaaagatccattttctttatgggactcggctcattaaaatagaattctcctacttttaaaaaaaatgtctatgtatatccaagaacagtaatacaggtctttaaaaacaggtcattgattttaggtattgctacttccttttttatatttaatatttcaatcattaacccagtgtagcttgatctgttaccctctttcc

SEQ ID NO: 123965 - DNA, 1868 bp, Homo sapiens
tctgttgtcttttgaacatctctgtttggatattccaaagatatctaaaaataatggaagtggtcccgtttaaatatccttcggacaaattagttctgaagtacaaaagaggctttggtattagttttgtctgacaggcattcttatagttgtttactgaagctatgatttggaatgactggcctcgtttagacttggaaaaattagatgaactaacaagtccatattataccggttaggaaggagctcgggctttgaagttaatttaataagatatgttatttgattcgtataaaaattggtttgtagtagaaattaattaaggctatagtcttgtttaaacatgggcttaatccagagaatgatagaataggccaggagctccttatttgagttttaatgctttatcaatgaaaccctcccctgccctctcttttttcctctggactagcaagaatattttttttgtctaacacatttaaaatttttacttttaacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagatgtaagtatattttgttgttttattcaattttgttctgcttcacatatgttgggaagagatatatttggtggtaaatacttaagcattattagccactttaaaaaaatgcagtcatcaactgaagtgtgaataatttggcatgataatttaaaaaatttctctctaaatatgtttgcatttgattgctgctatgtcactttggaaatgcacatggtatagactcttgggtttcaaaactggatgaggaattgtggaaagcactatggcctgactgacacagagcaccaagcacaacattgctcatctttaatctgaccttcaagaagccacagcttgggccacagcattctttctgtaaaatgaaggtgttggaccataagtttcctttcagctctaaaatttttattgaaaccactgattgtaatctgattttcccccatcttagtccattgttgaactattctctataagcatcttgttgtgaatagcctccttgtcctatatctgttaatttctaaataaatccagattctttgctttttgttacaaagccctatatgatacggtccattctatttctctggcctcatcttaaatgattttccctcttctttaccacactgtagtcacattgaccctcttttggcttttagaataagtcaagtctattcccagtcttagggaccccatgttagttgtgctctgatctctactggctggctgcttcttgtcattaagaatttagctcaaatgtcacttcagagaggcttcccctgacctttttatttaaaagccatctatctagctactcactgtttcacgttgtctttttttttctttgcaatagcacttataatcgggcatttttctggtttattttctctctctctgtctcccctgaagaatataaggtgtacataaaataagaaccttgtctttgttattcactgctgtatccctcataatattggcacataataggtaacaatacttgttgaatgaaccaagaaaagatgatggctttttgctaagtttcagaggacttttatgaaagcagatgaaaaaaggagttattataatatcaaaaatatgatgtgctctatgattctttagttatatggacagaatactagtctgtagatgagaaatgtcttaagttgaattaataggaaaaagctttgatattttacagttacattacaatttgcaaaaattgatctgatac

SEQ ID NO: 123966 - DNA, 2508 bp, Homo sapiens
ttttataaattagctatttctccaggagatgtatttagccacttattaatttataagaattaatatgaaggtaacaaggcataagatgctcgttttccctcaaaacacaagacattttggtatatagtctccaacttacaatggtctgacttaggattgtttacaatggtttgaaaggatatgttttcagtatgcttctcaatttatgatggggccatctccagataaaaccattgcaactgaaaatatcgtaaatttaaaactgcactttcaactcagtggtgggtttattgggacttaactccattgtaagtcaaggatcatctgtattcattctgtatttttaattaaaaacagttgtgctgttaatatatagacacaactcttctctcatcttacatacttgtataagataggcccactagtgttgactagattgggtgtggtccgttttttgtcttctgctaagtgaaagacttcagaaaatatacatatacgcttctgtgaatgtatttgtttcatacccactgtgttgcttatgtgatataatgaaagatttgtaaggcatctaactaaaatcaccctagaaataactagacacaatatttaaaaacattatcaatctgttgtgcaaaaagcaatccaaaaaagtgcattttttaaatgaaaacttggtctctccccttgtccccaaattttaggcacagattacactttatcagttcttagaagtgtttcacttgaggtgcttttcgaaatccattttttattatctattgtgataatgtgttgcaggagtttatctttaattagggaattttaaaaaggttaatggaagggttttctataatgctttacattttgtcattgggaaaaatctatcatttccatttaaaatgaagtgtgagcagcaatgaacagcattagacataattgttgttaaacctcttctttgtaaattaacatgccacttggcagaaatataattggtgagccacagagaaggtctgtatttaaacagtagggttaatgaatatctttttttcccctttttctttcccttcttttggcctttaaagttgcacttagctcaggctgtttgaaatgattttctttgaaagtgttgtgacattgttttaattgaatgaagctgcagaactggcgtgataaatcaacacagaatgaattttaatgcaaggcaaacgatattaacctggaaattggttgcagtagacaaagcagctgctgtgattagttttttttttttcttcattctctacttacaacattttgagaaggatgacctcgacaatttcagctgtactagagtcctgatggcttgcaccttaacatccttgagctgtttgtggcttcttggggcaatagtgattgtttcattttttaaggttagtaaaattttttaaggttagtaagattagtaaggttagtaagatttaatgtgattttaactgctttacaaatatttttaatttagtaaatcataattgtgaggattaattagctgtggtagaagcccttttctatgtaatcttgatgtggttccagccaaggagggttaatacttgaaaagcatggggtatgccaaacaaggctctatatgtggtcacagagtgtagggcagctggtttcacaaagggtacgggtcaaaaccaattacatattagtgatttgtactaaagtatctctgttcataatgcatttttccagacatttttgggccatatgtgaagtatataatgtgtatctagttagtgacaatttgggaaaagatctgtatagagtacaactattattgaagagtagctggcaaggttacttaaagaaatagccaaggtaacaaatatagtagaggcattttcacagacttcttgagagcagagtttcgttattctcaatccttcacatttacttcactccttgccacataataagccttaagtaaatgttttgttgaatttgaaaatgaaaggctgttctctgttttactgaaaaacagtgggtgagtgatagcatgtaaagattattatctctgtccaggttggaggagtggggaagtgaaatttaatgtaatctgtgacttacataaactggttaagtgatgatgttgtagaaaaaagtaggaagagcttattggagatgaacataaggccaggcatgttgatagattttctgttatgtttcttttttattcagatcctcatttcaacattgttacaccatactaccttatgtcaattctagacctctttagattaaaaagcaactgctcaaaaagtgccagtagacttgtgtttgttaaggactgacaagataatgcaggccagctgagcaattccaggaaaataggatacaataggaaaaaaaataactgaacacatcagagattgtgaatcagcaagattgtgaagaattactagttcatggtcttcaggaggtgagatgatcaaggatataaccgtgttttgggggatctctttttctgctgag

SEQ ID NO: 123967 - DNA, 1090 bp, Homo sapiens
agttgctttggagaaagtataatttttcttaggtaaataaaagaggactttccccaaaggattttggtagaaagggcagtgcctaacaatttcttcaacactgtcatgacaaagagacagttggacattttgtggaagggacttgtattcttggctggcatctaatattttgtcaaactctttaatactctctgttttaggttatttgttgatggacagttgtatctgttctagctgtatactgttcccagttcatagtttgtgttaatacttgtgaaaatataatgctaaacgatgagctattgtaattagacctgagacttagcaagaaattcataagggctctagattttatttcaacttagtattaaaaagacatttaacttcagtaagtaaatgtagatatactttatattttaagagctgtaagttccagcaagtgaataatgtatagtgatccttttttttttttctcagtttaattttgttgggagaatccttggacctagaggacttacagccaaacaacttgaagcagaaaccggatgtaaaatcatggtccgaggcaaaggctcaatgagggataaaaaaaaggtaagtccttgaaaatggactaagtctttatgtgagtaacttactatacttttacatcgtaataataaaatttccagatttttttgtgcttaaaacactatattccaggccgggcgcggtggctcacgcctgtaatcccagcactttgggaggccgaggcaggcggatcgtctgaggtcaggagtttgagaccaccctagccaacatggtgaaaccctgtctttactaaaaaaaatacaaaaattagctgggcgtggtggcgggcgcctgtaatcccagctactcaggaggctgaggcaggagaattgcttgaacccgggaggcagagatttcagattgtgccactgcactccagcctgggcaacaggagtaaagctctgtctcaaaaacgaacaaacaaacccactatgttccatgtcaggaacttttaaactttttaaaggtgttgtcatgattttcccttgtttttcttttttctttgtttgttatttttgag

SEQ ID NO: 123968 - DNA, 1039 bp, Homo sapiens
ttagtgcataaatacccagtggaatggtactagttaagatcatggaaccagggcttgaaaactattatgaacttcttgtctgtaccagctattttgtaaatgaagagaccaaagccttggggaggttgagtaatttgccaaaggtcacacgccaaaatgtggcagtcaaatttgaaactaggctgggcacagtggctcacacctgtaatctcagcactttgggaggctgaggcaggaggatcccaggagttgaagaccaacaaggtcaacatagtgagacccccatctctacaataaaacttaaaaaataattagccaggtgtggtggcgtgcacctgtagtcccagctgctaggtaggctgaggagggaggatgcttgagcccaggagttgaggcaacagtgagctatgattgtgtgccactgcactccagcttgggtgacagaacgagactctgtctcgggggaaaaaagaaaaagaaactgaattctgagttctattctgtggtacattattttctaattataaaccatttctaagagtgataacttcagacatactagaacaacttgaatattgagtattagaaactttgactaccatttcacacaccacccagtacacttgtgaccccagatgttgtaagggtttctccccacaaaccaaacaaatctccagaaaacaccatctgaatgtcctctaattcagttcaaaactgggaataatgtcacataccacaggctgagggctcagtcccctaagactgtctccacttcagatgccagttacaagccccagtggtgacctgtgcttttgactgaccagctgtaaatgtgtttttttgcaagtccctcgtcgggttcaattaatttgctagagtagttcacagaactcagggaagcactttacttatttattataaaggatattacaaaggataccgacgaacagcagatggaaaagatgcatagggcaagacatgtgggaaggggctcagagctcccatcccttctccagtgtgccaccctccaggtgcatcc

SEQ ID NO: 123969 - DNA, 2840 bp, Homo sapiens
aatatatttatttcatcataaatcacaatatcatactatcattcctttgatttttcaggaattctccctagaggatttaatcccatgtacttaatggaaatctatatacttgagcagattacaaatgctagaggagtaattttagatgagatcgggtgcattcagtatggtatggtgtagactagaggatgaattttaggaaaagaaagtaattatggtgtttcacttgaggttgcagaggccgtatccagggctgtgaaagaaatgtattcatgctaggaggcatggtccacctttagaaacaggtgggagtcagctggttctaatgtagcaaatgagaacatgtaagccattaaaacagaacagtgttttgcacgtaattaggtacttggcaaattgttgtggagtgacaagtagtacattgaagttcaccctttgggtatatatatgcatggtcattgtaggggacaccatttgtggttttgtcttatccgtctgcaatttgtcagctcttctgaggtctcccttctcataaacaagaggagaataagtagccatgcttgtgggttcctccttctcacctcctttttctgtccttccttctctcccattgtgttgatgggtgaaatgtatgcagtttatcaaagccatgtcagtcagatgttgcatcatctggaaatgtgcaaagacttagcaattccagttcaagttctttgctcaaaatgaagggatgtgcattcttcttctagccattccagggctgctaataacagtggctagagcaggggtgtccaatcttttggcttccctggaccacattggaagatgacaaattgtcatgggccacacataaaatacactaacaatagctgatgagctaaaaacaaacaaacaaacaaaaacctcatgttttaagaaagtttatgaatttgtgtggggccacattcaaagccttcctgggccgcatgcggcctatggaccgggggttggacaagcttgggctagatggtatcagccacttttactatctgtgctgcatcatgttcagaccatgggacaaccttggaaaagagttacactcttccaacggaaatggaggcttaaagaagtgtagtaacccacccagttgctcatttctacctgaagagtacacaatatagaaacttccatctctcactggatattcaaattcagttgtacaaatcattcttgtcagaatgtgggctttgaaataaattggtaatagtttttaacttaatatttgtttcccaaatgtatttggccatagtctccccttttttgaagatgtccctataactccttgaagaactacagtgttttgtggaacatgacttacgaaatgttattagagtcatattgtataattgcagacataggtggaattcttgaattttgttttgcaggacttgtttaggtagagcatttaataacttcttttacgtgatgcttttcatatacattacaaattgttaagtatctcttatagcagagatttcttagctctatttgttatgcttaaaatatattttaattggtcaatatgttatatttttagaaaagtgagaaagtcctagagggtctcaagaaaattaaaggctcctgacattccattagtttagacactacccttgtttatagtttggtatgtcttgtagattgttcttcatgcagttatgcatatgtacacgtatggtatattaagtggatcatattatatttgctgctttataatcaacatttttttcctgcaactctgtatcctgtcctatgtcagttcaccgaatagtagagctttatgcctaagactgtgataggtgataggaaagtacacttaaaggacatttcaaggcagcattcatagtgatatgcaaaaataaatttccttgaatttttgggtgggggaacttacaagattttattcttatgaaatatgttactgctgtgtcaacactttgaaagagagaaattaattcagtcttgtgattgatacaccagagtggctttggcaattggtggcatgacatcaagtacaagtagggttccaaacagcctgttttatcgatcttgttgaatacttagctctctgacaagctctagcatggatatagttttttttttttacgttttcattatgcaaaattttaagcaatggaaagacaagtagtgtagtgaactctaatttacccatcacccagggtcagcattgcctctctcctttcaagagggaactctctcattccccattgcctcacttcaccttttgcctcccagattattttagaatcaaattcagacatataatttcaactgtaaatattttattagctatctctaaaatagaactctaatgataacgtgtttgtgttttaatatctagaaaattatttatcctcaaatatgttgtcagtgttaatagtttctctggtgtctcattaatatgcttttaaaataatttgttttaatgagcatacaaatgagggtcatctacattgtaattgatagatctcttaagccacttcccaaacctccatttctctttcttggcttcactgggtgatttgtcttgaattcctgtggattttgctggtggcattttcttggtggtgtttaacatttatctctgttccccatatttcttgtaaattggtaatgacaaaggtttagttaaattcagctctcccaccttctctttctcatttctgttcttttttgaaagaatatttcataactagtgttttgatggtagtacataaagtctcatttcctctctgtgattttagcaatcattgttgattgttttctaggtcctttttttcagt

SEQ ID NO: 123970 - DNA, 1811 bp, Homo sapiens
cttatatccaaatttatttcattttgaaagcagtgcattgacactcttctcttttaaagatgagaagttatatgatgtattaattgttttggaaaggtaacttgacagtagtggaagagatggacagaagtgggaagtgactaaaggcagaagacaaatgatcaagtctcacacaactctgcctagaaagttctttcttgtgttaggataaaatctttgaaacttcagtcctctgatcttaatctactttgaattcaaaacaaatataatctcttaaactttagagactttgacatatttaatgacagtgcttgtcttaaaggtgttctgccctagctaaaagtttattgcctagtagccttagttctcttttttgttaagatgtcatgtgatatggtgttgaattcaacttcaaaagtggtagattggtttgtttttaaagagaaaagaagacccgctatccttttcagtgcttttcaaactgtctgtggtaagagacccactaaaaaaattcaatccattatatcttttggtgaaatacaataaaattagttaccagagaagtggagttttaaaaagacatatatttaaccccatttaaaactgtcttttatcaagagacataaaattatcctgtcagaatgctcaaagagtttctgaacaggcttgatttctgtacttgtaggctgcacttccggccgcactggtttaaatgccaactgtgacgtggtatgtttgtttcaggattgtaaactagctccctggtgtccctcctcctctacttttgttcttctcactccctcatttttttttattttttatttttttgctctgtgtttataaaataaaattcattttagattattgactagattatttttaagtttgatttctggttacatgttcattaaggactcaaatggcttagctttgttttaagatagaagagtacaaaacagtgcaataaagattaaatgtttatttccgggttgataatatctcagtacatttatagagtggagtcactgctttttgcccattgttaagaaagattgggaagacttgaaataaaaaatttatttgaaaatacatttattaaaatttgtgagacaccctttgagaggtaaaaagatggacccaataagaatagacttttgtttttattagtaaagtaatactttaacctgtaaaacttcatctcattactcagccatagatataactccaggatgagttaattgcccatgtctaatgaaatgagacgtgagtctcagtgaaaagggagagtccattttatcactagatgctcttaatgagccttttaaaattaagtcttgattggattgcagtcaatttcgttaaggaatatttgagcatcttgtagttgtgtcttatgtaacattttctttttagaggattcagctctctgttgacagagtgagtagtggaatgttgctgatgtgtattaatgctgcagcaattgatcttttcaaaacccgttaaccttagttggaaataatttttcagtctaatatattaacaacaaattattaggccgtttcataagcctagggagccatcctattctatcctattagttttagttttctgtttatttcttcagttatgagagaccactattaaattattttgttgttctttagattttaaaacatgtaattgttaactctcgattttaaatacctataatttttagtttggtgtttttaaatcacaggttgttataggacatagtttgtggggctgtgtttaatgtttaacaacaattgtgaatctcagattgttgaaat

SEQ ID NO: 123971 - DNA, 1060 bp, Homo sapiens
ttaggaagatagaagctaaacaattaaacgaacaaaggtaatttcagatagggataagtgccatgaaaattataataatgccaggcaatgtaagtatgggctgggtggaaggcttttaactaggagggccaatgaaggactctgaggaagttacatctaaacagagactctgatgggtggttgacatggggaggtctgcagactgaatgtttctgggtgaagttagagcaaaagctctcagttgtgaatgtgatgggactgtccaaggaatagcaaagtcagcaagggtggaaagtgggaagagaagacgtttatgtccctgttcatatgcttctctataggcttggtaaaattttattggaagtaccaggaagtcagttgatggttttaagcagagggatgatatgatatttatttttagcaagagttgtctttagcaattagagacatgtatgtgtgtagggagttgggcaagagttgaaggaaggggattcattagttggctgttgcagttgttgaggcaagagatggtggcatggactgggaatcgtcttcagattcattttatttccatgctgttagaattcttcaacatttgctaatcttggctgaatttccaaagcacttgttctctaaatatacaatgtaatgtttatatttattgtttgcttttgtttccttacccaggctgtcttcttcaggagggactaatttatatttccaatttcctcaatgaaatgtggacataattggtgcctactaaaaaaattatgttcttcctacagaattttacaggaaatttcttattttctgacgtagaggagcatcaaataatgcatacacttagaaatttaaataaacaactgaataagacttaaattacagaatagagaaaaaaccaacaaatactttatgaattagttggagtcgaagttaaggaaagttgaatgtaaaacctaaaagtaaaattaattgctaagctagaggcaatatgtgagcatattttgcaaagactttggtggccatattaggttttcaagccacgcccacacacataact

SEQ ID NO: 123972 - DNA, 1289 bp, Homo sapiens
catagtaacacccacatgtagcttctgatagaaacccacaaaataagatgaaaatagtttctcagtcaaatggttggaatatttagtaatacttggcagtattttttattttgttaataacaggtgtcatttaatacaatgacttttaaattatatattaaaagaaatttttaaaagttttatggcaagctgtgaaatactcagatggataatgtgaattaaggcgtgttctttggccactcaaagtgctccccacccaacactggcatggactgctcactaggtggccaaaagagatttcgtttatggatgtgttttgaatgttttaacattaaaaaaaaaaaacccaaagcatttgaggcagagatttttttagacaatagttgtttaatgagctgcttgtacatacaagagaagagaatgggcctgattgctcacaatctgatgtttgaaaagtatttttctggatcttatgcatttgcatatctaattgctatgtaatcaaaactaagtgaactgtagctacttgaaactctaaaatgaaaggcaatcatcttacggggaggagggagaaccccgttccatgcaagctagcctgaatattagcattatagtcttcttgtgtttaattataggtgtctgactgagcagtaaatttatgcttgtgtaataaagaaatgaatgtgaccctgaaacaccagctcagctttgttgtaactgagcattggctttgagagaagttagcatccattgtgtattttggtgataagggattgtgccagaatggctgttaattacgtactttatgtgatacagaaagtagtggttctacactttctttccaccagtgacagcactcaattaaaacttgtattaagcagctataatgcctttatttatctgtttggaagacatgaggtgaagaaaattaactttattttttccagctgtttgttggcagctttgtttttggtaaatcctttgaggataaaaaactgtttgttatgtgtcctgtatgctttcatagactaaatattttattttttgctgcctcacaaaaaggttattaagagatattttatattcttgccgggcatggtgcctcacacctgtaatcccagcactttgggaggttgaggtgggtggatcgcttgagctcaggagttcaagaccagactgggcaacacagcgaaaccccatctctacaaaaaatacaaaaactagccagacatggtggcctgtgcctgtgttcccaactacttgggaggctgaggtgggaggatcacttg

SEQ ID NO: 123973 - DNA, 1061 bp, Homo sapiens
tgtagcagtgtgagagctaatagaggtatcagagagattttcattattcttgtgagattttcccaattgaattgacatttcagttgttggtctgttgaataatgaatgcactataaaagtggttgttaaaattatgataagggaacaagatcagtcagtaaaatccatgtatgggagttttatgattaagaatatttctgtattttgtacaggacatctgtaaccacagaaaattgcattgtacaaatgaagaagaatacccttttacatcacatgatttgtgatatctggaaaatctcccaagcacctggtttctggattttatttagatttttcaatgtattttctaagtcttaggcaatattttcagaaaagttagttctttcctactcctttgatcctataacttagccacatcattacttaagcacttagtctgctatagtggattacagagttctttaagagttgtaactcttatcttaaccactataatgtgcatagtgcctggcacattgtagacacttaggaatgcttaccatgacccttagtattgtatatttgagttaattgctagaatttttaatatctcctattgaatttattaatactattttcatacataagtacacccctttcagtgttgtgttttaagattatattacccacttcattcctcccatccctcactctcacccaccaatggcaactttgattaacatgtttgtgtatagtaatcctgtggccacaagcacatagctgtaagcaaggactgaactagaagaccaacttgattctgcgatgattaaaggaaaaatggctaggaaattgactttgaacatgagtaatgggcattgaagccagtctcacaagagtaaacgatgctttgggtgtgctgtatcacctgtgaatacagcctaaaagttatgcctgtcaccaaggaaatgtttctggttgcaggaggactggagataatactgtaactagaactagggccaagctgccaaatggcctgaatactggattattgatatttctatggaagaatgggctttgaactg

SEQ ID NO: 123974 - DNA, 1134 bp, Homo sapiens
gtaagataagctagcttgccaccacagtttcatggatgatggcagaagacctaggacttctgaatcagaagccatgctttattatttacagcaaaaatagtagcagagtgttagcatacttgcactgatgccctgagccctggtgtgcacagggtaatgcagaggccagacaacacctgctcttggtgggctggatttcagaagaggagcccagggccaaggtccccacaattcttgagcaagaagcagacaaggcagtcctctacccttgacctcctcagttgcatatgttactgcagaaactgctcagccagaggagatagataacccttgcactctggcacactcagtgggaacattgagggctgctcagagctcacccaacagtggttagacaggaacacctgtggcttactgctgcctagcttatggcattaatgagacacatcgggtttcaaaaaaaccttaaaatactttttaagaaatgtcttagaataggtgacacactgtaagtaagtgaaatcaagggccaaatttgaaatactgtatttaaaaaatcatggaaaatgcaacaaacagctttagagctatacatttgaaaactgataataatttatttatcttaaagatatgtattttcaaatctatatagtaaaatctagttagaaatcctaactttttttctggtggaatttaatgaattgattacagaattcttaagatagtaaaattgcccattggtagttgggacagttctaaaagaaaaatggaggagtgctttcagagcatttaattcttatcagtttcataattgtctgtatgactgagggataagcaggttgaccaatggaattagactaagctattttactcggatatgtatgtgtgtattgtggaaagaaagaggtagatggagagaaatttacatgagaagtgggaagcgtgaatttaataaatgatattaggatagttgaatttgcatatgcaaaaataaatcttttgatggatcacatgcccaaaaatgaagagcaaaaaactcaaccactagaagaaaacataggagatacatttatgacttcattgtaaagcaggattactgactagaaaacttataaaggaatatcagtagctata

SEQ ID NO: 123975 - DNA, 1114 bp, Homo sapiens
tgaattagagaatgaaaactttgattcagttcctaaattgacagcctgttagctgtgtgacattgagaggtgacccccttaaccttgatgaccttctgtttacttataagtaaaatgcagaaataatgacatgtttctcaaagtgtttttcatggtaatgtaaggacagtatcagatgtatgttgtatgatactacatacatgatgatgatgtatgcttctagtgcataggagcacgcttggggctgatctttagcatctggttctgtgcctggtagatagtaagtgctcagtaaatacttgttggattaattatcatttgacccagtagtctcacattcaatcaaactttgaggacccagaaaaataattcaaagacttgtgccatcatagcaaaataatgcaaacatagctgaaataattgacaacaggttagtattatgaaagatgtgctctctctttaaagagaataattttaatcatgtactctgtaaattttttaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagtaagtaataatttccagaccttagatttgggcctcgtccttttttgtcagtttattttaaattatcgtaatgtttataaggaataggttattggttgttagaaattttatttaagcataaaattaaaaacacctgactgatacttctaacataataaaaacataaagttcgtatttaggggtccttagatagacattaaaaggggttttggagggtgacgtcgcgtaagaaattatccagatgcttttgtgttatcagttctccttccttcccggtttctctttccccatctcttcccccatctcttccctctgccccccttccttgggttggctccttattgtttcttaaccctttaatatttttagaaataataattgtactactcccagagtataatttttttttttttaacgggaaatgaaaaataaattactggttttctgggccattaatttttttttctt

SEQ ID NO: 123976 - DNA, 1109 bp, Homo sapiens
ctattggaaaaactagggctgggtgcggtggctcatgcctgtaatcccagcactttgggaggctgaggcggttggatcacctgaggtcaggagtttgagcccagcctggccaacatggtgaaaccccatctctactaaaaatacaaaaaataagtcgggcgtgatggcaggcacctgtaatcccagctacttgggaggctgaggcatgagaatcgcctgagcctgggaggcagaggttgcagtgagctgagattgcgccactatactccagcctgggtgacagagtgagaccctgtctcaaaaaagaaaagaaaaaactaggaatactgttagtattgtgtccaacaaaaagcattggcatttacataaatgagttatggttcctgctgctttttatttcccagatagcctattctttattaccctgatagtttattcaacaagtaaactcacaaatcataaacatttcccattaacttgatgaaattaattccttggaataaaagagttttatgtaaattctgttggtagattttattttttttaatgatcaggttaaatataaactaaaatctatatttgtgtactattaaaccatggaatctttctcattttccttaattgtgtggtattgaaaaactgtatagaaaaggagattttcgaaagtatactgggcaattagtgtcatgatcagaaaaagttatttaacatcgacttttactgctttaataacattttcttttctgtagcttactttattgtaagaatacggtatataacatataaaacatacaaaatatatgttgatcaactgtcaggcttccagacgacagtgggctattcgtcacattttgggagagttgaaagttacacaaggatctttgatgcagtctgtgtccctgacaaccgagccctcccttgttgtttgaggatcaactggatattgttagcgtcttttaaattttctatttacccagtcacctgtaatctcttgtcttgcttaccatttttatttctagtgtttagcatagagcccagcacatagcaataacatagtaaattgaaaaataaatgattgaatcttgtcataaggtaaaatcagttccttc

SEQ ID NO: 123977 - DNA, 4242 bp, Homo sapiens
ttaaagggtaagtgcattttaaattttattattttattcatgttaaaatttctaagttgccttccagaaaatttgtaccaatttactgtcctgccagtattgcaggaaaatgcctatttctcaacacacactcaaaccctggatattatcaaactttgatctttgctttttctaataggcttttttttaaaagccctttaatttcaaaaatgtgagtaaaatctcttggttcttataactatttgttatttaggtcagtttttatattaaggagctttgtgatacttacgtaacatgagatacttttgtaatgtaagaactttaatgttcacatcttgaactgttttttttttaaatgggaaatattccatttacattatcatataaagaatgaataagttctttttttttggaaagatagagtaagttcttttttagaaagacaaagagttttgtgtattttaatcattttgtgcccattttgttaggtgttgtatagcaaaaaacatctagtccaggcttgagggtcctagcagggtggggagtagggaggggcagactttttgcttaatataaactttcataaggaaatgtaataagtattttgtgtttttccatctgcagaaaagactaataaatctgattaaagattgtacttccttctctttgtgatgcagttctaatttttaaaataattttgaagattgtaatatttcatcagtttgcataactttacatgtaactaaatgtttagtaaatcagttcaaatcttttcaattcgtatttgggtttcaaaacaatctggtagacttctttgttttttaccaacaagcgtgcaaactcagagaagcttgagcattataagggcaattatacttgtttcttttcagagaacagttcagtattgtaattatactgcaaaagtaataagggttttgagataatcacacaccatttattagtagaatcaaataatattttacctggagaacatgtttactctgaaaatgacaccagtttagtttcagatgtttctttgattttgatgatcagtttactttattcctttttgtttcctggtgacaaaacatgaaataactaggcaggagttgtttctcaagttatatgtaggtttttatctagtctaaattggttgacttcaaatatctactttttttttcttcctgatccaatctagttctagagttttatcaattttatcaaccgttttctaagtatcagcttttggttttgttgatttttctcaattttttttctgttttattgatatctgcttttacatctttattctactaaggtttagttttacttggggacattttaaaggtagatcagtgatttgagacctgtcttttgtacttctgagacttttcttttaaggacatacattcctctctgagtaatgttttagctgtatccaacaaataatattatgctgcgtttttattatcattcagtgcaaaagttttttccaattttctttgtaatttcttctttgagccgtgttttatttccaaatgtttccaaatatttgagacttttctgtttatcatactgtagatttctaatttgttatgctcagtatgtatttgataagatggtagtcttttttaatctaataactttttgctagcccagcatatggtctgttttgatgaatgtttcacatacacttaaaagaatgtgaattctgcagtagttgcgtgtatattctgtattgtttatagatgaagatagttgaaagcactcagatcttctcctatgtctaccctttttttttttttccttttctctagttttgtctgttactgaaagaggtgtgtaaaaatctccattcattcattgtaaagatatacacaccagtgtgttcttgatggcactgaaagggcaaaagaatttggtgtacacatgtacatgcatgcatatctatgtatgtaatccgtctattatagcttatacaacctgtatgaacatggtttggcatcattaaaaagttttactctatttcatttcatatgatagtaactttttccttcttttaattttgaggtctttatttttttctccccaaataccagttatttcatgcagcatcttttctataaagatagtaccaagcagtatggcctacttgccttagagagactttgtaaaggtagtaattattttaattatgtggacatgaaaggcgcatacatgttcctccttcctctttttgcattttatgtgtttaactatgtatgggctggttacttgcaactgcatgtcatttgcaagttcaatttgtgatcccaaaaggcaccataccaggagagagtacttctgttccttccctacaaaatgtaccctgtttgctagtcatgattttgtcaatataggtttttatttacaaggaatagtagcccccccaaaaaatgaaattatataacattactaaaaaataatatatataaaactgtctctccacacaggagcacacattatgggaatgcttctcaggtatcagataccatccttcctccttccgttaatcctcattcatctagttggaaagtaatacatgatatttcttagtcaagactttatatggatacatattctatgatcttttgtgatcttctcagaagagacctaaaacacacaagaatggtgaaattggaggaatattatgctggattatgctgatattaagattgagaaagtagagatgagggatcctgtatcttgttttcactataattttcccacagttttaataggaagtggggaggtaaaaggtttccattggggagatagagtactaagcttgaaagggctagactgtaatacagaaattaagtgatttcaggcaactgaagttcattgatgttgtctcataagttaaaacagactttggcacacaatatgcctgcagacctagacatttcataaagtgttgaaataacaggtctttttctttatggtgagtaaaattgtgtgtttgttttctctgtatgtttactttataggtatttgagaacttgaatacagatcagtttttaacatatagctgatctctttatatacatggaggtcagtactataaaagtaaatgatctaatacatgacgacaaatttccacctgcgggttttgaaatttaaagttgtcatcaggattattatgacatttgaaaatattcatcaagacaaaagtaattttaattcattttcaaaaaactacatgttatagaaatttaggataataggcatctgttacaaaatgcactttttaaaagtttgcattttgtgttccccaaaggttcttttctgtctgccatatgcatttgactcataattaactgagtattaattataacctgaaaatgttaagagttaatgaatgagaaggtaacagacatcatgaccatagagatgtggtaattttatctttgatttagttctttaaccaaattgttaatgagttgatggtactgcatttatttagtccttgatcaaatattgatcattgaaatttgtggtattgttggcctccttttcattttattgggagagaaggagaggtattaaaacatatattaaaagacatctagaggtaatgtactggctccttgatagagctgtaatgggaaagaacatctctcatgtaaagaaaggtgttgttactgatttctaccttgcagagccattttaatctgaatgggaaatctgtctggggacccagagtgtggtaattagcagtctcttcagagtgtcagagcagaattaccattgtaatggtttagctgcaggataaaaggattgaatttgggactgcctgtctgccaacctaaatgagttgccatgggaattttcaaatgtgagaggcgtttacttaaagctttttggcgggtttgaataaactcataaattgtaggtttgaaagaaggcagtccttgctttctctcatataggcaaaactgtatagaaggctgatagcttcttaaattcttaatgagaatgagttgatccatgttcccatgcaggccatcagcttattcaggcttgttttttcactaagtatggtacaatgaagcacatttgaggaaagacattttgttccaagtctctagaggaaaaaagtgacaactctagatataaatttcctatcttaatttaaatatattttcagataatgctattatactgattctttgttttgctttaacaaacgttaaccagata

SEQ ID NO: 123978 - DNA, 2623 bp, Homo sapiens
ttaaatttgcatccttcaagcactacattgaatccacatgaatgaagtgatatgtgggcgttgcattaggtattataaataatctagagatgatttaaagtagactggagcatgtgcgtaggttatatgcaaatactatgccattttatatcatggacttgagcattcatgggttttggtatctgtagattttggtgttctggaaccagttccccgcagataatgagggacaactgtactttcagagagagcttcagctctcccctgtctctcaaaagaattaaattttggtgtaatgactttttagtgagaaaatgttcctgcaaatgtctaaggtgatgaacatcacttacactttgcgtgccctcactcatcctcaagatatcagtaatagtagttcttacattggtggtttgtatctgcccttcagaaaaacacccgaagtacaatttaagccaaaaattttgagactgtaaaatacttttaacaaaataaacatggtctttttggaggtcttaacattgtcaagccattagggtacagtttcattaagcaaataataatttggttgttactaaccctagtggcctgaaaatgtggatgcgtctttcaaaaatgtttcaccagggaaatgtgggtattttgaggagagaacagttgttcaattcaggtgagaaagagtaaaattttttaaggtacaatacattttttgtttatatattaatctttactggtcagtatgtaatcacacatcagtataatctgattaaaatcctatagctctaagataactgttgaaccattaataaaacttgagtcatggacagataatgtcctaaaatctcatttaagtgtagaatacaaagacccatgtagtccttaccagagatctctgtaatttctgcagagctccttggaatcacagccatcacctttgtgtgctgtgtgtaaggtactctcatgggtatgtgctgctttgggaaaaatgatggcggagaaaagcactgcagaaatttaaatgtgctgattttctttcctgtgaagagggacaattctaagtaaaatccagttctatatcagggtcataatttttatattctatctccacattttaggtgtgtggcttattctgcattaggacaacaggcacattgtcctaactagaattttcacaaataattaaaagtaccatttgattcgggtgacattccatacagacagattaagaagtttgccaaggtataggttttaagacttccctcaacatcataccataattatctaaatcattgagcagctatataaatctttgcttaccgtctgtccagccgtaatgttgcctggcagtgactgtggcttcttaaacacaacagagggcttttccttaaacttggatgtttagtttgatcaggctccttggtgataaaaaaatatgtcttgtttctgggaactgaacaagctttcccaaacagagactctgtatgaataacatcctcctcttgattcttgtaaggattcgttgaggaaccgcttctttcaacacaaggttttgttcaggttgacaaaaggtttagacatcttgtaattctaaattttaggcgttgcaaatgtaaaaaaaagggaccctgggcatagaataatagggcctaggatatatttattaaattaaatatttataccctaggaaatatttttgcatttgtaaaggaagtccttttactttaactttgtattccttgcacccctcagaatttgcatatttagtttgtaacactttataattgcttgtacctattaatttaaatattaatgtaaactattttataattggtataaatatataattatatattttatataattatataaaatattaatatttatgtcccataaacttctcattggttgggataatgcattttagtgtttggggttttttaaaaatttctttattaaatgtatgatattctacacagatactgtaaaattaatttcaatacatatttttaaatatttattagaaaaataggcgagtgatttctcagtgtattttctttagttcaattattttcatacatcactttaatttgtttgcatgcccttctgatggtgggtaagtagcatcatgttccttatatataggcaaagtatttgtaatcattcactttatagtagggtgcattgaacttgaattagtaaaaacattaagaaaatcacatgtcccttactatatttaatgtgcctgtgttttaactcatatttaatttttctttaccacatttcagatgtttcagtgttttgatatttttaagtaaaattattaggagtaaccattgtgacattttaatagtatattaaatgattcagaaatcacatgtcccttactatatttactttgcttgtattttaactcatatttaatttttctttactacatttcaaatgttttagtgttttgatatttataagtaaaattaagatagtaaccattgtgacattttaatagtatattaaaagattcaaataagcattttagtattaagattatttcaggtaagcttttggtagctcattatagctttatttttggttgtatttttaataactattttggaaaatttga

SEQ ID NO: 123979 - DNA, 1350 bp, Homo sapiens
catattgccaaattatataaataagtagatgtgttttgttttttaattctcttaacgtttaaaacctttgtggagaaaaacttaatctttaatgtataaataaaatataagagtatttatcaaagtatctttagttatgccttcaaactgacatggcctcagcttatttttagtaaccttctttgtagaatataatatttctgagaaagttagctaatttaggaattagcttactttgtgacagtaatttatgaattctcctgtcaatttaaataaaaatactttgattttttaatttagcatttgtggaattatacttgggaatatttctttcaagcgttgaacgactgacaaaagaaattcatctcacaaacttctattgaaaaactgcagtttacaaggctagaaaacaagacttcattatatacagagacttagatttcataatgtaaatgagaatagaacaaaattactgtgttcttaattgcttttttgatcacttgatgtctgctcttcagaactgtcatgctctcactagaattaaagtatttcatttccaatttgttcttcctggacagtctgttctgtaaccatgcctccagttaccactgcagtgctgattgtttttcagcgtgcttctaatctggaattccaaatcaaccagccattcaacacctccatgcgggtgccacataggcatctcatacataacattttgaaaactaaaatcacattcttccttgccctccccgtatcacaattcttcccttgttttctctgtagaatgatacttgttgcctaggactcatccaccttccttccacctttttctctcctgccctggctccttcccatctatatcatcaccaagttctgtctgattctacctccaaatagcacatatcttttctccatctccacagatggagtaggtctgttacccatggtgctccctcctatccattttctacttgaggccaaaactatctttttaatatatagaaatgtcatcacactccttgttgtaggttttcagtgactttctatcaccccatggtaaaaatgtatggcattcatagcttatcttcatctaacatgtgcctacttttccaactttgtttcatgtcattcctcctttacacttacacccacacatattaaataactcacagttttcagaacactgtttgtttacgtagtgtattttggcgatctccagaaagaactccgtgatttgtattctgtactaatattatagtagaatgcattgtctatgatagtggtgtagaattattagaactgaatgtttgtttgtttgtttatccccttgcccctgactgggcatttcag

SEQ ID NO: 123980 - DNA, 1026 bp, Homo sapiens
atcccagctacttgggaggctgaggcaggagaatcccaggaggcgaagttgcagtgagctgagattgcaccattgcactccagcctgggcaacaaaagcaaaattccacctcaaaaaaaaaaaaaaaaaaaaacaacaaacaacagaaaaggcatagttgatgacatatctatatcttaatatgcataaattaaaatatatatatttatacatacccataattggtcatccttaattgcaagcctccagaagttcagaaaactgtgtttatagttgcttcaccccacttagtgtgagtatttttctgtttgttacggactggattatgggcgtatcccccagactctgctgggtgttatagaatctgtggtgtattatctttctataaatctgaaaaactctgaaattctcaaggcacttccccgataccacaggttttagctattagcaggagtgtgttctatttttgagcttttacatttcaaaagtaaagacattctttgttgtgctttaataatctttccataatattttccatacaaatacaagggaaatattcatctgccctatgacccagcaactctactcataggtatttatccaagataaatgaaaacttatatttgcaaggaagccttatatgagaattttcagagtggctctgttcacatatccaaaaagtggaaacaatcaaatgtctgtagcagaagaatagataaataacatactactcagccattaaaacagatgaactacagcgacatgcagcaatatggatgagtctgacagctgtcatactgagggaaagaaattgaacacaaaatattatatatgccttcattatccgaaaatctagtctaggcaagttaaatcagatggatggttagggcttgaggtacaaggagactttctgggtttgtggaaatgtcctgtgtcttcaatggagtactatttagccataaaaaagaataagatcctgtcatttgcaacaacatggatgaaactggaggtcattatgttaagtga

SEQ ID NO: 123981 - DNA, 1052 bp, Homo sapiens
tacataaaagtggggggcagttagttctatctctacacagactttgatagatggaccctcatctactgcttgctttgactgtggctaaagtttatgttggactgagacatttgggatttggaaataaagttaaagacttctcataccagtcacttataagttctagtaagtaacttgggggtggccgtgggaacatggggttaggcagtggtaacaaagaaataagccctattctcatggagcttactttgggagtggtgatactcaacagactgtaatttgaagtagaagcaattaactttgtcgataggttcttggagatacaactttaaacaaaatgagtatattgcagcctcttttttcatcaatgttataatgaaaccatgttgaaagcagtggcattatttgaggacctgctgtctgtcgtttcacttaaagttagttttaaagaatgtattgaccacattaagtgaggatctactgtaatctagggatggcccctggagaaggaaggtagcatttaggttgaagtttgtggggatggggataggtaggatttggaaagagagaggggcagagagtgcgcaggggagcacttaggatggaggaagtgggaatatgcacagagatgaatggtggagagcaatctggtttgacttaagatgttacttacatacgtgtgtaaagtagtaggttaatgggcttaacttgagaggatattttgggaccagattataggcaactaaagttttttatatttttagatagtaagaaaccatgaaagtgttttgagacagaatgttgagaaacatgatgaaaattgtgatttgggcaattaatctggcctttgtgtagagattgattggagaacagacaccattagcaacatgttttagtagtttgggtgctatgccaaaaacaactggaacagtaaatggaaagagtgggaccaattcaaggtaaatggggtggccaaacattttgatgattagagactatcctgatttaggtttgaagcatggttattattagtgcccatttttgcttttaaa

SEQ ID NO: 123982 - DNA, 7287 bp, Homo sapiens
ctttacaaattgttgacattaatttactcatgaaaatgtgagtatatcattaataggaatttagaagtagggctttttaagattttctgtgacgttggttcctaaagatgcaggaaatgtacatatatacctagtggttacttgactaaatgcaataaaaattattctttctttactttgaaactaaagctgtactttagaaatataccaaaactgagtttctgtggactccggttacaaattattttttaacatctgttaatgcaagtgtttcattgtgcttctgcatgtactttagtcttatgaaatcttagatatatcaaatgtatgaactaaatataacctatttaatggtgtcattcatttttttacaatggctttttaatttttgcacattcttaatcacattgggaaagggaaagctgtttgcatttgattggtgtgcttttgcatttttgtgtgatcagcgcatgtactaatgatttccttttatttttcttctttcctgcttttcctttctttttcctactcccttctcatttttccgtattttatactgctgtctctatacttctttctaaatttctttgcttactgtagcagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaa

SEQ ID NO: 123983 - DNA, 7197 bp, Homo sapiens
atttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagttttttttttttttttgtgggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactag

SEQ ID NO: 123984 - DNA, 1074 bp, Homo sapiens
cctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgactctagatttctagattcctaggtggcgggaaaatgtaaaactttaaagctcatgagcggaacgcaatgcaagtcctgaaactaagagttaaatgtgagtctcagggaaaaaagctagattagcaaatcaaacatacatatgcctcatccagaacatcattcaggcatcagttcgggggctactagcagtaaagttggttttaaatgaaataaagtggaaaagtttgatatcacttccagaagtggtctgtcatcagtaagtattggtgttgagtctaaaatgaattagaaacctcccgttactcttaggattaaagcaacccggtatggagagaaatgaaagaaaaaatgtagtgttagcttgactttatgtccctttcactgaattccatatgagcctatttggcagagaaattttgtactctacaaggaaaacatcactgatgtggacagcaccaataatgtacgtcccattaagctaataaatacccagacggccgtgtgaataccttgaattcttcagagaagtgtgttagtgcgtttagtgttgctatagcagaacg

SEQ ID NO: 123985 - DNA, 1425 bp, Homo sapiens
gcttccgctggcatgacctgcaatgaccggcgggtcctgatgtgctttttccctgatggtaaaacttttgaaagttttttcttatgtccctgtgtccctgcgaagcccttgagtcaggccacctgcaagggaaaaccttgaccgattcacaaggacacattcgtcgctttctcaggacgtgactggcgccacccttattctctacggtcacactggtgtgcggcccacagagagccctctcttgagaaatgggcacgatgacttagaaggcttggcgggccactcgtccctttaaattgagggcgcatgtagagtaagcaatctcatctgaacgccacccgcttggcaggcttttcctcacccccttattgtaaggcaccttttgctttactatttccccggggcgcaggccgggatgcagacagaggctggctgtagtctttgaaagcaccattgacttggtttcgggggcgaccgcacacagggcaccaagaccctgttgaagggattaggtcttaggttgccttgtgcccacagttttgctttgcaaggagtctagcgcctctgaagaatgtgacagaaaatgtagtactaacaataatactccctggaattgcacatgggcctgcttctttaacagaagagaaaggagtaaggatgaggagagagccaaggagtaagggtgaacagaagacaagaattgagatttggcccctgggagagtcagaggagaattcagtgagaagactgggaagatgaatagaccaaacaaacaatcctcctaactgggcagctggaggaaaataaggaggaggtaaaattgctggtgtcagtttttttacacgtaaacttacattcttgggctttatatagtatacttttttagttgaacgaatgctataaatacgcatttttttgtttgagtagattagaatgcttgtcacaaagagccttgtaattggcattgtagaagctttctgggctcctgactctaaaagaagaattggcacaggagtggaattgcggtgtggaggagggctgcttgtatgaacaggaaaccatggtggaagttgttcagatgaatgacgtgctgaggttggaaatcccatttctaaaataatggaggtgtgatagtcatgccataggtcagctgactagaataacaaaattgagttgagaataaagctgagaaaactattgaaaatcagccacggagttgtgctgggcaacctcatgttttactcaggatcttaggaagtctttgcatgacccaggatttaaaagcattcatgcagttaaaggactgcttgtcgtgaagaaacctcagggacaagaaaggaatgagcttcagtctgaagccggcatgaacgtaggctggaaaagagatcactacagtcacaattgccaggtgcgtcaccagaggct

SEQ ID NO: 123986 - DNA, 1037 bp, Homo sapiens
tggatagaataaaagcaggcagaagaacatggaaggactagactggctgagtcttccagtcttcatctttctcccgtgctagatgctttctgccctcttacattggactccaagttcttaaactcttgggcttacaccagcggtttgtcaggggctctcaggctttcagccacagactgaagccagcactatcagcttccctacttttgaggttttgggactcagattggcttccttctcctcagcttgtagacagcttattgtgggacctcaacttctgactgtgtgaatcaatactccttaataaattccctttcatatatatgtctatcctattagtcctgtccctctagagaaccccgactaatacagctggttccagctgagccgagctggaggagacaaagcctctatgcgcgtacaacactggtggagacttagactggccccatctttggcatctgcaaacagtgctgtgatgaatagcttggtacatgtggcttttttcacttgtgtatgtatagctagaaaattaatttctggaagtagaattgctgggccagaggatatgtgcattttttatttattagatattgttaagtttcactccaaagaggttgtaccagttcatattcctgtcaatgatgtatgagagttcagattacctgacatactcatcaacaggatatattatcctacttttcaatctttttggattcaacaggtgaaaacaacaaaaactaacatatttcaatgcggttttaatttgcatttctttttacaaagtatgtggttgagcatcttttaaacatgtgaaatccacttgttttttttttctcttactacctttagctattttcctattgcattcattttctagttctttatattcattaataagtgtcttatatattacaaattttatttattgtgtatatggcaagattgtttcccagtgtgtattctgtcttttgggctggtctaatggtagtgggttatcagaacttattaacattagtgtattttgtctttcccat

SEQ ID NO: 123987 - DNA, 1044 bp, Homo sapiens
ggcattaacttgctcattttattgaatttgtcatacatggcggggaggggcacttgaagggagctttaggagaaatgatttagaagagtgatcgggtcctttgggaaagtgtttaacaatttaccaaaagtcaggcaaatatgtctttttgataccttgtacagttaggtacttacattagatttttgaagcgcaggtatacatcaaaataataattagaaaggatctcacaaaacataagctactctattgcctgtcaaattggtaactctgccttgaagtgaacagagtaaaaattcatgtgctaatcttctagcctttgttctgcatctttctgcacgggtaggaagtgataagatcctctgttgttagcagtactaagggccatataaatatatgtagataattaaggctaaatcttgtattaagaaaaattccaattatcctcacaaggacatgtttcaaatcttctacccaagtgccggaagcaagtccaattatctgaatataattgttagacattatttgataaacatgaggatagtgcctgtgactgcatgatttaaaaaccagcaacctctgcttttacctatttaagtgtttagattttcagccaaatgaattttttctccaattctttccaaaatgactttagagaaggtgtcatatatttttattaaaggacccctggagacaagtgattactatggtcatgcatatattcaaattgtatattatggagtcgaatctgcttacactgagttaatttaaacgattatgacaagaacttctgggaaatatgtcagctaaattacgtgtttgcaaactcctctggctcttctcttcaacccacaaaaataatgtcatcagacatgaatgcaaggaactaagaataaagcaaaattcctcactctcaaactgaaaacttgaaagcatacagtttggatgagtggagagcaatccggacacaccatggtgcagtgttgaggtcgggcaggggttcaatgcaggaggttctgaagacccccatggaccccctaacta

SEQ ID NO: 123988 - DNA, 1050 bp, Homo sapiens
gccagcagggccctggatgcctctttctgtgtctgtaaccctggcaacccatcccctaagaagcagagatctctgttgctccccatttgagcacagcactgctttacatctgcggatggcaagcacattcacatggcttctcattcacctagaggaaacgattgcggtgccactgacaatgtgcctccaggactttatccagtatgtccttccccccacacgggccaacagggaaattccctaccatctttccatttcttagaaaaataaacttttaacatattgaaaaaggtattttaccgggaacttcactgatgggccatccctcccccaacggccctccctcccttaaatcctcccaatttacctattttaactagaacttatatgttaacccagggcaccttgaaaacgcattaatgacaaataagaaagggagtcctcccgccctccctgtgtgcttgtctcacctcatgtacctggtcctgcctaggctcttctggctcaactcaaggcgctggggcagaggccggtgaagacggcggacatggatctcgccagggaagagctgaggatgctcgtgacagccacaaaagcagccctggagcagaatgataggtgaggcatgagggacggatctgatctatgtttagattcttccgtaacaaggtctgaaaccgctgtgacaagcctacggttacattgatttctgcgttgctgaaaacatgctacttttgctaatatcatgcctgtcatctggctatttctacaggccatcacctatgtgactaagacattctgctaagtatggtgtgtccatggggggagtttgggcaggtttctcaaggaattgcctgtcttttctggtggtcccctgaagactgactgataggcgagagggctgcagatctaagacaccttatatgaatgcccctattgttttttaacttacaaagctcttctaatataacctctctgtatcattttccggggtcgaataacaattggatagggcatactctttgtatgatttgaaaaaagattaaagga

SEQ ID NO: 123989 - DNA, 1966 bp, Homo sapiens
gaagatctacggtaggctgccgactcagaggagaacagctgactggaggcatcacctccaaatggggacgatgcacgaaagagaagaaaatagcaggcccccaggaagcagccaggccttggggttggaagagagaaagggcctttggggactgtggaggcggagagtgaatgcttgagcacggggagcaagggagtcaataaagaagaaaagatttttttaaaaaaatcccacatcttgggtgaccagggaaacaaagaagctcagcaactggtgggagggatcagaacccccgagactggccccctgtgccgccccgcccactcgccagggtgatggcagctgtgtcctcactgactcctgagaaattcggttctggaagaaagatgaagccaccctgaaatgggctgactctgtttttcctccaggagctccagaaaatttgcacgtgcagcccccagcagttcaacagactgcacgtctttggaaaagtctttgaagatatttgtaacagttctttgatatttggtgatctcttgaaaaaagttaaggtaagaaacatacatcttcagcataacagttgagaagcttgcatgaggttctgtgtacaagaatgatctcaagccgcactgaaattctgctaggtatcacaggcccccttctacagacagggaccatcactcccagagactcgaggtcatctgcctgcaggcacgtaaattgtaaggggccatgtggaatcaacacccagttaactcattcctcaaacccatattttcccactaaagcttcctaattatgcataaccgtttataaattttatataacttaattataattctaataaattaataatttaactttacatgtgtaatgttatttgaatccttatggaattataggtttgttgcaatttcatgatgaaagtgatttttgggtgctgtggctcatgcctgtaatcctagcactttgagaggctgatgcaggcagatcactttaggtcaggagttcaagaccagcctggccaacatggtgaaaccccatctcttctaaaaatacaaaaattagctgggcgtggtggcacatgcctataatcccagctactcagaggctgaggcaggagaatcgcttgaaccgggaggcagagattgcctcaatattttatattttattgtatggtattttatgatattctgaggtaatcaatacttaatgctcaaatatgcttcaaagatggtgtgattttatcaatgtgagcatgtataccgtttaatgcattgtgggaacattttatatttttctgaaatgatctaaatgaacattcttgacttccgtattatttatacacgtgaaacacctgcactgtggcctcctcatacatggccagtggacttttgtttgtttctgtacaggatgaatatgaactctacatggcaacgctcctggagtcccagcctgcagcacagtacgaggtgacgatcgatcacaaagagcctgaatagagcctgcttatccatagcttcatatttcatgagcagtggaaacctttctgaatccaagaagccccatgtgtgccccataatttagaatagctgatatgttctttgttatagatgagttttatactgccttaataacattattgataaagaactttccttttgattggcatagcattatttatactcccaaacaagcgacataactatctatgtataaattgggaatataaatggttctcttccagtaatttccaaaaaccactgtccagccattgtcctggcgaaatcactgagaatgcattgtgatggctggtgtgctgtaagctgactcaaaccccatgatctctttgtttaacgggtgacagcgttccaggtgttcccttccagggtcgggttaaacatgtgattggtcaaataagaaaatatactgcaggaataactttatcacttataaaacctaagaa

SEQ ID NO: 123990 - DNA, 1048 bp, Homo sapiens
gttcagaataagaacaagtgtaagatgatgaggtttaggcctcctgggagatgcactgtcgacatttctcagtaggaaggtccgtgttgtcaccaagtgttcctactgctctgggaccacctcctttgcacgatcccgcgtattcctcagtagtaaaccctagggctctttccctgttcaagttaatccttctttctaagaaaggacgtatgctgagccctagcatttctgctgctttcgcggtccagagcggatggaccaaggtgcccctgaccctctggcacctctgaatctctttcctgaacagccatcacaggaacctgcctggccacgtcgtgctggtaaccatgtcggagggccccacacaatgccgttgtgcagagctgtgccacaggactgtttggttagttttcaagacaaagtccagaaatcctttattcagcttctcctgaaactgcatcttttatccctagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaa

SEQ ID NO: 123991 - DNA, 1040 bp, Homo sapiens
atgtcatattgtatcttttgatgaatgttttgttgactgggtataaactaatttttttatacttaggtggtaataagagctgatattttctgagttttttaaagcaactttcatatatgaagtgtagagattattattatctccatttttcaaatgaggaaattgaggcatagaaatgttaagtgatgtatttcagtaattctgtaagtggtagagctaagagtaccttggtagtcgtcttcgataattagaattttatgttttaaattaaatgctgccgtagagaccagaataataattccacatttcttcaagcactaaacttgctctcatgaaatgattaagtattagggaaggaaatcagagttttagaggtaataggttacatacatgaaactttcaagaaagcggaagtgccatatttaaatctttctctgatgtaaagataagcggacacaattcttctgtgcttcactgctctgtgcagtaagttcatgttagtagggtgcacagcttagatgcctgtgtttctactcatagcatttcttagtcactagggacaatttggctcctaaatattaagaaagaattagcagctgttacagtggagggacaagatgtttgacagcagcatagcaagttgggggctgtgtaatgaatgatctgaagtggaacagctatagtgtcagcaagtgaatagaaacttttgaagtatttgcagcacagcttcaaacagtgtagcgtgactgtggattatgagaaaataaatacaggcaggtcaactggtactaaacacttaagaatggggatttctttttaaaagcaaactcagtttgcctaagaggtgaagtgtaatgcttccaaagggtatcacaatgtgtgaaagtggctgaggtcacaaatgagagaactatctcttcaagaacaaaatgtgaagaaaactgtcttaggaactctggcctgtctcactcagataacattatccatagcagtgatactgactactcagataacattttccatagcagtgatactgactc

SEQ ID NO: 123992 - DNA, 1048 bp, Homo sapiens
ggaggatgactgggatatttagtttagatgatttaagaggaggatgatttcacttaaagagatgggatatgaaagagggaggtgaaggaggagaagagggagaagattcaagtaggttaaagtgtagccatgctgagaattatctgttagttatttgatttttttgttttgtttttgtttagaagctaatggtatagatatagaagtcatccacagagatgttacagttgaagagatgggggtagagaagactttgaaggaaaagaatgtagaatgaggatagaagagaggaaatcccaacatttaacaggtgagtagaggacacgaagccagcaaaagaaatttagaagggacattcagatagacaggaagcaaactagtactctatagctctgttttgatctgccaattcattaaaattatcaattgatgagaactttgttttgttcacaccttgactctttttggtgccaaccttcagtcaagccccctacagtatcattgacagggtttcattgcaccgaaaagtttacagtgtttcatactggatgggttagttttaatggcttttgaggatttctgtggtgttctagttgggtgatttttccctttatttttcatagggtgggttacatatttgctttaggcaaatttattattggctaaatgacctgctttaccatgttatgtaggagaaatttccaagaaactaacggattagttaacaatatctgatactactgagaccaagggagatgaagactgagataatgatatttagcaatttggaaagttggtttaaccaaaaaatgattttaaccaaagaatgatatccagtctccagtaacaatatctgatactactgagaccaagggagatgaagactgagataatgatatttagcaatttggaaagttggtttaaccaaaaaatgattttagtgcagttatggggaatgaaatcattgggtgattattaacacatgaattagaattaaggacattaaaataagcactggactactcttttgactttgatggtgaaagaa

SEQ ID NO: 123993 - DNA, 1081 bp, Homo sapiens
cttctcacctcttctgaaggactggagaggcagtctgcgtagggtagaaaagagaaaagagagcattccatagagagaactggacatgtacagggagctagaagtcctgaccccgtcccctcatcttgcagaaggcaggtccatagccagcctcccagcggctggcaagagcaggccctctaggtcccagtgctgggctattagtttaaaattttcctaatttatttgaaaatttataagagtaatggatttttttctttgaaaattagtttgtgattctacctattgtatgagcttaatagaagaacccaaggaaccatttattaattgccgtgttccagatggcatattaagaatttgatgtgcattatctttattagtcttcatgataatccttataagattgatactattattatcaccattttacagatctgagccttaggataagtccattgcccaaggtcacacagcaggggccacaccatttgtaccctgattataaaggaaggtatgaactcccattttcatgatatggagcaacttctgtacaagtgttttaagtttggaaaattttaaagacagttttgctaaaaatgcctttcctttcttctctttttgaaagaaatcttgacaataaattgcttatgtgttgcatgtgactcttaaacattctgtttttaagatctctttgatattgttggtgctctctctctctaagatctgttaataagaagaaaagaaattaaatactattagtgaagtatacttccaaactttgtaacaataatttccaccattctcagatatacttaaataactgctaaaatgtatgttggtattgtaaaacctaattggcaaactgacaggtttggggtttttttcccctcaacaaaaaagtaagtggaaaaagactctcttaaaattagagttgtgagtggtttgttggcttgactcgtggcattgagtgcctcaggtgagcagagaccaaagcgtgacctgtgctagtggagctcttgttgccctgtttcgttcacaaggaggcaagttctacttcagtcttgcatgtgggtcacacaca

SEQ ID NO: 123994 - DNA, 1046 bp, Homo sapiens
tgagcaatatatatctcatttggtctagataacatttatgaaagtcaatttagcatggatgggcttctgtagatacttgtcgttaataatgattgttcactatacagtgatgttttttaaaccctaagtgaaatttgagttgtcttttgcatgtgggtaacatatgtgtttcagcacaagggagatgaggatgtatgaagtgtgtaaaagaagcagggaaaggtagtgtccaatactggcaaccagtgaagttgtttgaggttattactgatgacagtatacttttcaaattgaatttggtaaattgcttcactggctgaataagagagttgattctgaacgaaggagatcaaacctgaacagtacattatcttcattatacttatggttgtatgcaataaacataacttttctaatccaaatattgtggcagactatcttacagaaaattgtatttgtgtatatgaaggattttcctatgtgttttgaaggaaatgaaaatgtgtaatggctacagcagtgatactgataggctagcaggcaattgattgctcagaggttaagttgagagagagagaattctctggaccatagtcattattccttattcacactccattcagctttccccgccccttctgggcacagcctcagatcttgtgccgttttggaaggcacacggtgtggccctggtacatgcttgtatccactcattgaggtctgggattccaccatggtaaggctcatcagagcccttcctcaggactggcaggaggacacccagagaagcagttctaacatttcactgtggttggtaagcaggggaggacatgttttcagtcctggttggaagtcagcttatcagtcaggacaggtgaggttctaattcagtaacaagtgctatgaaattctcaatggcttagtacaacaattatgtatttccttttcatacacagtttgccacaggtccaggtgactccttcatgggtcaataaattactttttgtttttttgcttgttagtatgaattgggcttttgtttcttg

SEQ ID NO: 123995 - DNA, 1097 bp, Homo sapiens
actaaatttagagtgatttttactataccttcatgtaatttttctttccataggagtgcatgtttgaaatgaaaatggaaattagcccaggcacggtggctcacgcctgcaatcccagcactctgggaggctgaggcaggtggatcatttgaggtaaggaatttgagaccagccttcccaacatggtgaaacctcgtctctactaaaaacacaaaaatttaccgggtgtggtggcaggtgcctgtaatcccagttacttgagaggctgaaaagagaatcacttgagcccaggaggtggcggctacagtgaggcgagatcatgtcactgcactccagcctggccgatagagcaactgctctcaaaaagaaaaaaaaaaaaaagaaaggaagaaagaaagaaaaaaaagaaaatgaaaattaatgggaaaatgtggctgtgtataaactttcactgacagacacattttctgacagagccacgtggtgatgtgcagagaggatttggatgaagaggagctgctggaagctgtggagttgtttctgtgaaaaacgtttcagtgagtcagaatttctagagctcaagagtgagcggggggggggcggaattagaaacagaaggtgcattcatcaggtttgagataacagaggggcctggctgactactctgcacgctgtgagcctaataaataccattcaaattaatgctccaagaattgtatgtgctccagttcctttttcaaccagatataacttgggagtgaataaatgtgagagaattgaggtcagtattttttttaaaggaatgcagaagggaggaacgagagagaggctgatttaagtcagagacttcaaagaaatgaaggtttgatgcgactgtccttgcaggctgagaacaaaacgggcctgaataagcacagaggggaggcgaggttcagggtgagctcctaatcacctgctgtatttacaggagagaagacaacaggagaagttagggaagatattaattgtatatccaagttaaaaattagtaaatatctgtcaaattccaagaatagagtgagcatgagggaatatgaggaagtggaaggagaaattga

SEQ ID NO: 123996 - DNA, 2259 bp, Homo sapiens
aaaacttgttaactggaaatagaaaggaacttcttcaacttgttaaagttgtctactctaaaagtgatgttaaacgttacacagattaggggcatttttaatattttctctgaaattgtaaatgatgtaaagatgcccatcatcactcctattaattaacatttgtctgtaagcttgtgaccaattctataaggaaaaaagaataagtaggagaggtaagacttgaaaggagataaaactgttattatttgcagataatataatcatctgtccaaaaaagcttccaactattagaactagtaagagaattgaacaaaatttttagataagaacaacttaagaaatcttgatatcttctacactgacaatacaaactaggaataataataaaatattattccaaattccagtcaaaactagaatatttaagaattgatcattaatccatagaaactttatagaaaaaaattttatgtatttatttttttggctgagcacaggggactttgttgatggtacaagacaaggtggggctccctaggccactccctcttcagggggtctgcatggaaactgtgaggaggggagattctcattgtggcaggggactgagtgtggcagggactccccagcagtgagggcctctcttttcctcttgtgctgtcactggggctggtggttcaggggtcttactccttggaggacttgtgggccatgacgtccaccaccctgttgctgtagccaaattcattctcataccaggaaatgagcttgacacagtggttgttgagggcaatgccagccccaacatcaaaggtggaagaatggatgtcgctgttgaagtcgaaggagacaacctggtgctcggtgttgtagcccaggatgccctagagggagccctctgatgcctccttcaccaccttcttgatgccatgatatttggtaggtttttccagatggtagatcaggtccacgactgacacattggcagtggggacacagaaggccatgccagtgagcttcccgttcagctcagggatgaccttgcccacagccttggcagtgccagtagaggcagggatgatgttctggagagtcccaccaccgtcatgccacagtttcctggaggggccatccacagtcttctgggtggcggtgatggcatggactgtggtcatgagtcctttcacgataccaaagttgtcatggaggaccttggcccggggcgctaagcagttggtggtacaggaggcattgctgatgatcttgaggctgttgtcatacttctcattgttcacacccattatgaacacggaggcatcagcagagggggcagagatgatgacccttttggctcctccctgcaagtgagccccagtcttctccatggtggtaaaggtgccggtgggctccacgatgtactcagcaccagcagtgccccatttgattttggagggatctcgctcctggaagatggtgatgggatttccattgatgacaagtttcccgttctcagccttgatggtgccatggaatttgccatgggtggaatcatacaggaacatgtagaccatgtacttgagatcaatgaaggggtcactgatggtgataatatccactttaccagagttaaaatagccctgctgaccaggcgcccaatacgaccaaatccactgaccctgaccttcaccttcaccatggtgtctcagggatgtggctggcgatgtgagagaagatgcggctgtctgctgaatcggaggaggaaagagccgaaaaaaaaattaatgagtgacacagaaagttcaatggagagacaacccatgctctcaggtgggacatatttgtattatgaagatgctggttttccccaaatcaaagtacgaattcaaggcaatttcaataaaaattccagttgaatttttttgaggaaggaaaatatgttaccataatatttatatgaaagcttacaggtccacataaaagtaagtacaatttgaaatagaagcacaaatagatgtgacctgccctaccagtctatgaagacatattatagtgttaagattttaaagaatttgtattttaccaagagcagataaataatccattggaacaatatattatgttaagagacagattcatgtatttatataggcattttgtatataataaacctggcaacccaagtcaacaaaagtagattattcagtagatggtgtttggaaaattggcttactacatggagaaaaatatgagagaatt

SEQ ID NO: 123997 - DNA, 1027 bp, Homo sapiens
tgttggaagttcctttacatggttccctaagttccggagcgcatctctgtgtgtggtctgctgggaaaccccgggaggaaggaacctgtggggttcccaaggccctcgggacccggaacaggactggccctctctgggtaggcggggctggcttgggggcgacgctgccaggagcgcgcggggccgcgtaggcgcccggggagacgcacttgccccaggcggcagccgtgggagcccgaatccacaccccggaggatgaactgtcgtttgcagagttaaaacgagctgtcaggtgtcttcagaagtttagacgggaaaaggcaaagagttaatccttgctggacaaaccactgctgcttccagaaaaaaccacctgagaacggtttaaaatgggagggggcgctttcctaggaagcggattcagaaaaacaaatacaactcaatagattacagtaaaataaaattggagggcgccaaaggaacatttggttattcaaaaagcttgttttttaatgagaaacgacttcaaaggcgccttggaaagtgggtgggacgcgcacatctcagccgtcacaaggcaggtggggccccccgggcggagaccccggagggcctttgcctgggagctacccccgtccccagccaggaaagagcagagggcgagaccacgggtcccagcgtctgctcccctcaccggagctttctccctggggtggcggccgccgggctccaggcgacacagccagtcgcagggaaaggcgccgctgctccgtgtccgcgcgggcgtggcggccccgctgcgcgctcattagcgcccgctccgcccagtggcttcccgcggctgcgtgtttacttgtcattttctggcggctttgtttcccacccagctcctgagcccgggctggccgcactttctcgttctggttttctttttctttcctcttctttttttttcgagacaggttctcagtctgtcgcccggggctggagcgcagtggcgcaatcctagctcactgcagcctcgacc

SEQ ID NO: 123998 - DNA, 1214 bp, Homo sapiens
agggaaccacaatttgttaaatgcatggggaaacacagtattaaaaaaaaaaatcaccacgctgggcgtggtgatgcacgcctgtaatcccagcactttgggaggctgaggcaggtagatcacctgaggtcaggagttcgagaccagttggccaacatggtgaaaccccatgtctactaaaaatacaaaaattagggcgcagtggtgcatgcctgtagtccagctacttgagaggctgagacaggagaatcgcttgaacctgggaggtggaggctgaagtgagccgagatcacactactgcactccagcctgggcgacagagcgagactctgtctcggttaaaaaaaaaatctttctctgtaaaaattatcctgatctaaaatatgatacacgtgtgtgtgtgtgtgtgtgtgtgtgtgtgtgtgtgacttaggctgtcagaaatcttgaaaggtcatacaaaaaggcatacggaaagaagcccagcgagaagagttttcctgctgatgaagacagaaaaggcactgcagcagatcctgctgggacaggtagcaactgttcgtgtgattgctaacaaattgaatttgtggcgtctttggtgtttctgtatttgatgtcctcggttcattggacaacagagccattgttggtggcaggaaatatcactgtacatttatactgaaagtctgtagttctggcaaaattaaaactttgagaacataaagttgcaaattctaataacactttttaaaagtcagttttctttcacatgaatgcatgtgaaaaattcacgcagctttttgtcatccaaggtcccagggagagagcacgagcgttgaaacctgcaccagcagcccgggcgaggcggctccttgtgctagggcgccctctagagccggagagcggaagcggcgcgggcggcgggcggcaggcggcgcctctgcacccaagaagcgcttacccccaaaacatatgctgggccccaggtgcctgccctgggtaaccagcacgaacgaacagagataccccaggctgtgtaaatccttggtgatcccctagattcatcctttgagttttaaaaccgagaaacttgatatccagagaagaaagacccttttgaggccaggattccatgggaggaagaccctctcctcagccccttaatacccaccctccccagccaacaggacccttggggaagaaaaccctctccc

SEQ ID NO: 123999 - DNA, 1118 bp, Homo sapiens
tctactgacagatgaaacatcagtgaatgttaaatgtaattctctgtatatctcaaattcaccataaaatgttctttactttttttcactgatatgtgaagaaacttaatctcttggttattttctctagtattttgccttttattgcctaatttgtaactaataattgatttatccctaaaggagactataattatcagttgtggtacagtttctattttattataagaagctcaaactttagcatgcaccagaatcacctagagagtttgtttaaagtgcaggttgcttgttaaagcaagcttgtgatttaggaggtttaaggtaggacctaataatttacatttttaacaagttcccagatgatgctctcactgctggtcggggtcacactttgagaaccactgtacagtctcatgctgctgtatttattataaggttagacatggccttttggcataaaggaaaaccatcattcagatgaagattcaacatgcttgaatatttcttgcaggtatagcctgtcgtacatcccatatgcaaggtaagcttgtttgaatcttgtcttctttctggttctttacttatcttcacacaaatatatgaatttaagtaatttttacataaaaatactatttaaaccctttttttttggttgattttaatttcctaaaaggaaataaacatacttttttttttttttttttttttgagacagagtctcactgtgtcgccaggctggagtgcagtggcaccatctcggctcactgtaatctctgcctcctgggttcaagattcccctgcctcagcctcctaagtagctgggactacaggcgcgtactgccatgcccggctaatttttttgtgtattttagtagagacgggatttcaccatgttggccaggatggtctcaatctcctgactttgtgatcctaccgcctcagcctcccaaagtgctgggattacaaccgtgagccaccgcgcccggcagtaaacatgttttcaatgagatgaatagcagcttgccatgataatgtctgtatggaaacattttggcgacatggagcagctctgtggggagtatcctcccgccctgctgcctggcgtgcactaggga

SEQ ID NO: 124000 - DNA, 1063 bp, Homo sapiens
tgtgatatgcaaaataaatgattcagactatgtgttaaaactttgctttaatttagtataaagaatcagattggtagtgaattaagactatattctaaattttcccattttttattaaggtcctggatgcctcatcccttagtttcaacaccagattgaaatggtttgccatctgcttcgtatgtggcgttttcttttctattcttgtgagttaaggctttatattgtttaataatttttattttgtattagactaataattccatttagtaccaaaaactaatgtcctttactaaatccctgttagaccattttggtggaaggtatttattaaactaaaataaaggggtagagatcaatgaaaatacgtagaaattagtattttggggagttttgtggatagttgaaataatttaagaaaaatgtatcaatgtgttaaaagatctggagagtcagtaatttagatgtttattaccttttcatacttggtatttagcatgaaaatttaacttaaatagactgagatttactggtaagcacaaagttttgttatggctcatttatatatgctagtgcaaataggaagaagattcaagttagtgtataacattgaaaattaactattttttctgtgtaatcagactagactgtctacaagcagatttgtatttaaacatattacataatattggtattgtattactgcagtagcacgtttatattttaaccattaaaatcataaaattattttaaaataactataatatcttaacttagggaactggattgctgtggcttccgggcggcataaagctttttgcagtgttttataccctcggcaatcttgctgcgttagccaggtacgtttggcttctcaaaatatcttgtttgctcttgctaccaaatttacctttctaataagcactttcccagtaggatgtttatgtagttctgtacatactgtgaattcagccacaggatttacattcattaaataaatatgtattgactgctgctgtatgccgtctcccataacagacggtattagtgctaggaatagcca

SEQ ID NO: 124001 - DNA, 1096 bp, Homo sapiens
gttggtgtgtttggtggtttggtggtttggtggcagcaggaaggtaagggagttcacactgatggctttgggtttctgtgtgtgaagtaggggaagttgtctgctaagaatggaagtgtggggcaggaagtggaggtttgaagtggtttagagtaaaatggacgttgagataaagcaagaagccttagattgccaggcagcaatgtgcaggccatggggggctgatgaggactggctcaggacccccctgccctgtgcctgactccacccagcagtgctcagctcagcacctcctggagcaggaggagggaaagctgcactccggtgggattttaccaggtggaggcagcggaaagggaatttgaatgtcctgttgaagccgctgaaaaaacggagaagggccggatgaggagttcaggaggccaaggagtcagcacggtggggccgaggaaccagcctgctgccagaagaaacgggtcggagagcggcagccggaattttggcgatggtgtaatttcgagcaggaagactgccctgggctgggtcactgagtggagtggaggggaaaggccagtggagatcaggggatgctgcacagaaaggccaggctgcccacgcacacgtggaacccgtgccgcatgctgcaaggatctggataggccccgcgatcaagagtcctgaatgagaaggagaaagtgtggaccccagcagcgggtgtggggagcgggcggttctgcctggaatgggcctgagggtctgcggatgtctgtttctttttctcacttgtctgcacaactttgactttttatacccactgctattttgaaaaaggagtgggaggaatactggattcagtgtcatcattagtggaaagccacaagtgtttcctatgtttagatggcagaagcccaggggcaaggctcaggtccttccagctgtgctgtctcctggcgatccgtggattagagctgttcctcagcttctccgtcacttaaaggggtgggtttcggctgtgctgtgggagccactcattcagccttcatgttgttgctgctaggactacattttcctctattatgtttctcacctgcttttg

SEQ ID NO: 124002 - DNA, 1041 bp, Homo sapiens
cttccacgagagcagtcttggtggctggatggggtcagaggcctgattgaagtcaggggagaatagaaagaagatggagatggtatggccatctcagtgatttttcctgtggagcaaagaagtgggtggtagttgaaggatgcagtggggtcggggaacatgtcattttcccaaggaaaatactggatgtttctgtgcattgggaatggtccaggaaaggggaaaattatggtgcaggcaagagggaattgttgctagggggctattgaggagtgacttggaaagcaggtttctctagggaggaggaaggggcaggaagtggcagtgaggagggcagacacctagctcactgcctgtccaagtggtacaggattcacaggggagagccctggtcctggagactaaatttcaaacctagccggaaggtgagaggatcatcagagaagagggtgaggacatagggaggtttgctgttggtttttggagatgggtaggagatgagatgggattaaaggcgcacagacctgaatggggtgagggatgacctgagagtgttgcacgtcttgtgcagcaagacgtaaccaggatggcgggcacattggaattgggtcttgacagggatggttctaggccagttgaggagttgggcgaggcagtgaaggtcataggggagcatcctgacatccaggctgcatcatcctcctatgcaggcgctttgagccccggggagaggcacggtagccagagttctgggacctctccttcgagatgcctgggaagaagtcaaggagggagagatattgagccagatcttaagagagttgatcatattcctcccctgatcacatccttcattgacttcctgcagcacttgagtaaaatccagatccctcccttggcctctcagccctgcactgcttgtcggcccgcctccccaccctctccccagtgcttgccttgccctgccctctttctcctcctcagttggagccattttcttctgcctgggagacctggcagttgcatttcttttttcaggaa

SEQ ID NO: 124003 - DNA, 1374 bp, Homo sapiens
gcagtggcgtgatctcgactcgctgcaacctctgcctcccgggttcaagcaattctcctgcctcagcctcctgagtagctgggattacaggcacctgccaccatgccctgctaattattttgtgtttttagtagagatgggggtttcaccatgttggtcaggctggtctcgaactcctgacctcaagtgatccgcccaccttgacctcccaaagtgcttggatgacaggcttgagccactgcgcctggagcaattaaatttaaattaattaaaattaaataaaatttaacattcagttccttagtcacagcaaccacatttcacatgttcagtaggcacatgtggttaaaggctactgtattaaacagcgcagatacagaacatttgcattgcagaaagttctattggacagtgctactctaaactttggagatgcaaaggtaatatcacttatcttgagcccactgtctagaggggagaaagatatgtggagaagtaatcaatcaaagattagagtgactggctgtatagacaagtgctgtgagttcagaggaggtgatcgttcattaacaaatattcaagttcctgcatatgtttgacattgttcaagatgcaggtgttaataacagtgaccagtgcaaatacctctttcacatggaacttaaattttaattggaggaaacagtgaataaacaagtatataatgtgtcagacagccacagaaaaagtcagagcaggttgaggaggttggggttgccatattacttagataaggcctccctgccagggagtcatgtgagcacagctcagaagagctgctgggatgtctgagcatcctgtgaataaaagcctccaaggcagatacagagtcccaagtggtgtgtggtcagcatgttcagggccagtaaggaggccagaggggctctagcagcggggcagagaagagggacaattgtagaagaaaaggtgaagcaggaagggggattctcaattgtgagggttctcataggccatagaaaggattttagctttactctgagtgtgataggaagcctttgggtttagagcagagtggtggtgtgaccgacttggattttaaaggatcactctggcagctctgtggagaacaaactgtagaggcaatgttagaagcccagagactgggctggagacaagtacagttgtcctggcaagagatgactgtggctcaaatcagtgatagaagtggtttaaagagcaaaaaagcctgtttaaaaaacaaaaaagtggtcagattctgtaaatggtctgagtgtacagccagcaggccacactgttgacggattggatgtgtgagagtgggaggaggcaaggatgcctcatggcattcgacct

SEQ ID NO: 124004 - DNA, 1052 bp, Homo sapiens
tcatgggtggcagggcgctcttcggagcacggccacctgcccgcaggagccctccgctctccgattccaggcgaggggaggcgcattcggggcctcgacttctgggaacccggggtgccgcggacccgcccagcaaggcccctcgcggggcccggaggacgccaagtgcagggttcagtggtcgtgccccagtcgggtctacactcaatggctgtgcgccagctgtgggcagggggtccacacccgcgctgtgtccccgcgcgttaccacggcgcacctcgcggacagtgggaagggatagccccaccatcagcgcccactccgcggacttcacggaccactaccgggtccgagagaaaggctggtgagcatgcgcgcattgctacggcggccgcgctgacgcacaggaagcgggcgggaccggacttccggctggtctgtggggtttcgggttcggggtttcctggtgggcgtcaggggcaggcaacagagtggcggccgctacggccctgtaacagggccatggagaagctgcggcgagtcctgagcggccaggacgacgaggagcagggcctgactgcgcaggtagcgaacttgcgccctcgtccagtcccggggctgcccgctggccccggccgcactgaggaccggccgagcgggtggggtgggtgcgaggccgggggtctgggactcctctgcccggctggttgatttaggagggctccgcctgcttcctgggtagaatttgagaactttccagttttccatgcggtctacttaaacccactttgaggcccccccccgactctcccatctggccttctgacttaggaatccgctaacgtctgccctcgctttcccaaataatccatcgctcccacgtactatttggttttctgagcctggtgcggggtctggcctcgggctgtgcagcgtaagtagctatgcagggcatttatcctgcaagctgcagtgagccgagaccctaaagcttgttgcatctgtttgtctttggaggtaaaggtggtgttatgtgtgtgtttgctgggggg

SEQ ID NO: 124005 - DNA, 1025 bp, Homo sapiens
gcagaggtggcgacagcgatgatggaggtgatggtgaaggcatggtggagggaatgattgtggaaatgatggtggagataatggcaggagtgatgatggaggtgattgtggagggatggtggaggtgacgattgtggagatgatggtggaggtaatggtgggagcagggatggagctgatggtggaggtaatggtgggagcagggatggagctgatggtggagggatgacagaagtggtggcagaggtggcgggagtgatcgtggaggtgatcattttggaggtgatggtaggaaatgatggaggtgatgaagggatggcaaaagtggcagaggtggtggcagtgatcatggaggtgacggtgggagtggtgggagatgatagtgagagatgatggtagtgattgtggaggtaatggtggaggtgatggggatgatggtgaggctaatgagggtaatggcagagatgatagtggaggtgatggtgaagataatggaaggtaatggcagagatgatggtggagggtgatggtagaggtgatggaggagggatggcaagggtgacggcagaggtgacagagaaaaaatggtgagggtgatggtggaggtggtggtgaagatgatggcgagggtgatggtagggttgatggagaaaggatggcgagggtgatggtggaggtggtggtgaagatgatggtgagggtgatggtgggggtgatgaaggatggtgagggtggatggtggaggtgatggaggaaggatggtgagggtgatggtggagatggtgaggatgatggtggaggtggtgaagatgatggtgagcgtaatggtgggggtgatggaggaggatggtgaggatgatggtggagatggtgaagatgatggtgaaggtgattgtggtgagggtaatggtgggggtgatggaggaaggacggtgaggatgattgtggaggtgatggtgaagattatggtgggggtgatggaggaatgatggtaagggtgatggtggaggtggtggcagaggtga

SEQ ID NO: 124006 - DNA, 1039 bp, Homo sapiens
aatttttaattttgaaattttaaagttggctttaaatgttgccagttgactttccagaagattatgccagttatgctccctcctacaattataagtgtccacccccagccaaacccagatgtgattgatttctttcatttttgttagttcattagacaaaagtgttgtcctatttaaatatgtgtatgcttactccttagagagattgggcatcttttcatgcctatggtagctatcagaattccttcctttgagtattttgctcttttctcattgatctctgggagctttcgggcaatagagagtttaacctctcatctgttatgtatgatgcagattttttttccccacgagggatttatccttttgtttttcttaatgataaacttgaaatgggatcaatctcacagcagtcatgcttttgaacacagatcttacagagatcagaaaaatcttaatggaagggaattactcctttcgtactatgccttgctgtggacaggagaaacgttgcccaaatgtccttggagagcagagcacgtgcacagcacacatgcagttatgcagctgtgggcacaggggtgggacctgtcgaacctagagaccagaagctaaggatacaggattcatgttcactgacaattccatcctgaggtcattggtgccttcttaactgagtctggagtgggtaggggtggaggagtgtggtcaagaatatagagtaaattcagaagttggcaaactaacagatgccatcaatgataatcctgaagtttttgttctgggtatttttgccatttaaaaatcaaaccattagcacaagccaaaagaatgtagtttcatctggttcagcatttctacatgtctgttttaccttttcctccaccacaggcatacgccacgtgcacacacacacacacacacacacacacggacttgcacacacataccacatgcacacacacactatcacttcaccccagggtcacccagctttcgtggcatctgaactctgcccctgtcacctacagactctcct

SEQ ID NO: 124007 - DNA, 1045 bp, Homo sapiens
ctggaggcaattaaaatccctctttcaattaaagtgcatttacggagagggaaggctgtcagttatgtctatagatttatgagctatagatattattcatgcaaaaaacagaaacccatttgaaaagtagtatcggctactaaatagcacagcaattggatgcatagatttggtctcctggtgtgtctgaaattactcttggggtctagcaaatttcatcagaactggtcagctccctttaaaagttatctttttgggatattaatgaattaaagtctgcttttttatatatggtaattatcctggtctgatagggctatcataacaaaatactacagactgtgtggtttaaacaacagtcatttattttctcacagtctggaggctggaagtccaagttcaaggtactgacagggttggttcctggtgagagctctcgccttgacttgcagacagctgtgttcttgctgtgtccccacgtggcctttcttctgtgtgtgcaaagacagcaagatggagctctggtgtctctctgtcttcttataaggacactagtcctcttggattagggccccacacttttatcctcacttaacttcagttattctcttaaaggcctgtattagtctgttttcacactgctgataaagacatacctgagactgggcaatttttcaaaagaaagaagtttagtgaatttacagttccacatggctgaggaagcctcacaatcgtggcagaaggcaagtagaagcaagccccatcttacgtggatggcaacaaagagagagcttgtgcagggaaactcccctttttaaaactctcagatctcatgagactcattgaccatcatgagaacagcacaggaaagacccacccccataattcagtcatctcccaccaggtccctcctacaacacatgggaattatgagggctccaagatgagatttgggtagggacacagagcctgagatttgggtggggacacaaagctgaaccatatcaaggccctgtctccaaatacagttacacttgggggtagg

SEQ ID NO: 124008 - DNA, 1068 bp, Homo sapiens
ttcaggccactttggtcttcttgcccacaagtggagtatttgcagtatggcgcagagagtggtttgggggtgtgggagctgtaggctgcgggtcagggcctcacagcacaggcgtctccatgcagctgttgctcccattgccagcagcgagatttctatccttttattcctacattatatacactaggagcactcccccttcagggaacccagcaaggactctgtgcaatgaatcatcacccttcaggtgcttcttctgttggacccacctacagccgggtaaactgcaggcacagtcccgctccatgagccactgacctgtcacacccatcgtgacgctttgaaaatcgtttagattcttcctgcggcgctttcgatcctgtcttctctctggtctgcatatttttgcattattattttaggaataatctataaatgtgccctttgccttattggagcgtattaattccaaaatgcctgaagccaaaaccgtctacagaaggcagatgttagggtctgagaccccaaactagcatctgtttcctatgtcatcacccagttcccgtttttctgttgctgtctcggtcctcttctcacttagctgaaggtctttagtataaatagaatcctgatgggcctgctccgggcttcctcacgtgcgcttgtttcccgtgaaattcgtttcagccctgcggccacactgtgtcattctgacatcctgggacaaatgagatgattttaaatgtgcctggcgaatttgatcatgagactgcattttctctcgtcggtttcggcatgaattgtcccagagtctcagaaaggggggatccagggcagaattgccagtgtctgtctcgttaagctcagaatcccaggtgagatgctgctgctgtttcactctcaacacaaccctgcctacagtggtttacatacaaagcaagaggccggatgacttctcccccaaagcctcaaacccgttcttaggtttgcacatggaaagaaaaagcatacacagtaataacacatattagcaccttccaaatgtttacgcagcatcaggaagacatt

SEQ ID NO: 124009 - DNA, 1036 bp, Homo sapiens
taggattgtacgcaacaaagtaagggaggaggttaggtagaaataacagaacaaagcagagatatttgtaagcagcctccaggtaaacacagtcacctgtctgagcaggctcaggggtggccaggtgtgggcaggaggctgggctctggcttcctccgggactcagtcctgtcaactcctcttcatttcctggaatccttccctcccgggttaactgcagcagctttgccaggaactctgctctgcaccttcccctccggcctcctgggaggtccacctggtgctcacactcacaggcacctcaagctcctgggggtgacagtggggtgctaggcagccgtcacatgcagcaggcagcacctggctggcctgtcccatgcttctcttgaccacctcttttgctcactccaaccccaggccacctctgcctcacaagccctcggggctgagtcgtggctttctgagctgggggcatcggcaggtgcgcaggtgccttgggcaggagtgagcagcctctgggctccttcccacggccccacctctgcacatccccaccctccacactgctgcattggaaactgtcagagaaccccatcttggatttgttctgatgatcatttctgtgttgttgacaggtgctggcattgacggagtggaggaaattaagcgccatcccttctttgtgaccatagactggaacgtaagttgcatgccacagtccccacctgcacacgcgtgacacagaagtgggtggagggaacatacggcttggtgcagagggtcctcagtgtccgggtcacaagtaggtcggaggtgaatgtagacaagccacctgcaggcagggagcccccaggaccctgctgagcgggctggcaacttgggaggcacagacacgtgagtgcccctccctccagcttgaggcctgaagtcccctcagctttcctccttctactctcctctgcccatcagagtcgaggcttctgtcctccctgcacccactccccggcctctccgagccctgcatattcccgattgc

SEQ ID NO: 124010 - DNA, 2761 bp, Homo sapiens
gttttccgttgctcttgttactgttttcctgtccagaactgatctccagatgatgtgtttttaatgacttcaaacgtggtccattctgatcctcatcccagtttctactggcattgctgggactgcctgtcataagccaggctttgatggttgctgaagaccaggcagccccaccctcacaaccagccctagggagccgctagagacccatgcccagggcctgtctgcagatctgactcccacaccgctcaagcctgagcccctagcccatccctgactcctaaccggctgagtcctgtgggacacgagcgactccctgacaaagggtgtaaacatgaaatagatgaaatttcaaattggccaaaaaaaaaaaaaaaaaaacctttaaacaaataatgtgtagataacctttaagtgatgaagaaattgaaaaagcagacctagtatttaagtcaatgatggaagttgccctggatggttataggctggacatggtgggctggttaggagaagcttgcagtatgtaagaaacctaaggaggcagccagtaagattctactgaatgttcccagaagtgtcggagatgggtttgtgtgactctcaaacaacaaaaatgaaaatattgcaaaggagtcccaaaccatgaattaaccatctcctaaagctatctgtggatatacagacacaatgcacacatttttggcagataccaaaaccctttgggaatcacctgctgagaatttagaatccccacaatgaaatgaatggcttacctcgtgaaaaatatggagtagaagagctggacagaatcggtgcaatgaaagaataaatcatccgtgcagtggctcctgcctataatcccagcactttgggagacccaggcaggcagatcacttgagcccaagagtttgacaccagcctgggcaacatggtgagaccccatctctacaaaaaatacaaaatattagccaggtgtagtggcacatgcctgtagtcccagctactcaggagactgagctgggaggatcacctgagcccaggaaatcgaggctgcagtgagtcacgatcatgccactgcataccagcctgggcgacagaatgaatccccccaaaataaaaaaaaaaatccattcacaggcactgcactgcactttagtcattgatatgagagttccaactggttgcaaaattatacccttaaccagagaacagcaattggagacacagacccagataaacacattaggtgacgccccaatttggagatagaccacaagccatttaaacaaacaggatcaggtgttattactaccgagaagaagtgtgattcttgaatcttctgttcccctgaaccttgaactcctatttgccctgcattaaggaacttaacgacaaattgctaagcctgacaggagggaattccggccttctgtgctcacagtttctgtccctgttcttgtcagtgcttcatgatctagatgagtggcagcagtcctctagaaccaaggaaggccttcagtgcgtgtcatccgcatcccgtagcgagccagccgtgattccagcatcagcctgataccttccgattctccccgcccagaactccactcaccgtcatttgtccagtgggttcagtggagataaaaagggggagccgagtgcaaagtcacctattttaacaagaataataaacctgactgccctgggagggttgacacaggtttcaaggtgctgagtgcaaaagtcctcctcctgtttcatgtttccccctgtaattggaacccctgtaattttttagtgataaccaaagtgttattcccctgttgactctttttgctgagggcttaaaatacaaacatggtgcaaaatcttactaccttaggggaaaggaggtaaagatagaaatgtgttgattgcagtgatccaggtaaacccagcatataccagttacatagtagttataccaatacctgtatttcctctgcctctcactttctaaaattcctgcagaccatatttgcaaatgatgaacaagaaggaaatacagtgggtacaaaatgtgaaatagatcctccaaagaagtacagccaacaagttgccacacctgtgcgtgtaccagggcctctgaactgtttgttccaatctccagccttttgagagtgcctctggccatgcgtccaacagtcaccaaacaaaagagtagaggagaggcacacttcagaggagggtctttctgttaatcatcgtgaccagaaggactcttcaacccagagttctggtcatcatcaaaggaggcctgcacacaggatgggcgcttggggagggctgtttggaagtcagactgtcgctctggaaatttcattacagcagccactggtgcgcctgcgaaggctcatgccagctgctgcgattgcaaaggcctgggatcagatccctgggctcagggtttagaggagaacaagggagctagactggggacccggaggggcctcagcagggagtcctcgggaaagacacttcagaaggtggggcacctcagctgcttttcagacatgtgcctccaaacccagtacctgtaactcataacctctggtctgattttgaacaagctacccaacctgtgtcagcctcagtgtcctcgtctgtaaaatgggaacagcaattgtgcatcggatgactgagatgtccgtgtgctatgtctgtcctatgattctgcgtcctcatggaaggagaaactcctgaatgtgtgcccttcctctaattc

SEQ ID NO: 124011 - DNA, 1014 bp, Homo sapiens
aggtatacgtgcagtctgccatcttaccagagaactcagcagaggcctccactctgcagcacatactttaagattgatcagagaggtatacatacagtctaccatcttatcagagagctcagcagagctctccacactgcagcacatactttaagatcgatcagagaggtatacctgcagtctgccatcttatcagagaactcagcagaggcctccactctgtagcacatactttaagattgatcagagaggtatacgtacagtctaccatcttatcagagaactcagcagagctctccgcgctgcagcacatactttaagatctatcagagaggtatatgtacagtctaccatctcatcagagaactcagcaaaggcctccactctgcagcacatactttaagatcgatcagagagatatacatacagtctactatctcatcagagaattcagcagagctctccacactgcagcacatactttaagattgatcagagaggtatacgtacactctactatctcatcagaggcctccactctgcagcaaatactttaagatctattaattcaatttcaaaggggaccttggcttgattccagagcaatgtcagacatcagtatcctttttaaagccacaaattagagctgagccttcatggcttatttatttctaatctttgcaacaacaaagaccactttgagctttgctcagtcttaattaaaaattgaaaaggcttttcaggaaaattccctatagctatgcttgtatttctgataagagtacttgacttggccttttaaacttgaaaaatgaactatcttttaattcacaactcaattcttttatactttaatatggaatgaatgtataattattctcttttcctgcagagaatttcccagaatttcactgtagcttaatttcagaattttgtaaaaatcccaacttatttgttttcattgaattttatatagaatttttattctatagaaaaattgggcgaaaagcatca

SEQ ID NO: 124012 - DNA, 1238 bp, Homo sapiens
tgagaagcggtcagctgtgcaccttgctctgatgagaccattccaggccactgcttccagagtgtgtgtaatcaccactgcatgtgcccgggggagttggtgcaagaaagaaacccatgctcagacaaggctgtgctccatcccctccttatctcaagttccgtcctggcaggtgtccagtaataacaaaataaggatgtagggtgcggcagctgtatctgagaggttgctgtgccatattgtcctcgtcagaggctaatggctgtggtcaggtctatctcatgctggaagcactctagcccccaccatccaggcatgcatgggtgttcaacatgagctagctgttctcctcctcctcctcctagctcatcccttccacaacacctgccagggcaggacaggttcctaaaccgcgtgtaagatgtgttcgtccaaactgcctgaccacaggaccctgctctgcctcttttctctgtcgtactcggggcctgctggcctgccacagagtgtgattatctaccacatctgtcatttacccgtctcacccaccaaatggcaagctctgcgaggcagttttagtcactgttgtaccccaagcacgtaggccagtggctacaattgactgatggagattttgcatgaggaaatggacacggtagcaggctgccctgctggggtactctgccgtgaagccgggtccatctggatgaatgaactcactgtgctctgtgttgctctgcagtttgagatgctcacggggtccctgccgttccaggggaaggacaggaaggagaccatggctctcatcctcaagtgagtagtgtgggagccaccccagagacctgcgagcaccttctgatatcaagagctgctgcctctgaacctggaactgtgaagttttaattacattgctaggcttacagtgccaaagtattgtaagctgttttctaaaagtcactggttttacacaaaatggtagcgctcgtccgccagtagcagtggtaatagggtgctgggcattctaatgacagtgggtcaagggagcagttgctggtttgtctcatcctgctgagtggttctgatgaactcttctaccatagatagttttccatcagtaagtcacttagaatgtgtagtggctggttttcaagcgtgatggttggtgacctcccagaagtaaaggatagacggaaaaagacacaaggcctccagggccttgtccggagagatcacaggag

SEQ ID NO: 124013 - DNA, 1052 bp, Homo sapiens
aacgtagaatcaaaaaagactttatccagagtaatcccatgaagagagcagcctccgcagctgctgtctccccacaagagcagcagcacaaggccagatttccatttcaaagtgggtctgacctagaaccccgtggtgctctgagccctgggagtcccctttcgcctctccttaattgggaggtgattgcagagcctggcctgtcaccttgggtcgttgccaaggtcatcccagaagttaacctggtattaattaccctccaagtcggagtgccgtgttgtgagtctgtgtggacgttgccactcctcctcctcgtgcggccctggctgttgacgcctgtgtgttagacacactccccgtgcatccactcaggccgggagtgccggttctcattgctcctgaaggtcagcgtgatccttacagctaaaaatagccttatttaattgcaagcttgaaggaaaaggttgtgttgttcaactagaattattagagaattaatcttgaaaggtgcttaattctgggcaaagattgaatatgcccaaaaggcaaagatgaaaagatttgccttgttcattataaattgtcatcttaattacatgctgtaacttttccttcccatttccagaaaatagtggttatttttttaactctgtggcagattttttttaattgtagaaaaatacacatgacttttacagttttcaccacgtttaagtgcccagttcagtggcattaagcacgttcccattgctgggcccccatccccaccgtccatctccagaactgtttcatcttgcagaactaaagctctgtccccctgcacagtagctccccagcccccggcacccgccatccactttccatctctgtgactctggcccctctagggaccatacattttatatttgtaaaatcatataatacctgtcgtttggggacgggcttatttaatcgagcataatgtcctccgggctcctctgtgctgtagcaagtcaggctttccttcctttcacaggtttctataaaggtatcacagattaatcctccaagcc

SEQ ID NO: 124014 - DNA, 1066 bp, Homo sapiens
gatgatgcagctcccttctttttattctcagcagctgagaggtcctgaggtctcagttctccctcctccaggccagatctgtccctctgcagggctggatagcagtatccttttgccccattctagccacgttgtccattccagccatgttgctattgcatcctccacatgacctcttaaatctagaggccctaaacatgtgctgtgtgaaagtcctgtccatggtctcttggctccccaggcccccatgtccctgcccgcaggcctcatcagtgtggcactgcagctctgtgcgccagcccactggcatccctgagggtaccccagctgccaccctacagggccatcccttggcctgtatcctcctgcccaagcacctggaggctcccgggtcccctgtaaggcttagcccctcctctgtgaaaacctcccaggctgtttccagttcccccagcatgcacaggtcccccagcacacaagaggtgggactggtcaccctctggtggccccttgctgccatcaccacagggcatctccccactgggctctcacttcctggagggcagagcctgcctcttcacattccaaacacctggcacaaagaagactgagaagtagtgatgggaaaggagtgggccaggagaagaggtgggggaggaaggaatttgaggccaagcggcaagaattgtgacctcaccattcagctgtctgatttgcaaaagggctaggaagaccgagcctacctttgctcccacatctccccacaatccgcgatcctatggcctattttccagttcacctacatagagaagaaaaactactctgaccagcacgcagaatccagatcactaagacatgaactcacaaatgataaacaggagcgggtgcaagactaaattctgcaggagagccttctgaaaatgtttgcacacaatgactacaatcagaaaggaagaaaagaatctctaaactccggggtcattactctagagagaaaatcatagccaggggtacaaaattgtattctttgaaagtgttctgcgctatcctggcttctgaacacagt

SEQ ID NO: 124015 - DNA, 1055 bp, Homo sapiens
tttttaagtaattctttaatagatctgggatttattttagtgtaagatatagggaggagacctatttttttttttactgtaactaggtagtcccttcaaaatttgaatataagacatctatctttctctaatttttcaccagacttaccaagttttccttaccaatgctataaagtcagacatgtggctaaacaatgttcttcattccaaatggatgtgaattcaataacatcagtcctatttagaggatttttagatgctcttacccagagtcaaagatcaagctttgcaaggagatggcaagatggagtaggaaccccccttttctctgccatgctgcttcaccaggtctcagcttcagatcatgcagggcctggcagatggaacagggacttcacccagaagaggaggcacattggaatgacggatggcctgctctcccgtgggccctgccgagcctgggcctgctctgctgagataaagggcacagtgtaggaagcctggccacatgcatctcatgaggatttctccttgtggaagcattctgagtctagggcgtggcagagcccacgggtcctcaatggcagccccgttggctgtgtgatgtgtgacagagaagttttccttgttgagtttaactttgtttgatgccagcaggcagctcagagagagagaggcttgttgtttaatcatcctagaaggggcagtgtccccacccctcccactgtgtgcagtcactcctgcctcccccacccctggcttcctgcagagcctgcctgcattcgtgagccctgtgtcttctgcctaggcctttgcttttactttgagagaaatctttctgactccactgtgtcctttcttcctttggggtctttgtgctgagtgaatagattccaggtttgctttcatcaactccctgaaactctttggtgctcacactggctgtagctattggaggctgtaacgggggagaggtgggcaatggagatgtgaacccccaaaatctcagacaggtctcagttaatttaaaaagtttatgccaaggttgagggcat

SEQ ID NO: 124016 - DNA, 1106 bp, Homo sapiens
ttgggtgattaaaatctttaaaacccaccgatggtacacaactctgtgaatatcctaaaaaccattgaattgtacactttaaatgggcaaatcatatggaatgtgaattatatctccaaaaagctgttattcttaaaatgaacagctgctagataatacgttcctttcctaaaacccactctttcatcctcgaggcattgagatttgctctcaaacacagatgaggcatcttcctgtggtttaagacaaaggcaagtggatgcgggaagctctccagcctgtccttggccacacactgtcctactgtccatcaggcggttccatgttcacctctccagggcaccaggagtgacccggaagagctccttttctccttcaagcgtaacggttccttctttcccttcaaagttggcctcaccctcccccgccactgaaggaaagggaggcaaagtgggaatgcagctggaatctgtgcctgcctgctctgctctgtaggaatacagtggaatggaggagcgggaagctgcaccctgtttaagttgtcgctaagcctggactccctcagggctgaccttggcctcttagctaaagtgcagaacgctccatctcgatgacttcactctccctaatgcaagtatccacggctgtttataatccagtccacagtgtccttgagaaacggctcctgatccatggttatgtggaataggctggacataaaactctgtgtacagaataatcatggtattgttaaatttaagagtgacttgagcagtagtgaggtgtgtgtatttgtgtgtacacacatgagatggacattgtgccagaagcaaacatgccaaagtgaagggctgacttacaggattggggctagctgttgtcttcttccctatactctgttactgcaagttttcaacagaaatgaaatatctctaatttttttgtaatgtaaagttatttttaaaatattttggaacaatgtgcttgagtagctaaaattatttttatgctatgaaaatgagccatgtggctggatgtggtagtcacacctgtaatcccagcactttagggggcagaggtgggaagattgcttgagcccaggagtt

SEQ ID NO: 124017 - DNA, 1025 bp, Homo sapiens
attctgtgggctggcagggaactgaagccttttagggtgggtgctggatgggggcagctggtccagcttatggggaaacctgcagggtagggagactttctctctgggaggggggcacacttggcagagcagggagctcatgcagaggccttggggccccatgaggctctgagatgtgaaggcggcacttgaatttttaggtcttgcaacagtgtccccagcaactacaggcaggggagcagtacaaatatatcattctctgccttcaggtcacttgccttctagctgaggaaatgagatatatgttgggaaggacctgtcaccaacaagaaggacaaaaaatgcatagaccaaatatgtacagactttaaaccacttaagtatacaaaggaggaaaagagctcttccaagtgagttagaaggtccgtgggacttctggtgaaaattctataggggagagaaatctggttgacatttatcagtacaaccaatggtaagaaaatgcagaagttgaccactttggttagacctgattagaattgtctgtgtgtttgggggcggggagaggactgttacaaacacagatcctggccccactcctgatctactgaatcatcatcttgtagaaacaaggcctagatatatgacttttcaaacaagatgtcccagtaattcttacgtacacaaaagtcttaggtgagacattctagtttattgtaggcactcaagtttttagttcagtgttatcaattgtaacgtaatttaacccatgctttttagagtgaacttttttttttaatgctttaagtgctagggtacacgtgcacaacgtgcaggtttgttacatatgtatacatgtgccatgctggtgtgctgcacccagtaactcatcatttacattaggtacatctcctaatgctatccctcccccatccctccaccccaccacaggccccagtgtgtgatgttccccatcctgtgtccaagggttctcgttgttcaattcccacctatgagtgaaaaca

SEQ ID NO: 124018 - DNA, 1032 bp, Homo sapiens
agcccctgcactcggtaagtgtctagacgttgcccctccagtcttgggggggagccaagagtgcaaaggtcccagccatgtccctctgcccatggcaggtgaggctgctgctccacacggatgctcacttgggccacctggagtttccatggaactagaacatctatagtggctggtctttctggctttttgaggcttagtaaaggagacgttttgggaaggagccaccctacctcggccctccagccatactgcatgggcagccacaccagtgcaccgtgtgcctgtgtcatctccatcatgcaagcagatatttgcatctattggaaaacacttttaggaaaatcaagtactattttcttaatttgcatggaagtttttttttttatacaaaggaactccagttttgtttactaagtttgttaaaaaatcactaatacaaatttaaactcaagctctcaattacctttttttgttgtttttctcagtgatacacatcaaaatgtatttcagaaagcattgccaaatatccgtaagtgtatttaagatccagttagaaaggaactcttaagctactcacagctaaaatttgggtgaagacagttgaagtaagagaaagtagcttttcttgaaaatcggatagagcctgttttgtgtgattggtaatacctttcagcgtggtctctcagtaaggatttacagagggatactcaaaccaaaggatctcccttaaaactcctgtttgtttttctaaacagctggtcttcaaaacaaggggcggtattatttctggcataaaatgcaaagttaatgataccaaaaacaaatgacgcttcttcatacaggcacatagtgatgttcgccgcagagctataggaacttagagcattttccggcagccttgacgttggagaaaattttaaattctcaccagtgtacttgttttattgaaaatgctctaaacttccttgtgtatccccttgtcaaatccaatatggaaagcgagtttgaagtcttacgggtttctgatgt

SEQ ID NO: 124019 - DNA, 1041 bp, Homo sapiens
aaaaatgagtaagtggctaagacacatgctgcctccagggtttgagttgagcctaccttgagaattttacattcagcaatattatataagtgtgtgttcatatgctaatgataataaaccattcagatgtcaagctgttactaaaacctagtagatcaatgtcaaagctagactgcagaatccgtagagagccattgcacacctgtggccattgccaggatacagcccacattagcctccagggaccagcgtggttatcggcccatccctgctatgccactgaaaaagagctggtcgtttttgtgcataggaaatgataaactttttacttagcaattcggaaatagcatcctcgatgcatgggtttcctaaccaagtttccaaatccttttttctaaaataaatagtggactttttggcatgtgactgtgagagcttcagaaaccttttgggattgtctcctccatcactgaagtctctcccaggcaaggcgtgtggtccagatgcagaacaggacacctgcagttgggggatgtggccaaggcattttaccaaacctcaagctagggtagatttaaaaaaaaaacttttataatacaatttcttttgatcttgaacacttatatattgtgccagtaatggcttctggagtgtagaaagttctcaagcccacatctttcgccacacagagggattggctgtcatcatgtgggtgaggccatgccactgggtgattctgcagcctggcatttgagcagggcctcctggggaccgccaagcaccgctctaaaccatttcacaagttttcatcgattccttgaacaaagactgaggaaggatggtgccagacgctttgcgaggtaggaggggataagcaggcattagtacaaaatgtggcctgtcctgtggggggtcaaagacctgtgaaattgagaattgagactgtatttaatccatgcacagcccctgagttcccctgtaagtgttcatggggtcagggagctgctttggagcagcactgggtaacaaggatctctaggc

SEQ ID NO: 124020 - DNA, 1066 bp, Homo sapiens
ggttggttttgccccctgctttcaggctgcagtggaggaggatggagtcctgtgctggagtgggacccccacccccccatggccacccgcgtgccagccgcgagttctcacatcgcatcagacctcgtgacttaggttttgtccctgaatgtttctctctgtccccacacaggatgcacatccggagctgggaagaggaatagaaagggaacagaaattcccgtgggatttttattcagccagcagcttctagttccatggttaattcttctttgcatccaatgtttacaacaaaaggaggcaggttaagctttatatcacattcagcttcataaaactggcctgacagtctgggaatatgttagtcttaagacttgaaacagaagctaaaatgctcacgaacgagcaaaattttgcagatctcttacttctgggaaaggggtagcagtcgcttctcaggtcatcattatttgaaaagctctaagtctaataagaaaaatatgtcactctgtgggaagaagtagcagaaagctgaacttacgaactgcatcagttgcttcagtgatggcagcaccaagaactgcactagaaaattccaaatgttcttgcctggacagacagatagacagatacacacacagggtttggtgcagtttccagccactgcctcggggtagcctgtaggtgagagctccttctgaaatacgcatactagtttcccatgaacagactttgacctaactgtgtatttttcagcagggctaagttctgaataagatccaagaatacggatgcaaatctcggtggggatttgcgctaatgttccaaagctgtcattctgagaaagaagagcaatttggaaacatttgaaaacagatgatagtaggctggctttctttttttaacgtatcagcttgtaatgggtgcagaaattagccaagtctgtttaaagcagtgccctgtgtttggctcagcaatggtatcctctaacaatgggatgagccgcacgtgtgataatatgtgagcattgagtcagggctgactggcccacgtcagagccagcaga

SEQ ID NO: 124021 - DNA, 1024 bp, Homo sapiens
aggttttttttttaattttttaaaatgagttttattgtgtatgtttaaggtatacatgatgcaacgggaaatgagtagagatagtaagaaggttactgcaggaaagcccattaacatagacgtgctttcagttatgcacgtgcgtgtgtgtgttgtggggcaagagcagcagcaatcaactcattccacacgaatcccctgtatagtacagtgcaacgacctgaagtcctcaatgaggatttcaattgtgctgctgcatgtctggattcttctggggcaggctgatggcatggttctcaccctaagtcatgctcctcgccaggctccatctttaggtgtgcccagccctgaaataggatctgtctcctcctaaagcagagtctgacacggagttcacactgggaatctgtgaacttaatcttacgtggatgctgtatctgccagaccctaatgactgattcttatcagcgtttagtaggttcttgctcctcaaagcctactgatgtaggaactagtaatttactgttctgattctatttcccactatgtccaagttttaagcaaaaagtataagcaaaacaacaaaagaagcaaaaccagaaggctgctctaatcaaatagatttagtctttatcatcccgatgatgcttgccaattccagcccctgtgtctttgcttgagctgttttatttcaccttgaatgccctctccacagcaccgtctgtattccccccagttcccttgcctcctcctctgagcaccccaatcaagctgcccaggggcccttcttcctctggcccttcctgttcttgttttctgtgtatctcacttgcatgcctgtggcctcatttgttgggttggtgggtatgatcttgtctcccggtaagatcccaagtctctctccattctgttcatgccacagtttagtttatgttgtatatcaaatctaggagttagaaattttgaaaatgtttccaacaaatctgatttgtttgggccaaagcactgggtgagagtcttctgt

SEQ ID NO: 124022 - DNA, 1216 bp, Homo sapiens
tctttgtgtagtgtaaagaatggaactagttttgttttctgctttttaaataagataaccaatttttttagtgccccttattgtgttgttcatcctttctccatttacctgcaagcacttctgaattcacacaattccctataaggatggagtatttctggctctattctgtttcatgtgtctaacctatgtcaaaaccacactgtcctattaaccatcagtttaaaagaagtcttgatagctaatacagcaagtctctcctacctttatcttatcgggttttctcaatattgtcgtagctcttcttggttctttatgctccaggtagcttttggagacaacttgcgattgacacaactctttaacctaactagattaacttactttcaaattaaataagatgttttaggtagaagtgctttgtaaccaatggagtgctatgtcgatttaagctgtcagtatttgcatcatgaaaatgtgatttatttggatttaagagcattttgtgtattgtatgtatctgctagtatataacttgcttgcaagtagagaaatatggcttgatttctatcattttctctatctaatgtcatgtggcttgtggcctgtgggtgcccaagaaatattatctgaatggaatcatcagtcaggttctaagataggccacgtggttagttgttttttctttttcttctttttttaacacttctaattcttccttcatctgtcaccatctttttgagctgagtataagagattttgtttgtttgtttaagaaatattggatatgcagagtattttaataaattgctccctgcctacaggcaaaagcaagatgaatttcaatagggataatataataagaatgactgagtttaaaatttaatttcctactgattttgataagaccaatttcaaaatgcatgcatattccattttccatttctattcactttgtgcaatgagcttctttcactgatttctacacatctgaaatttcattttacttcaaatacgctacatgcagctatattatttagtcctgaaaatagggcaagtgcaacaacttgtatgttaaaagaattagtgttttcttctcccatttgtttatgcaaccagtttttagactctcgtaggttcttattcaaagataatcaggtggacttcctgcactaaaggatctcaaaacccatcaggaataagggatatttccaaa

SEQ ID NO: 124023 - DNA, 2812 bp, Homo sapiens
tatttttcatgcattcagaagtagaagaatgaagtggaagcccattaaataaaaaaggaactatgttcacatcctctgacttaccatttacctggaatttcattctgtttctcacatgtggggcaaatagtttctcagaagtggcaatttaatagtgggtgggagaagtatgaactctctgaggcagcttccagggctgctggctgtgaaggggaaggggaggaaagaggctttagggctgtagcttcaggatgaaggcaacgttcgggtcaaccagagatgtgtgcggccttggggaccttcagggagctgccaggagagtgctcctttgatatgggggaccaggatgagtttactttgtatgacgtggagttggtaaccagtaacttagccagaaatactctaccttttttgctccaaggatctgtgcttattaaataagcagagctggtctaagactagcagcattctctagaatgctctgcttttatttctgattacactgaattaggttgtgttgcattttctcagcgttttatgtttgctgatatattttcactagtaaaagctattacattgaattcaaataagtaaaaattatcaacaaataggctgttaagctacagtgtgatttaatcaagcaaatggatcagacacaaatatattccatatgaaatactgttaatcacatctgacttgcagctgcgtgagaagccttgcctgctaactgcttagctaggggaaaataatggtgcagctacaaggaagccggaggcacctgcatatcagggcgtggaggacaaatgtgcgtaaccatacacctaggatttattaccaagcaggccagaagcagtgtttccgaccagccaagatgtgtacctgttgttatgcagtcatttgcatatgttatgcagtcatttgcatgcgttcctggagatcagtcagagggtgttcccaagaatgctactgatatgagagccctacctgattccattcggcgaatgctccctagccagtcttcctctatgagccttggtgtgcaaagctccccaggctgggtggtttgcccttgccttgccccgtggaggtaggattctgcaggcatggagcaggtggtgtccctgtttccctcctgcccctgctcggtgccagtctcctgccgtgggaagtgcctgaccttgccggctgccccttctcccagccacctcacactgccctagtgttcttgctgtctcccttgccaaaccactgaatccttctgagcacctgtctccccagctacaaaataggggtaaccctgtaataagggttatctgcaatttattaaatgcttcatcagtgaaatgtgccttgtcaggacagcttgcacttggcatccgtggtgttgcacaaagctgactttggtgagaccatatctgtaaaggttcttgcactacattatgggggaaaaatgttttttctctcctgccagcctctttccttgcccctttgaatacacatctgtttctaattagtattatcaccatgaaactagcttttcctaggttatagctatgttaagtttatatacaatgatggtttaatctttgatgctgtcattttaaacataattcgtggtaatagcccctcttggaaaacagacttgttttccacgctgtttctggcatcagcccacaaggaatggctgagtggggactgttgggagaaaggagaaggcactggtagaaattatctagccttttagagaaaagaattgtttcttctttcagttattctgtcttctgtatgaaattagcaagatttttaaaaaatgaatcaaagattagtacttaggtattggccagtgtatttcctcctgttgccaaagaaaagaaaggcttgaatgagattgacaaataagaaaaacaggcctcatacctgtggaatgattcgtatgctgtagtttcacaatctgaattttcagatggacattagccagaatgcaagcctggggcctgctgtggagagcagtctctgcactcgaagtgcacggtaacattctttgcaccaagacatcttggccacacatcctgccaagggcctgtgggcttgcagcttttactcattaaactgtgaggccaaatttataacaggaggagtggggggattttactttgaatgactttgttttggaatggttatggtagaaatgccctagcgactacttaagaagctcgcacaggtcccaattttaatgctctcagcccaggataattgcaactagttctctagaactaaggtcagatatcatattagcttccaaatagttttacatccataatatcatgtggacaatctttctgagggtgaaaaaccaaggaagcctcttgttctgaactgtgggtaaaacacaagaggagcagagaagatggctttgagaggactctgtgtgagaaaagctgggagccgggcaaggctgggaggaggcaggaagcccagggggctctgcaggccctccacgagccttaagacttcaggccacatggccgtcagctcctgcaggcacctggggccctgggctctctgtcacagggtcaagccctggagagactgctgcgttctacactatgcttgcaaaggtgctacgagaagccctcttgcctgtaacttgttaaagcaactctgttgattggttgactttgaacatagcgaaggaaagaaacacagacaaacaaaacaactttcaaaagagcatttatttttagaacacctttgacttcttgaattcttcttggtttctcatcacttcagggactgaacagacgggctgcgg

SEQ ID NO: 124024 - DNA, 1032 bp, Homo sapiens
acctgcatctcattcaacagtccacttcatagatgaggaaaggggacactggcccatttgctaagctggagttaccgtcacctggctgggataggataccctctgagtgtctggcctatgagtcactgcacttatctacaaaatacgttacccatgccagttgcctaatgagctaaggtggctttgagagcaaggaaatgcaccaccctcaccgtcctaacttagcagaaccataggtccactgagctgaaaggaatcttctccccactcaacctttccacacgccagtagagcctcagaagatgggatgtggaacctccaaagcttagtttgtatttcttccaacagggaatgtacatttaaactaattaaaagtgagattattaactcaagacttccaccaacttgctaaaggtgtcaatatgcaaagtcatttcatttaggaagcagttattagtttggagttaccaaagccagagggttctctttggtgacctattatttgagctatttcagctgtaactggcatttctcctgaaagacagtagggagtgaatgaggaagacaaaatgcgagactctacctgggatattgctagtgatgaactgctgagtggaaggagaatttcgttttatttatctatttgctcaattgttcatacactcaaaagattttagcacatactgtgtgcattgtgctaagcaactgggacataaaaataggatccctgccctcagtgagcttaatgtctaacaatagaggcaaacaagtcaaaagaagcttgctatcagggtataagtgctgtgaaattattggcagctttggatttaaatggtctgattagatcaattgtcaatttatttctatttctggtggtcacagatcatcagaattcatctatctgtacatataaagacattttaattgctcatcccttttaaggaaaacatggtatcctaataaaggaagtgtgaagggactcttagcaagcatcaggaacaatattggctccagtcatggataaaaagaaag

SEQ ID NO: 124025 - DNA, 1088 bp, Homo sapiens
gggagttcaagttactggaaagctggtccggttccgaaaatcgaaccaaacggctccaaacgttatcgctgggactccgtagtaattgggcggtccgtgggtcctcgcgggggcaactccacccccactgcatttccagctggtttctccgccgctggctgcacggggtgtgggatggtcccctgtgggccacagggagccccgggtgaggaggggctttctctgcagctagaccgccgagtggcgcggagcgctccgcgggggtccctcaaagtcccgagtggagaagccccccagctccgccctccgaggcgctgatcaggtgctgtctgccgtgcccggccggcaggttccaccttatcttgtagctcattcgtgcacttgaagtcagtgtagaattcacagaacggggaagaacaggcagcagcacaatctgcttaggcgtctaaaacggcgttcaggagtaaagagcctgatgcaatatcctcgcagcgccgaggctgatacagattcgtcctgaaaacccagagtactcccaaagccctgtcctttctacctgtcccgcatcttggcatcttagagtttccttgtggacggttctctcgtggtgtgttttatttcaaccatcaaatcttattctcttattcccagtgtccaaatcacattgttgaatctatagatgacaaaacagtgaaacgtgtttaagtgaaaaagacatggtgatggggagactgaggctgggacccaaagatttcgcctgacactgtcccgcctttgcctcaaggctggcacctgtggggttttggttggtttgtttcagctggaacaatctcaaatgtttcatcttggttttctttgtcccagctgccatgatattagacacagacatgggttctgtaaccattgagagacctgaggaatagacaaaaaagtagaagagaattacttgtttaaaaagtttctcttatggcatccctaaatcagaattggaagtactagataggatcagtatggccggttcccgagggtaaaacacatctttcaaacaaaactgttaatccagtactggaggagggcttgcttttaag

SEQ ID NO: 124026 - DNA, 1032 bp, Homo sapiens
cacctatctgtaactacatatatatgtgaacacttatttgtaatcacatacacgcgtggacacctatctaaaaccacatatacacatgtgcacatctatctataactacatatatacacgtgcacagttacctgtaaccacatatgcacacgtgcacacctatctataccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctatctataccacatatgcacacgtgcacacctatgcataaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatacacacgtgcacacctatgcagaaccacatatacacatgtgcacacctatctataccacatatatacacgtgcacacctatgcataacc

SEQ ID NO: 124027 - DNA, 1054 bp, Homo sapiens
gctgtgtgtgagcaagcatggtttcttgacagcatgctaggacagggtttgtcttcttgcttatctttaacaagaatatacctgttcttttagcaatagggtactgttgcccttttggcctacaaaagccatttcttctcctaatatcttgatagatatgttgagtgctgttgtatctgtgtgtaactttgttaattttctctaacataaaagcagaggcttttcaccagggcaccaggctggcctctggtggtgaccaggggatccaacccccaagcccagctccactgcccacaggcgagtcacctggggccactccttccaatttagtgcacagcagccttctgctcaatgaaggggtccgttcttggaacctagaacctgtggtgtggagcctctgcttttgttatcttctaaaagttctaaaagttcatgatcttaagaccttgatgataatccaagatctgaattctaaagcgtctttcattgtttacttttaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcc

SEQ ID NO: 124028 - DNA, 1020 bp, Homo sapiens
gaaggagaatgtgtccaccgtggggagggggtcgggagagagagatacttcagagtggacagggctgagaaagctttatgggccgcgaaaggcagagtagttgttggtggatgagggtggctgtggcaggtggcgtttcaggtgagacagctcggggcccagaaagacactgggaggaggagagctctgctctccagagaaacaggagcagagaggaaaacagagccgcagcgagcggcttgtggtctggggatgaagcccaggttgacagcatcctctgcttcgctggtggaggtgggggcatcattctcacacctgtgctgggtcctgtccctgccagccaagggagaccaggaccctgccactgttgcgctcaggatagtccagaactgtcagatcttttctgttgaagtttaatttctaatacacttgtatttaaaatcaggttgcagattttaaagatgcccttgccagagtatatggagtgatacccaaaatccagtgccttccaccaagccaggttagacagttatgttttgtcttcctttttttctcaagaagacaggttctacttttctgatggccttgtcttcaccatgcagttccctggggcagacttgtatttgtgcatttgtgtctgtatatgtgggcatgtggtgtgtgtgtgcatgtgtgtgtgtacatgcatgtgtgcatgtgctgtgtgtgcatgtgtgtgtacatgcatgtgggcatgtgctatgtgtgcatgtgtgtgtacatgcatgtgggcatgtgctatgtgtgcatgtgtgtgcatgtcctgtgtgtgcatgtgtgtacattatgtgggcatgtgctgtgtgtgcatgtacatgcatgtgtgcatgtgctgtatgcgcatgagtatacatgtgcgcatgtgctgtgtgtgcaagtgtgtacattatgtgggcatgtgctgtgtgtgcatgtacatgcatgtgtgcatgtgctgtgtgtgtgcatgtgtgtgcatgttctctgtgtgaacatgcatgt

SEQ ID NO: 124029 - DNA, 1014 bp, Homo sapiens
cctgtctgtaaactagcagtgatatttccgccttgcagagttttgagaaccaaacgaagaacgtgaaagatttttgtaaacctttaatctgcagtaaaatatcaggaatcattctcagtgaccacatttttctggaatacaaattgctgttcacgtgcagccctttagttataggctattcagttgttcttattgtcctctatgtagaatggatgcttaaactataatttgtagaagctgaaatggaaaatgggcctgaggtgtttcctggtaattagctgtcctgcctttccatggctggttgcttagaaatgacagtttgtgccactctgcgaaattccctgactgcaaagcacccactcactgcaggagaccacacgttgctttgtgaatcagtgggggttggggcagcagcatgttcttttttctcagctttgatttgttgttaattgagcaagctgtaattgtagacgtgaactgaaactgattatttaatcgtgggggattgaaataattgcctatgttgcaaataaggaattttatccttcctactttgtaaaagaaatgacatgcctaccacatgggaatagtctgtgctgagagaaaacatgcttgagcattttaattgggaatcagtttcattactttttttttgagatggagtttgtctcttgcccaggctatagtgcaatggcatgatcttggctcactgcaacctctgcctcccgggttcaagcgattctcctcctcagcctcctgagtagctgggatctcaggcacctgccaccacactcggctaatttttttgtatttttagtagagacagtttcaccatgttggtcaggctggtctcaaactcctgatctcaggtgatccacccccttcagcctcccaaagtgttgggattacaggcatgagccactgcacgcagcctgtttcactacttttaagtggagatttttcctaatcctcacaggaagcatgagtgggaaaagcatgggacctgcgccgccc

SEQ ID NO: 124030 - DNA, 1050 bp, Homo sapiens
agacttagcatgtgaggctgagacctcagtcatagtgaagcacctttaagttcagcagaagctaagcctagggcataaacgccatgttgaattcaagatagcttttaaaatcctggcttttttaagaacataaagttaaattccttgtattaacattatattaactgaaggtaattattttctctatcccacttcaatattgcaatttataattcagattacaacccatcaaattttaggtgggaagattaacctagaaatatttttgtgtataattttcaggaaaattaaaagttaagtttagaagaaagcttttgaaaacaaaatgaaatggaagtgatgtccccctttctggttcatcggtgtggcagtgaagtggccttaggattcatggaccctcagtctgtgcgttgaatcacccttgaaaattcgggtggtgaatggttcaggtctcagtcacctgttctgcacagcctgtgttctagaaaattatttcaaaataatggccatgataagttggaatggaagaagataggaaaaaaaattatatgtcacttcacagtgtacttcagatgatgagtttatggtaactgagttatgtgaaagagaatttttccagttgttacaatgttccatgatagagtctgtcagattttagctaaatggcttaaaataaatcagcaaacatgcaaaggccttcagtgagctgggtcttgagcatttaatcaaaacagtgtgggcacagtatgcatttatttttgggctctgataaaggcaagatgacttactttaaattttcaggttgatagttgaattacacacttaaaaaactggttctaaatgaaaaagataaatctcacacacaaattaatatttatatttttgagtgctcctaaatacaaaatatcagctagggaggagctcctgtctgggctgtgtcacccagtcctgtgcctatcactcaagtcacctgactaactccatgggggttggcctctggcttctccacctctgctccttgggcaggggaaggtgtcacagcactgctgt

SEQ ID NO: 124031 - DNA, 1176 bp, Homo sapiens
ggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttttttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaagtgggtaatttaactttttcggagtcccaccaaccatcctgagtaaatattctggaatttgtcaacaagaatagaaccatcatcaaagccttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctctggaccctatgggtctggacccctaattaccttgccttaacggtcatacgtggtctggaagaaatctcagtggtcat

SEQ ID NO: 124032 - DNA, 1930 bp, Homo sapiens
gtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagagtgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtgcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctgcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctcaagagtgttgggtcatgagctaaactgtctggaacaaatcccaactcctcgttgcctcacttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagagcgcaggttgtcacttcagcttgtgcatataatttcattccttcatttatcaatatccagcaagcttttattgtgcgcttatttgatagatactgtgctgggtactgggcaatcaaaaacaaact

SEQ ID NO: 124033 - DNA, 2152 bp, Homo sapiens
gtgttttatttttaaatgtattttaattttaaactaaaatattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagata

SEQ ID NO: 124034 - DNA, 1045 bp, Homo sapiens
ctttccctaccgtcttcttgctagctacctcctaccaaatcagccttgagggcccacggagaatgctagaaactctccaagagtagggtccacccaacctttaggaaccagctttgtgtgctcctgagaaaggtcagatgaggtcaggacaagtcttcaaggaagttgcctaggaactcaagtgaggcttatttagaatgctgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcagtttttatccaggtgaaaatcatactgttgaatcttaa

SEQ ID NO: 124035 - DNA, 1542 bp, Homo sapiens
ctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatcta

SEQ ID NO: 124036 - DNA, 3398 bp, Homo sapiens
tttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaggagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccatgtatggtggctcacggctcacgcctgtaatcccagcactttgggaggccgaggcgggtggatcacttgaggtcagaagttcgagaccagcgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaaaaaaaagaaaaaaaaatggagttaataattttggactacattccagattccttgtttcagttgagtgctttttctattattccacgggtattttacacaatactgctctctttagtatgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatatgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacaaaggttgcacacacacaggtttgattatgctcatgagacttcttttattattgaaaatatcttaaagttttatctcaccaaggaggccttttctctttccctctctttctagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggtttaaaaataagataaatgttttcattttatagttaaaaaataatgaactatggaaggtttataattattggatccataaatctgactatgcgttgttaatgcctttcatgt

SEQ ID NO: 124037 - DNA, 1297 bp, Homo sapiens
gcagggaggcgagttgggggtagcagagagagcaagatggggatcggatgaggtggactcagagatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtggggtgtgggagactacagaggatcaccaaggaagcaggtcctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcagttttaaaggtccccttgaggttagtggtcatgactttaaggggagttcatcagcatggctgttagtggcttctgtaagcaatattaaatctgagaggtggcacttatttgctag

SEQ ID NO: 124038 - DNA, 1737 bp, Homo sapiens
gacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgctgatcgttttaaagtgattatttttagggtaaggctgtaaaagaagtgactccgtctgcctacgctgagcaccttcctgctgctgctcattcagcaggtgtttgaatggcttttatgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtacatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcgatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacatggaagcattggaagagcttcacaggcaggttagggagaaagaaaggtgtgtccccatttgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatct

SEQ ID NO: 124039 - DNA, 1074 bp, Homo sapiens
gaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtccccactcagaaagttctggattttattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatgg

SEQ ID NO: 124040 - DNA, 1025 bp, Homo sapiens
agctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattaattttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttttgagaca

SEQ ID NO: 124041 - DNA, 2743 bp, Homo sapiens
accacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcactgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaactt

SEQ ID NO: 124042 - DNA, 1037 bp, Homo sapiens
ttcatcttcagatacggaactgaacacagccctgcttcattcaccgagttggtttgggagcaggtggagtcatcttagttcaaaccccatcaaacaggaggctgttgtcccggccagcaggtggcgcacaccgtcaaggtttgtttggtggatggttgaagacagtttaagaagcccagcattcgcttctattccctttgtattttctcagctgaattaacacctatatttctgagctatggttaagagggacagtgtgacataaataacaaaaacacattttgccatttggaattttcacatgcacttatcttatctccccagatcttgagattatttctctcagatattttcttttgctaatctttacaggagtaatattttcaatgtgaagacaaagatattctttctacattccttgtccagcattatgcacatgaggttatataatatttgctgatagttaattaaaatcaacacatcttcgggatgggccgtaggagcgaagaggtaaggagattgggatgaaaaggaaagaaaaagcttccaagagtaatttttacgtagtaattaccacaattcccatggcccagtactctaaactcaccaagtcagcggccgtggaagatctagactgatggccactgtgggacacgagcttatgaaagacgaatgttggtgggacagatcatagcacttattcattactgataaccacattcggggatgggaatttggacctgatctactcagtcagtacagttttgggggaaatatcacacccagtgtcgagaatgccatgtaggtgataatcatgtaacaattctgaattgaagaaaaaataatgaaaccacaataatcaggctttacatcatttttcatcttggagcttttgtgtttccataaaggtagaacaggcactgagcgaaggttgtgccatcaccaccttccccgaggccagccagaaggagccgagcatggataagaaggcgaccatcatccggttttcttttatttatttatttattataatttaa

SEQ ID NO: 124043 - DNA, 2072 bp, Homo sapiens
agacttctcacatcccctccgtctgtgttctagttggggaagaagcggacagtggaggctggggacccagctctactcacagggcaagtgtggcagaggccccagcgtggagcctttccgtctggggccatagagcccccagcgtggggcctttccgtctggggccatagagcccccagcgtggggcctttccgtctggggccatagagcccccagcgtggggccttgctttcatgctggatctgggaatctagacagcagccagggagggggccgtctacagtctcctagctccaggctttgggctgcttgcaggaagagttggttctgcagagcaggctccacgtcgtattgccctgcaggccgtccagtgcttgggggatggactgtgtcctagaccctagacctggttgctgcagagggaggggctggaggcacggcatccgggctggtggggacaggttctggacactgccccatggtactcagctgcgggcacacacagcctgttcctgcctggtggggaatattgctgcctggcaggggacgtgtggccctgttgatgtcagaccctctaccagcagagggttctcctctccccgcctgctcttgcctgacacgcaggccatcatggtggttgagtgacatagatggaggtgcgatgggggccactgcagcccccacatgctgggctccccacactgccctcgcagtgctgtgatggtctccatgacaccgcccagctcttcccacgggtgccatgacatctcctgggactcgcgtgtttctcctaaaggtgcctcttgcttctgccttgggtcgcttagtggctgatccaggctggagcatccccgtctgagagcaagtggttttttactagtcctcttccaggctacccaccaacccatccccagggcctggtggttaagcatctggtacccaaaaacagacagcctgggttcaaacctcagctgcggtgtagactgaccatgtgacctctgcaagccttctaattgccctaattcgcaactccctcatctggaaaggaggggaaattgtaattctcttatggtgtaggtgttacattaaatagtgaccacaaagtgcctaggaggtgaaaagagctccaaatgggtaacaatttctaccctcctgcagttccctgggtagggatgggcacaggccggggaactccttacgagggtctgtgagctctgaggcacctgagacctcattgccctgacccgtaggatggactccggtggcagaggaactggaggctggtagtttggacacagacctgtttacagccttcgaacctcactttaaagaaatttctgcccttgcacctagcttattgctcaggaaagtagaaaagcgaaaagccttttcctgctgaaaatcaatggctctctttaaaatattaaaagaacagacaggaggagatggcacgccacgatggcaggggcaaggccaccgccctgaggctgcagctcagaacagatgctccgagtgcagccagatggtgtgattgaaaggaagagagcggccagcagttccagagtggccgcctggagacagccctcagaggtgcagctctgccaacactcacggacccacggcactgacttgccatcaccaagagaatattctgtgattcattcatgaaacaaaggttttcgtggtatgtgaatgttgtgtaaggattgtgaaggatataaagaagttatttcgattatctcagtgtttcctgtcagtatagatcatgtgtgcacaaatcttataataaatgaaattagttttgcatttctgagtgctttgtttgaaaaagataccctgtagtatatgataaaaagtaattctttgccaaaacaaaaagaatccttcgccaaatgtgtctttcacagcccatactcctccccctacaaataaaagtccaaaaaaaagaaaaagaaaaaaagaaaaaagagagagaaaagaaagcgagaatgtggccctgctggttcgtgtaacagcaataatcctgaagatgaagattctcagtagagaaacagatcacatatagccagaag

SEQ ID NO: 124044 - DNA, 1036 bp, Homo sapiens
aatattttccttcttatttagtttttctttgattcctttcatcagagttttgcggttttcctcatatagatcttttgcatattttgttagatttattcttaaggtatttcttttttttcaagtgctctaatatcaatggcattatgtttttaatttcagatcccccttgttcattgctgttatgtaggaaaatgattgacttttggatattatcttgcagtctgccactttgctattaatgtaattgcttgttagtttcaggtgtgttttctgtggtcatttctctcagattttctacatagacaattacatcatctgtaaacaaagacaactttatttctttcttcccatctatataccttatattttatttatttgtttattgcattagctgggacttttagtatgatgttgcaaaggagtctggagaggcgacaccgtgcctcgttcctggtcttagtgggaaaagttttgagtttctcaccagtaagtgtgatgttagctgtagggtttgtgtagatattctttatcaagttgagggaagttctcatctatctcagttatcatttttaatagctgaataaaaggtattacatcgagttcatgttcaaagctggttaaggcaccatcaccgtgaggtttccatgcattgcgcagtccagagtccatggttatggcccttcagtttcagatgaagaacaaaaccagagaaaggccccagagccaccctggagtgtggggtggaaaacaccaagaggcctgtttttccagaccttctttgaagagcttcatcttcaggtaccaatgcagtgggggtgggtgtcagaggaaggatgactaagttggggcgccctcatggcagggacagcttgggattggggacaacgctcctgtgttggccttctgcatctggtttaattctgtcctgagagacatcagctctgttagctcctgccatgtctccagaacctcagagctatggataagtgaatgaactttactacctgatttatgagaaacactttgtgagtgtttt

SEQ ID NO: 124045 - DNA, 1130 bp, Homo sapiens
ccagcagcaaattaggttggctctaacttccaaatatatccaggacagaatcacttgcaggcattttgtgccaaatcctcacaaagctctttagacattttcctaagtcacaggtgagggtcctggtgactttccgtgccctggggctgtcagggcagcaggccctggagcggggcagaactgtgccctttcagctccggcctgccttcctcatccagctcagacggggggcagagggaggagggcaatgtcaagatggagtgccccaagctggggccgcagaagcaggctctgtgcaagtggggtgggggcgcccggaggacttgacgcagaacccctctctcctctgcctgcacgcctggctctcccctcctatggctgcgtggttgtgaggggagtgggcggctgtttggacatcagtcccccagtttagccttgttgtcctggagggattctgagcaagcatcccaggctaggaggggccatcccagtgaagccttgggaagagtcgccaggcttctggggccctctcctggctcggttcatgggctgggtatgtgacaaagggattttgaaggcctctgtgggccctgctatgggctctgccctctgaggtgttcctggtggtcaataatccgggccatcactcgggggctccgtctgcagggacaggctctggacatggagcccagcagagcccgtggctgcccagggatgaatcctgcgacacagttatgccctcctctccaccgggttgcctcagaccacagcaaatggtctggcccaggggtctgaaggagctgccggctgccgtggcatagagggcatcccctagccttgctgtgccacagccaaatcctcactgctgagtccatttacactacttcaagcgcactaagcacatgtatttacttcctactctctgccactgtcactgttagtggcagcctcggttccccttcccagtccctgcaggatgatgtggggtcagtgagcaagagacccacagctcacccgaaaccatggcgcagaaaccatggcaaaaccggtttcaggctccacatatggtgaggaaaggaacctcctggagcttcttccgcagggcaccgggactgcctggggcttcgacg

SEQ ID NO: 124046 - DNA, 1863 bp, Homo sapiens
ggagactggatatatctggtgataatttcactaatcaatcaatgcaatcaaccccttatgctactcttatccgggtaatttatcatggacattccagttactttccttccataggtgaagtttatgcttcactagtataaaacgcagcattgttcagaactaaggtgacatttaggaagggcaaacaatgggaagaaaagctttcctggggggcgtgtaaggttagcgaggggtggagatgaaaggtagagggagtacaaagatgggacccagaagtgggggtgaacagggaggcatctagggatgtttcctcttggtcacagaaagatgcccatcccgcttcggccttctgcgccagccctctctgtgcacacagcctaatgcatgtggtagcaggtgcacagtgtgtgtccacatctcttcttctctttgctaccacccagcttggtctgctgccaaaccaatgggcttgttagtaatatatagatgggtggatggagggatggggggagggaaaaagggagggaggcatggacgggtgtacagtggagagctgtaatccggtgttctgggttgagagaggctgcatggcatggtgactaagagccagcctttcagggctgcgcagcctgagtttaaatccctgtgcccagcatcctccccgtatggccccctgcctcagtctttccaactgtaaaatgtcaataataacgggccgtcgtgaggattgagtgagttaatccaggagcagtgcctggctcagcgtctgctgtgcaaccgtgactatctccccaatccctcctcactcagtggctggcctcctggctgcttgagcttctgtggcagagctgggctggagaacgatcgtgcagactcccatccagagcacacgtcacatgggcactggacagagtcctgggaaccagagagtcagctcaaagttttcacagtttcaaaatacttcctcacctctgacctcagcactccaaggcagccatgtggatgccggctcttggcagggagtgaatggaatctttaaggagcgctccagccgccttgccctggggcgaccttggctcagcacacatcctaatgctcaaggccttcagggccagggtcttcccatgaggccccctctgtgcatccatctgttccgcaagtatttgttaagcacctactgtacgcatgtgtgtggtttggggtctgccacctctaccttcattctgagtcaggtcttttcctatgaaatgtttatctttctgttctgcactgtgtggtcttgatgcttgccagggaatcagggttgggtttggcaggcatgagcctggaaccttccagaacggtgtgggaggtaacaatgagtgattacaacatggctcttgattttctcccctcctcatacctaacctcattttctcacccttaacctagggttccttaactccagatctgggtgaacttcctgaggagggtataaagagtgatatgggacattagaaggttttggaaggaaaacttgaacatcccactgagccctcaagtgagcagaatggctatcatgagggtgtgcagttgtcctacaactttatctgtatgtgggtggggtggggtgaggtggggtgggtgggtgccaggaatggagtgggaccatctgggtcattccatgccccttagtaccagaatgaccctgtctggacctggggtaaactgatctgaagcagacagacaggtagtctccacagggaaggctttcctgacttcagggtctttgttgggctgggccttgacgtgatttccgttcccaaagccgacgagcagtgtggaggatggggaggagcccactcttacatgtccatggggtcc

SEQ ID NO: 124047 - DNA, 1016 bp, Homo sapiens
cctaaggctctttgtttaacttgttacaaattagaccagcctctccagcagttgccaccaaattctaaaagagaatccgaaacactctgcctcgtcctaccttgggatgcttgttgacacggtctctgtctttgtgcatggccgtgagaagtctctctcggtcacatgaggacaattagccttgcttcagcaagggcaccacagcatactgggtccccagatggtgagacctgaatgcgcagtgtccccaccccaccccccggccccgtgggcgttcctccgtggcttcgggaggctctgactcaggatagtaaaagaagctctagccgcaaaggcgtcgcgacagcagcctccaggctttagttacaccccccccaccagtgcggaagaagacattcttcaaatttataaattataagaaatcagaaaatgaaaagatcaaaatgctaaataaactggcgttaaggagctctcgctctgctcttgcgcgtggtagtggtgagagcggggcatccgagagccctagagctggtgactgggcgacctcagcctaacacctgcctttgagcctgtatcctcgccaggtggctggaagagtaactgatggggattgggacaaaggtccccacaggtgtcttcttagtttatattcatttcctcattccaagagtgctattttagggcatttaaaagtgaaatggttctaataagataaaattacatttccatgtagacagaaacaaatttaatggaattttgttaaattgcaccattattaaatgttgaacaaacacccattgatggccacagtgcagcaagtactccggcagggagtaccagatacacggaaacggattctacattcaaagatgtcacaatctcgaaagggaagtagatcatctatgcaactcgtaatcatgggtggaaaacggaacatgtttgcagagaaatataagaaaagcatcctaatagttcataggaaaagtcagacaaataccaaattacaaatgaattct

SEQ ID NO: 124048 - DNA, 1074 bp, Homo sapiens
tcattattttttagtttacagttgtattttcttagatggaaatagacgatagttatgaattcacctctaaatatccttggagaaatcacaaaggtggattaatgggcatcctccactgatgcaggcagaagaacgttgagaacagggcagggatgtgaagacacaaaagcaagaacccaggctcacctgggcatgctgtcttccggggaagaaggcagcaccatggcactgggaaacttggtgaaaaattccatctctggagtcacattgctcccatctggactaggactcagtatcttgtatgagttgtcatcctgagatctcccttcagccccctcatgggaggtttctgtaaacataactcctgttttctatcttctgtttcctctgttctttccttggcaagaagccaggccaaccatggcagttgataatatgttctcctctgagctcttgctatactttctacctcatccattttcctcttcatactgattaagttattatgataacctaattgattcctgttcttctatgttgaacacatacaggaaagtgcatgccccatcattatacagcttgatgaacacttgtgcacacacccaggtttaaacacaacagcagaatatggccaacaccccggagccccactcgtgtctcttcccagtcactcccttcactccctgctcaagttaaacgctgtcctgacatcacagactcatttgtcttgtttttgaagtttgtgaaaacggaatcctacagtatatatttttgtgggtatgtttggcttcttttcctcagaactgagtgtgactgtgtatgtatgaaagattcatcctttggttgtatgaggcaacagttatttcatataaattgctgtttaatgtcctattgtttggctactgtgatgtccactgttagtgaacatttggattgcttccaatgtttgactgcccataagaatgctgccgtgaatagttacgtatgtgtcttgatgtgcagcacgagctcacatgctggttgggcacgtgcctatgagtggaattgctgaggcattgggtaggcacatacaca

SEQ ID NO: 124049 - DNA, 1064 bp, Homo sapiens
gttaataaacgtcgaggggaagctttgatgcgccccatttggccctgagagatgccacgtgatcgtcattttaaatcctgtacgtgtccccgtggacgtggaaacctgaaattaatttcagtagcaagctttgtgaattgtagggattttttttcataaggtgtcttttttgtaattgcccctcccctcccccaccctttgttttggctgcagagcgccatctctgcagtctccccacgccgggttcagtcaggcgaagttgcgttatctgtgatgtgttgtaacaaaaagcgtttatctttgaaacactaaggcaagtaatgagaagagtgaactatatttgacaaagcctttttatttttgtcattacttttttttccaatgtggaaataatttttctctccaccaactggatttcctcttttgcagacaattaaagaattctgtcatccccactgggttctgtcttttctaccgcacttgtccagtacagctacataaggaggcttctcagcagaggagcctggggtgttgaaccagtgccatgagggaatgaattattcaatagatcgctagtctcctttcttaaaattaaagtgtggtgacttgcagaaaagcatctgtgtctaaatgtcatcttcgtgttctagcactcggtttctttatgcctttcagttcctgggcttcccgatggactcgagtttttactatgtgagcatcccggtgcctgcacagcaaggactctcattgggttccacacgtgctgcgcagatccctgacgcagcgttcactgaacctcaactgcaggagcttcattcctgaggacgctgttaccaagaatgacttgcctcttgaagaatgagtttgcaaagccggcagttagattgctgatgtccaaagtaagtatgtgtagcatcactaaagagaaaattcaggattcctggaaaacagttatgggctctctgcagtgttatttttgtaataaaaaacatatagcatatgtgaaatacctactgggtgatgcaggacacatagaaggctcgaaattaatgtgaatcattctc

SEQ ID NO: 124050 - DNA, 1806 bp, Homo sapiens
cggtaccgccggttgggacccaccaccgccagtccagacggaaccctagcaccgcgcggggcccgccctccgacacctccctccctggcggccgcggcagcagcacctagtggagcggcccggaggtgcggcggcgccgcgcggggcggcggcgcgcacggcgggcggcggcgcgcacggcggcgggcggggcgcgggcgggtgcgggcggcgggcggcgggcgccgggcgcacaccggccggcggggctgaggcggcgcggcgcggcgcggactgagccccaggcggaggccaagtcggaggacgcggcgcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggtgagcaccgccgggcgcggggcctgcgcgacccccgcccgctgcgccgcgccccgcccctcccccccgccgccgcccgccagccgcggacccgccctcctttccccctcccccctccgccccttctctcccctccccctcccccaggcccaccgcgggccccggcgtcccccgcagcccccgtccccctgccgcggtgtatcccggggtcgcgcgggccgagcgggggctggcggggcgcggcagtcacctgttcccctctccggccgctcacctggtggctcacctgggccgccgcccccacccccgcgagcgcggcgcggccccggcctcatccccggcggcgcggggggcgcggcggcgcgcggggccggcgccctccacctgcagcccggttgtggctcgcggcgccccttcgccgtggccgggatggagcctgtgacgcgcgctgtgcttcgggttcataaacttgcaggctgccagctgggaggggaaagtcagtatcacaaagttcgggaggtgcgggctgcctgatggcacaggcccggagtcggacgcctccgaggaaaggcgcgccttctccaccttcggggccgcgaggaagggccctctgcggcggcctctgcccggagggaggcgccggccccaggctggctccctgagaggaggaggaaatcacgctcgctcctggcctggtaacaatgggggttgtttatagcaaagctgctgaaagcgttccgagcagcttttaaaaaaatgtttgagtccaagtccactaggaagggctccgtggagaggggagggaggtgaagggtcggggagcaaccctgtaaatcgctccgcaagggtcggttccgcgctctgttcattcggtggctgcacagactttaccagcataaaaaaatttcactcaatatttgtgcccgtttaggaaatcattttaatagcgtctatttttgatttgttgtaataggtaatttatagttaatacttgctataaaatactagctcctaggcaacaaaacatgtttggcagatttgaacattcttacgaaatgtaatccttttatcattaaattccactttatgtttttgagagaatttgactattgcttctctgatttcttgagtttttgccagtcatgggaaggactctatttcttctgttttcatctgtacctgtgactgcacttgacgtgggtagctagccatttgtcttaatactgagttgaatactgacacacgccat

SEQ ID NO: 124051 - DNA, 1060 bp, Homo sapiens
tttagtagagacggggttttgccatgttggccaggctggtcttgaactcctggcctcaggtgatctgcctggcctcccaaagtcctgggattacaggcatgagccactgtgcctggctgtcaatagttgtatttttaaatattggtactgctgaagatctgtttctggtgactgatgttttaatgagatggatgattgccaatgatgtatttttagtatttataggcatccctattttttatttttgataagttgaatctcattggtggttataaccttttaaaaatcttttatttcctttaataactggttacgttttatgtttgattcggtgtgttcttgtaagtctgagggacagctcttatctaacagtgttgagtcatcttaagttgaaactacatctaggctagtttcaatttgctgtcttcctgccagtgaaaaataattttattttacataatttgcagacctgatggaaaataagtgttataactgtagacttttataacactatcaaactgtgattgtggttaaattaatagtggcagactagcagaagtgggtctttcatattcttgaaaaacagggatcataaatgattaggatatgataccaaattggtgagaagcttaagaaacgtttatgattgtcattaaggatttgattgagcaattgtagtgtataaagcattatttctaggtgttggttaatctggtagcatagactaatttgtttataaacagttttaccagacttgaattttggtgtaatgtcagacagtgtgtactaataagtaggatagcatttattttgatataaacatgtttctttattataaataaaatgtatatgcaggtagcagttattgaacatatgagactgaactcatttgaaaattattttcaggttagattgagtcttgatttctgctgttgttcaaatgtttgctatttctgttagttttctggctgatagtatataggatatacccattcaccttgtagatacttaagacagagatcaaatgtatctgtctgacctacatttacacttgtaagtt

SEQ ID NO: 124052 - DNA, 1057 bp, Homo sapiens
ggctgagaggtggcaagggagatctttgcctagctgaagtcatctggttgagattttattctagcaaccataagaacataaaattcactaatcattttgacatatgtgattgaccaaaaccatattagaatttaatttagaaagtgaatgtgcttaataaagtgagaataagcatatagagaggtggttcaaatacaagcaggaaggtattttcccagtgtatttccaaaaaggataatttgaagttttatacttacaaatttatgcatgtatgtcatgagtgaaactcttttgaggaactgaaatggaatagtttactatggctggaaaagagccaaaatttttgtgcttttgctcacaagaaatttaatgttaaaattgtatggcttacagaaaataagcaatgtcaaccttggttgcacatgtttacactttgctgtgtttttaggctgaatatacacaacttgctttaccttgtaagcgtcactcctttgtagttagagtggctatgtggaaccctgtgagtacaagtgggcactattaataattataccaggacaacagccataaactggagttgtctcctttaactctaggtatgaacaggttggacttgctggcactgttttttcagtttctgcagtttcaaacttcctgaagtttattagtgcctgactgacctaggctgacaggacaagaccattttcacagaatattcagacttttttgtgggtgttttaaaaaccatcttcctcttcggtagggtggaagcaggctgaaaagtacatattgcagttgaggctagctctagtctagctctgccactgactatagtaacaacagcaggataggttgtttccaaattaggaagtcgtgccttgcctcctaaaactccacctgaaagtgcctttgattttcagaatagaagaaaggttgacccaacattatgatccgtgaaaaaaatgctcatttgtttgttgtttggggggtgttttattggctgagtggtgcagtgggctgttctattcagaatcctagcaagttctcttgcttgagt

SEQ ID NO: 124053 - DNA, 1079 bp, Homo sapiens
atatgattagacatgaaggagctagtatgtttgcttcactatagtaagatacatttaaaaaatatttgcttctttccattattcaaatatgcttattttagagcatttggaaaatacaaacagaaatgaaggtaacaaattacctagtgttctgccatctgaagaaatgagttgcttttcaggctttttttttttttttaacattttattttattttggaaaaaagtttgcgtgtatgtttagctgtatctgcttattagttgtttacatctttagtactgaatcgtgtttcttaaccagccatgcatctgtcaggaatctagtttttaaagtcacctaagttattctgatagtaattgtaatacatcacatgtagtgaacacatgtgatatatacctgacattagtgtaaatgctttgtgtatgttatctttttacgttctcctgtgaggtatgtccttttgctgttcccatttctggatgaagaacccaaggcacagggagattaaataacttgcttcagggtatgcaaaactagtaagccacagagcagtgattggaacccagatcctctgactctggaaccttctcttaagcactatgtttgtaaaatccaaaaatttaaggtcactgcaatgaaaccagtgtttggaagttttataggaaaataatatccaagtagaaaatttggaatgtaattttcaggaagaaccacaggcataatgtaataaaacatctcttctgttttatttggatcatatacttatgtgcatatatatttatttcatacataaatacatgatgtattgattttcatctagactttttaaagccctattataattttatcattgtgatagtagattctgtgttttgtagccaaggtgacacatgccatattttattttgtaactatatacaaaccttgtatcttatatagcatccagaaattggaatatgaatgaggagttcagtgaagaagtcttcatagcttcactgattactttcttaggcctataggaaagaaaggaggtcaagacctacccaaggttcagatgcctttttgacagcattggctgt

SEQ ID NO: 124054 - DNA, 1054 bp, Homo sapiens
cttcgtcctccatgatcttgctttaaagtttgttaaattgcatttaatttaatttctactctctggtcttgcttcatagttttttcggtatcctcttaaatgccccccttcctagcattctgtaaagtttcctattctttgatcatctgtgatgtccataatatatcagttagagtgtttcaatttatgttgctaattttttttttctactactggaaacatttttatgattgttatctattttattacttcaagagcgctctggattctcaccgatgcctttcttcttttgagatcccattcctctgggactttgcagctgccctttcattccttctgtcttacttcccttcctctctgtcctttcttcttacctcccattcactcatctttgggcttttctcttctgttaaaaggcactcaggttttgttttttaattaaaaaaaaaactttgctaaagttttgtaactcttcatgttttgtctcatcattcattaaacaaacatttctactccaacttactgcaggaattatccctttcccccatctactcctgactcatttaacccttgcctttcttgcttctatccccaaaacactgctagaactgcctttcttgatagccttgatttcctgattaccaaaaccagttgcccactgtgggaccataaaaggctttatttaccaccctttttttttcttggtaatgatactagcctctttctggagctattctttccttatctcccttagttgactccattttgctcatgtctcaggacagtgtgtattgtaatgctggattcttgatgttcttctactcattctctcaattaaaaaatgccccataattaactatggggccacaatcctgaggtcaaggaggcacattgataatgactctagctgacataatatacttagcatttattgacttcaaactgtgtatgcttatttagatatttaaaaatttggctggcattcctgggtcacagtatatactctgcaagatgggttgatggagagcctgatttcgtggtagctgctatttac

SEQ ID NO: 124055 - DNA, 1069 bp, Homo sapiens
cccaatatttcatcacctggaggactccagactgctaaaatgcccctttagcaattcctgacctcttctccctacaatatgagaagaaaaagttgctgtagggaaatctactaaaagtcaaggatgtgacagtattcctcactgaattaagcactaagtataagagagctattttattgctaagattgatgaatgggcattagtacattgttaatgcacttaaaagggtattgcactaaacttgagctctttgaggacagagaccaggctgtgtggtcttccagaggaggacacaatgtgcacagtggataattgaagaatgcatgcattaagaaattaatgaaagttgatcggtaaggacataactgtcatacacaaactcagcacagtaaatttgaagacttttatttaaagctttgaaagtctggccccttgctgggcttgtgtagatttctttagaaataggataacttacagcaaaaatttattaaatataagtagctcattgcagatattcatgatttggtagtacattgtaagaaataatagatttattctgagaatatgctgctgcttttcacctggtactataatctgctcatataattagaaccttttgtgttaacatttcaatatctgactaaaggagaaacaccttgggatagttaggctgttgaagactaatgtaagctttttcaggtgggcagtaactgacctgttttactcaaagggaaacttaagttttatagcaagagatatggagagcttgtatttattaagatttatgtggataaaatttagttcgtgttttttgaattgagtctgtagggtaaatttgaaggtctccctttctcctctgaattctagctatccagacatagccactgtaaggaatttttacagtgtgtctttcccagttttgctcttgtagactcaaaaatgaagtgtgtgtgtgtgtgtgtgtgtgtgtgtgtgtgtgtgtgtgttttgagatgagatcttgctgtgttgctcaggctggtctcttaaatcctgggctcaagcaatcctcctgcctcccaaatagctg

SEQ ID NO: 124056 - DNA, 1922 bp, Homo sapiens
cttcttcacaaggtggcaggagagaagtgagtgcaagcaggggaaatgccagatgcttataaaaccatcagatctccactcagtcacaagaacagcatgggggaaactgcctccatgatccaatcacttccctcccttgacataaggggattatgattcgagatgagatttgggtgggggcacacagccaaaccatatcacttgagttacagcggatagcttggaccccattccttttacatctagtaggtagcagtttatcagagcttgggcggtcttttttttccttaaatgaggttcaaatttattaaactctctgtgactggactgcgtggtatcgaaagaagccttggatgtaggtttgttaatgagatctttaaatgttgactagtttagatgttttaagttcctaatttttcatatgactacaaaaatactaaaataattttacttcagtgactttgagaagattctcaaaatgaactataggggtgtttttttctgttttggggataaatgaacataaacaaaactccccgaaaaccagtgcgtgaacttttaaaagttcaaaaataagccatgagctttgtagaaattagccttactgatagttgtaaatagttaaggttgtctgattacttaaaacttctcattaactttttatttgttgtgatgtatatttatgaaatggctttttttttcagtttatttccacaaacatcacagtaaagaaaataattgaagattgaaaaaagtataatatttaaaaaaaaaaccaagttgttttttttttttttttcaatgtatcttagagaatcttctatgagatttgggggaggagtataggatgtctaggaaatggcattttcaggggagttaatctattagaaaagtcataattaaaactctgagttagtagaaatcaaatattgtttaatataattcgtcaactgaatctgcgttaagacattcaataattgtattattgttttgccagtttagttatttgattgatgcaaacctgtcatctgtacaataaaaaaatagtgaggtatgtctatactctgtcagtttgtttaattttaaagctgaaagttaaattttagaacgcttttcatttgcttttttaccgtaagtgggagcagcttttaacttcacgaaaaccactctcctcaaagtcattaaagactttcatgctgacacatccagtcgtttatcttctgatgcagcagcagttgatcacatcttccatcaaattcttccttcacttggtcttcaggactggcctgttgcccagacctcagggtctgatcccaatacacactcttttctccacttattccctaggtgaaatatttcatttttgtggttttaagtgctaatatattccaaatttacatctctaagtttggcccttgttctgaacttcagccccatatagccagtccctcatatctctatttaggtgcactctaggcatctcaaagtgagcctgtccaaaactaaactctgatttcccaccactgcactctcatcggcaccgcactctcatctgcttcttcttcagccctctcctaagtcttagtgaacagcagctcactttaccaattgctaatgtccacagcctggcattcttctggattcctttcttcctctcagaccatgatcatatctaatcttagcagcagattctgtcagctctactttcaaaatatttttataatttaaccacttttcaccatctttgcttcttactactgaattaatccaggctaacttcatatctcccacctgggttgttccagtaacctcttacttagtcttaatttatttcccttgtctgcctttgcccccttacagtctgtttcctacacagacatacacttctaaaccttaagttaaataatgtaatgtttctattc

SEQ ID NO: 124057 - DNA, 2112 bp, Homo sapiens
agtatttgtgggttttttctttcccttgattttatatgtttatctttgtatcatgtaatgtaacttgtggggggggagagatttccagcaacatgtttaggtttagtattgtatgttctaggttgactctgcattcttgtttgttgccgtttcttattttgtgttcaattatagctagaaatgatagtaccttcttcaaaagtatccttatatgagatttttttgaacagtgtaatgttataaaaacccaatcagtgattttgaggtttttgtttcatggaactttacacatcttaccatattcttatcatattctgtatccctgtctttgagttcatgcctattgtgtattccattacttacctaaagaatttgtttcagaatgtactttttagaaatctatatgtgtatgtgttagcctaggatatttatttaacagtatagaagattctcaaaaacaggagttaagagtattattctagtgaacagagtgtttccataaaattaaatgagaatctacttcactgattggttcttttcaccatgattctgttttgcaaagagaattaattaagaaaacttaattgaacagtgagctggtttcattagtgtcacttttcctgtcgaggttctaggttccttttgtaagttactactgataagaatcctcctaaacagcttgacctcctttcagaagtccgtgtgctgatttacacagcttacctttttgtttttctcatgcctggtactaagtgacattccaatctgctgtagtcatttggtaatgcaaagagtgaaactggaagggtaggcaggaggtaccggttggcaccaaatatgcagttcaagatcactcatgataccagggagagaatgtcaaatacttgaaccagaacaacacattgttttagtttgtaaaattccagttataaggcagtaatagtcatgttactctacctcaaaattattttctttctcatttgttcttttcacctctgtcccaacccccctctcgctcatggatgtgttttgtgtgaaatgtgaaaggtcttaagatagtggaggcttgaaaaaactgcctgtgttttaaaatgtgcttgtgtttgtttcctaatgcagtactttgaagatattttaggtttaggtaagttgctttaagtttttttttcttaattggagtaggttgagtgctgtgaattcaatttttagtgtactataaaaagatagatggaagcactttgattataggaagtttctttgaatcatttgctatagtttgagtgtttactttaatgtgaaactcactgtaaatccaagtaaatgctgatctaccaatgttcatgtatataatttgtatggtacattatcttcatcgttcaaatttagaaccttcttattatttcacatacttaaagaagaatcttagttgcagattcaagatgaagattataaaacattttcttgggttttctttcagtattataattttgaggctgaatttaagaacatggttattttctgtagacaccaaaacattttataattttgtgtataggttgatttgggtagatcagttatatcactggaaatgatttcaactctcagaaattgtatttcaacaatataattttttattgtgtgtgtgtgtgtgtgtgacaaagtcttgctctgttgcccatagctggagccgatctcggctcattgcaacctctgcctcctgcaagcgattcttctgcctcctgcattcaggcgattctcctgcctcctgcattcaagcgattctcctgcctcaacctcctgctggggttacaggcacccaccaccatgcccagctaatttcaacaatagaatttgaaatatgtatagtgccattctattttttctacaaagtttgatggttttcatttttcacgtcatatatacagatctttaatatatactctgttattttttgcttttgtatttagttttgctagagataggttttttatacacatacacataaacacaaacacacacctttctttttttaacttttagggtcaggggacatctgcagggtatgcaggtttgttacctaggtaaatgtatatcataggagtttgttgtact

SEQ ID NO: 124058 - DNA, 1050 bp, Homo sapiens
cttccaagactggtgagggctgctgccatcgctttgtgtggggtataacattaatgtgatgagaacaatctcatagaatcagtggaacttctgtgtggtattaacattatgtccttattttccagttgcatatgagataatttgatttacagaaataagcttttagcaaaaaccatgtatactttttttcttattgcatgtatatttctcttattttcccagttagatctaaatgagggaattgcctctgttcagtgtctggcactggatatgtggtaataaacatacagtagcaacaaaatgttgaattaattaaaacaaatgattttacattttgaacaatacatttcagtctgcaagtaggtgctttgtctataaaattaaatgtatatcagaatgcttgtattagctagttctatgaaataaccatagcttattctttttttcatttcatgttttgaagaagaaagaagattggatatagatgagaaacctctagttgtacaactgaattggaacaaagatgatcgggaaggcagatttgttcttaagaatgagaatgacgccattcctcctaaggtaggaaccctcagtattttatgacggtcttggtccagggccaggtctgactgataaacaggagactgatgttttgttacaggagttccttctcttttttgcttctctttataaacccttttaccctcctcccagaaaataatttaaaagaagcctttttctctctactttatcctttatctcaactagtaattccagatattgtttctcaccttttcaaagaatatttatgtaaactcgttactgtgagatttaatgatcaggtgatcagctgcagttattttttttttccaaaatataaaatcagaatagttctaataaggatcaaaagggaaaataacgcttttatatctatttgtgaacttttagatgcaactttggtcatttaaaacgttttcattatgtgcagggttaggaattagtaaactttcttgaatgatggaatagagtgattctacaacttcctaggtg

SEQ ID NO: 124059 - DNA, 1060 bp, Homo sapiens
tttcataaaagccaatttattatggctactcttaacaattcctttaaagttaaaaactactataggcgatttgtctattattcactctttgtttttataattttgttaggtttcttttattcaagttactttatgtaaattacttggagttttatttactgaaaatcagatttcatcatttctcccccagttttctaactggctttgatttttgtttcttagcttgcttgcttgctagtttttaaatgaggtaaaatatagattcggtgagatgcacagatcttgagtgtgcagttcaattgattttgataaatacacccatgtaactgccagctgaatcaagataaagaccattctcattactccagaccttcctgtgtttcagtagctttgttcacatgttcggcagcatgtgagatgaagttacctaagccgtaggcaattttatgtgattctgcatagtagtcaatatggtgataatgttactttcatcagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgtgtaagtcagttttggaaatgttcccctttctttgtgctccaaatcagatgtttttgttgcaccaaaattgttaaattttcagataaattatggaaaggatgagtatcagtcaggaaatgtgtttgggtctactcccagctcttctgtgtggagggaggatagagggtcttacctaagcagggttcattgctggcagtgcctgtcttgctgtgcttgggaagaatctctgcacccacagtcttgctagtcttaaataagcaaactctagttaacattattatttttctttttcatcttcagctgggttttttcctcatttctgtggttttggccatgaggcagcagttgtctcatatgtacctcagatacacttaatgcctagtcagaggctgacaaggtga

SEQ ID NO: 124060 - DNA, 1030 bp, Homo sapiens
ttctgagctgtgtccctcagctgttgtggtgtgaacactgagggcaggaacttgaagccctgtctctactaaaaatacaaaaattaattgggcatggtggtgggcacctgtaatcccagctactcgggaggctgaggtgggagaatcacttgaacccaggaggcggaggttgcagtgagctgagatcgcaccactgcactccagcctgggtgacagagcgagactgtatcaaaaaaaaaaaaaaaaaaaaagaatgcctggtgttgcatctgatacctggtgttgctccagtatttgccaagggaatgttgatgttgataagtgtatataagtctatttaataataaactgttctataaaattgcatctgataaactttttaacatctttttcttttcagtaatttttggctgatttttactgatgaaaatgagaaagtgaaagagcaccttaatcggggttttaaagttataaaagcctatcttgggattttattgacagtcccttatgaagtcatttgataatttccattgagtgtttcttctagttttggttttctgttctgttatttcctaaccagttttcttttgcaagattaggcaatacaaatcaggaggtaattattgttttaccttgaaattctttatcttctcagcttgcctttttttttttttttctttttttccttttggagatgaagtctcgctctgtcacccaggctggagtgcaatggcacgatctcggctcactgcaacttccgcctcttgggttcaagccattctcctgcctcagcctcccgaataactgggactacaggcgcacgctgccatgtccggctaattttttgtattttttagtagagacaaggtttcactatgttgcccaggctggtgtcgaactcctgagctcaggcagtccacctgccttggcctcccaaagtgctaggattacaggcatgagccactgtgcctggcccaggttgccattttataaattgtagctgttttcttattctttattcattatttta

SEQ ID NO: 124061 - DNA, 1023 bp, Homo sapiens
tctgagattttagtgtacttatcaccctaaaagtacatttttatatgtgtatttgtgtgtgaatgtggtttttatatgtatgaatgtatttactgatcatagagttgtttactaatgtaagcatttattcttaacctggtgtttttttttcaagcttatgatgtctttcggtagctgttaatttagagtagtctttggaaattgcttgctagagcttttcaaacacaccaagaggctaatatttcctctgttgagtgaaagtatgaattgggtaagctgtacacagtgattccttggcagatgttcctaaattacatgcatctttttgagaaagttttgcacagttgactgccagtcagcgggccatcctgaccaacctgagtctgcctgatgatttcccatgctgctgttctagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccaggtgagaaaactggtcacaccagcacacattattaatgtgcatttttagcttcaaatctttgtactttctaatgcatcttcaagtagtcttctgttggctgacttaacatttttagccatttatttttttaaaagtaactctcataacatttatttctcttaaattattaaaacttaaggttgtaaaatatgtatatgtttacataaaaatggttcacatggacaaagatgagtattcagaaaccaaatttagtgtatggacaattttaaattattttaatccctaaaatttttttttccaagataactttagtaaaatagttactctaccaacaatgacaaattggtatttacctagggcagatttcataaaggggtgggtgtgtgtgtgtgtgtgtgtgtgtgtgtgtgtgtgtgtgtgtggctgttgtttctgatgca

SEQ ID NO: 124062 - DNA, 1049 bp, Homo sapiens
gccttcaggtaattcacacagtgggagggaatcacagtgccatgtgacaagtgactctgcctctagtcccgacttctcctgagccctgtgcctgtgggatagcttaacttgttccacaaatgtctgaagttcaggtctggtgccactattttaagggtgacctaagggttggtggcaggcctgaatgcaaggccagggtcttccctgcaccaaagccatgttctttcactaagtcatgatgtcgttttaggttttcattattatgcattgctcacagtcagcatgctgaatgaaattgatctattttccatttatgagaaaataatattcatacataatgatttgttatgaatggataagtactgtatttcccctgggcacattgtcagccaagcattatatactcaatgctgaggttctgctgggtgtggttaggagtttttttgagatgtggtcatgagctcagcattgtcttttggagaaatggggagaaatacattatttcgttctttgctttggatttgaatgtgttctttaaacagaagaaatcagcccagtggggtggtagccctctgtatgattaactcactgttgctgtcctgctgcttggtgactcacctgttgtcctgtggtttcccttaacagtctgcattggtttctaaaacactgactggggcactagtatagtcttgtcctcacaaaagctgatgggtgaagtgtaccttttcttcctttgaaacgtgtctcactgaagttcaccctctgcgtctcttctcctccttccctattccgcgtgttctgcatggtctctctcctgctgatgctgccttcacctgggtcctggcatgtgtcttaaccccagggagaaggaatcactttgcctactacaactatcacacttacgaaggtaatgctatgcttactactacttttataactaaagcactaatagaacctcatgggcagaatagtgttgaatgaccaaatatcttatgtatcagttttttagttgatataaataacctattttaagaaatttaatgtactgt

SEQ ID NO: 124063 - DNA, 2132 bp, Homo sapiens
ttttggcaacggttttatatgttactccctgtgagataactgtccttctaatttggagagggaatggactactgcactctccctttcctccccagctcaaaccaaacatccctttatccactgaatcctgtggccaccatttaggttcttcaaaatctgtaacagctttaactatggtttcctattattactgtgaagtaataagagagcctgggaaggatgtttatctctctatctgttgacaaatttctattaccatggtgaggtgaggagaagggagagactgagaaagcagcttctgtctctccctttctctgttttgaaatctgttgatgtagaaaggtgtgtgatagctctttattgtctcataagagacctttcagaagcattcagaattcggaagaatatgaatgtgaatttttctttcatctctaaacacatttttcatgttctgtttttaactttgcgttgaaatgttcttgtttcacacatgattacttatttactgcttttgctttctttataatttatttgtgtcatttctctgtgactatattgcattcagttttctttatttttatataagtattcactgctgacacatcaagtctttattgattgctaactatggaccgtatgtggagtgatcagtgccagggtaaaaatttttttttttttgtaaacctagccaccagggagctcagagatgagggagataagtagatggaaatcatcatacgatacggttagtggtacaattaatgtaacagatggggtgctctgggagtagataagggggacacatttcttaactaggggggttcattagaactgcctttggtggttaaaacacacaaaatagtaaacattactggaggatttggactcagcaggtctagaagggagctacctatgtccaggaaaagccccagatgattttgatgtcttgttcagatcaggactttagagcagttagagttgaaaataaatgtttcaacacgatgtgaagcagcacagatgatgaacaatttcttaatgggtgttaggcattagtgtctctcaggtacttcagtctcatcttacctttactcgatgtcacagatttctgaagtatttcagaaatagaaaattttgtcattagaatgtaactttgtgtaccctaaaattaacatcagttctaacaggacttgcatttttatggtgtcttttgtctgtgagagtttagcggtaccactgctgagagattttagcagtctcaaactctgtgcacgctcatactccaaactgtttaacgtgtgaaactctcaaagcttacgttcctaattgcagtgactagagattttaacaggtaatggaatcagcgggtttgaaagttataaggcactcataaagcagatcttggcgactcttactggtttggccttttcctaagctttggtgggtggtgtgcttgccacactagactgactgccatggctatggtgcaggtgctaagctctgcagttacatcatcattcatgggttctggaaggcacattttctcatatgtcaactctgaaatcagaatacctcatttttagttaaggtaatgaagtgacattgtcctcatctgggatacagtaggtgaagagtgagaaaacatgtctaggtgtattgggactagagggcttcggcagagcagcttcctcctcctcctcaccccttccctgtcatggaaacacatgctcatataaattaaacattccaacagttcataaaggtataaaatgacaaaaaaaaaaaagccaaaaaacccagtcttccttttactccagttctactccagggagctaaccacttttaacagtaattcttgatcagtaatggacagcagaattacttggggtgatttttcagaggacacatgcttaggcctcatccccaaggattttcatccaggtctggggagcgctatgagaactgcacatttaaaaacctccgtcagtgatttagctgtgccctcaacctgtattgtgttgtgtgccataagggcagcaagaatactgcaggaaagatctggtccgaagggaaggcctgtgtgtctttgatgagcttcatattgctactacagttgctcctcagaatcattaaca

SEQ ID NO: 124064 - DNA, 1010 bp, Homo sapiens
taataagaatgtggtggaattaatgctagtgttagcactttgtgttaatcagaaactgatacgtttatttcttattttgaattttctgtatccagtttgttaaattgtgttacataagtttggagaattttttgaaaagaaatcctgagaaatgagaactgtagtgcctgagataaccttttgtttgttggaaataacatgacagtaatattagactttgcaaatagagctgtcttccttctcttctcacagatggttctgactctagagataagccaaagctttaccgccttcagttaagtgttactgaagttgggacagaaaagttggatgacaactctatccaggtacgtagtctgagcttcctgctgcaactctgacattccaggaggcataacgtattgtacagagcctgccacatggtaatgaaagaaggaattataattaccgacttgtatttaaatataaataatttatctactctgggtcacttttctctgctttagtgtggaaacagcagaatgtgagtttatgttcaagttccacctctagaaatttgggctggtgatgacattgctctgaaactgcttccttttctctaaaagatggtgatgatacttttataggtctatttcaggattacaggatataacctatgcagaagtgcttatcactggaggtctgaccacatagcattaggcattcggtaaattctaattaaatttagcttaatatggttctcaagtacttaaaacagagcttaacacattatttgaataaatgaagtcagaatttgtcacttctttgaagttgaattcaggcgaatcacccttgctctgtacttagttctcaatttgtaagatgatgggttcagattgttaatatcattttcaattctaccatttcttctttcttagcacaacactaaaaataataataggaatctttaatgctaatgatctgtttagatttgtccattaaccatctaacaaatattggttaagatgact

SEQ ID NO: 124065 - DNA, 1205 bp, Homo sapiens
cttaagtcactgggtactaaaaataaaaggtctgattggtttgacttttttttgacagtttaattatttttatacgattgagggaaatccactttaaaaggcactaaaaatccagagcttattaggttatatttgtcataaaaggggtactcacggttttaacattctgtgtttaaatgctgtgaacttcatgatgggagtttctttggtttccttcggtttccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctgggtaaatagattaaccctaagatttaaaatgttttgattatacttaaagtagttcagattattcatagatatcttggctttttatttttgtttcaatttttaaaaaaatatcaaagtgaagtttgtgattttggttcctattgttaacttgggttggttttagaggaaagaagaaaggtcttgactttgtcttaaaattggaatttctcactggttttaaattgtttatatttaaactttgttttttagccagtatactaaaacagtaccttttcttttgtgaaaaaaacatggtgttctttgtaattattcagtgtaactaagattataaaattttttgaagtattcttttctgtgactgataatgaaacacattaagatctcttaaggaattcagaatattttagctccacctagtgcttttctgaagacttgcattgtgggcttagtaagggaaaacagaaagcctttcttaatgactatctagtaaaatttttttgtaggtagggaatatgacttctcctttggttttactttttaaaacatcctgttaagccacttcattgtctatttttcatgctgcttaaaacaactgaaaactcccctagattgtaggctttcttcctgaagcacagacatgaacccgcgtggtcttccctgcttggcctttcccattgttttgttctacggcatgcctttgattagccacccagacct

SEQ ID NO: 124066 - DNA, 1120 bp, Homo sapiens
ggaaatttgttgttctaggatgataattgtaagtggaatcaagaaggctttgattctactcacatactacccacaagaggaagttaggggtggacactgctgtgtgcagctttggtaggtggcagagaagctggcctgctgtcattgttactcctgttgtcagagccgatagctggactgaatctcccactcaaactgatgggagccagcagggcatttccatgtttttgtgaatatcttggtgatagattatgagtatttaatttcagaatattggtaatatattgcagaaagttgtgtgcagaaaattgacaattatttggcctttagtaaaaacttttactctttcaaaagttactattttaaagcatggtattattttgcattacaaaatggttttattttcttagtggtgagatagaggagaaatttgtacctgctcttctaatctgaaaagttgttttcaacttttacattacttccttgtttctttctattggttgagtgtaaataaaagtttcccattaccatgctgctttgaaattagaccatatattaatatttttcaagtattataacgggacatttcattctttttaaattatgttttgcagaaatccaggaaatttaaatactaattcatccttgttggtttccaggtgtttttagggcttttttttgtggaggtggggagggcactctccaatgagctgggaccagtgagttgcattcacccttcatttgtgctgaagaatgtagtcggtcccagcttgttagactcttcaatcttcataatgagattttgcttatgagttaggttttcaaagtgacatatttagaaattttgatattttgagatatttgaagaatcagtttaaactaggataatttttgatttgcatgctaacattatcaaaaatgtcccactttttaatttgtagcctaagtagtgatactcatgtgctttacaaaaataatcagattgactttcaaataggagagaagctcaccgctgttcctcatgtgtcactttccctgtgtccataaatagggccgccggcacttcaaccttgtacacctcatttatatgccatttgctgcctggatagacttacataat

SEQ ID NO: 124067 - DNA, 1084 bp, Homo sapiens
aaactcctatgatcctggagtgttctcatcagcatcaaaacacgttacagtgtcttctcttttagaaaactctttatacccctccagttttgaccccatttttctactcctgtttgctacacagcttcttggggaaaaaaaaatcatctatgcttgctccctccacttccaaactctatgttctttcctctgctcctgttcattcttgcccctccctccacagggactgtctgtcagggggactgatgacctcccaggtcccaaatctggcacgcattttgtcctgtcttacttgttgcaggagtttttagccaggccacaaccacgtacttgatgcactttcttctgttggcttctagggtatattaccctcctataaaccacctagtagtggtttctccttggtttgatttgttggtacctcttcctcttatgcttcactcctaaagtttggagggccagggtttcagatgtagggcaccaatctgttttcttcctgcatctttcctaggtgagcttaccctgttgcctgagtttaaataccatctaatgttaattatccactaatgtgtacctttggttctgacctctccagacgcatatctctctctcttttttttttttcttcctgagacagagtctgctctctctcccagtttggagtgcagtggcatgatctcggctcactgcaaccactgcctcccaggttcaagtcattctcctgcctctgcctcctgcgtagcggagattacaggcacctgccaccatgcttggctaatttttgtattttttagtagagatcgtgtttcgccatgttgcccaggctggtcttgaactcctgagctcaggcagtctgcctgcctcggcttcccaaaatgctaggattacaggtgtaagccactgcacccagccccgattcatatctctaaaggtttacttgacatatccacttgcatatcctgtacatatttcaaattaaatctagctaaaagaagactagattttctttcttaacaaactttccctgatccttccccaccttagaagacaatactaccatctgcagcgttgctccaatagaaac

SEQ ID NO: 124068 - DNA, 1892 bp, Homo sapiens
ttaacgtgtcaccttaatcagaatcctatttccttgtgacctctagaattatttaaatgttgcagagtaatatctttgcattaaacatggtggataaataacagatactgactagtggaaccagcagcatgatttggtgctgaacacctctaccccagagctctgcgggaactcagacagaaatacagaaagactgcatgacttctatggcattctcattatcagcagtgaaactggcagcattccccctttggggcttttcagatagatttttgaagaggccattgtgtttccttcaaagatccagtcagtgaggcagttagatgaggcaggcgacttgcccagggtcacctatcagttcagttgcaggtgacgaagacacagttcttcagtttcccaacttccagcagagggcactggatattgcaggattttaatatcattcatcaccagttatacatgtgtagactcataagggaatcccaggttttaactttatttttattgtggatttttggttctaatgcaagatttttattggctatgtgaatcttattacatgtgataataaatagtttactttccgtgtttgtacttgtttttgttggtggattatggagtaggatgttcagaatggtaaattggtattgtaaggaatacctctatgtatttctaaggtgtgactgagaagtatgaatcatagttcttagctcataaatatttgagtaaatgaattcgcacgagggagtggattgattaggataatgcttttaatatatgcaaaattagtgattaatatagtgtcaaaatagtaatatggttaattgtatgtcaggaattattttttaccataaacacataatttaattttacaaggtaagattagtttgcagagttattaaaggctttattttaattataaactatgttgttttgttgctattactacaatgatgagaacagatgagcctttctgctccattctttgtttttcacatgggcagtgttataataagcactacttaatttaactgatgcagtcatgaaaaatttaaacgtgtttaaaatgctaatattagtgaaggaaaaaacccttttgaatggaggggacgacttttaattgtcactaaatttttttttcttttatcaatgacaatgtaaacacttttttaccagatttgttaaaatataattggtaaagtttactcaggttcactttatgagatatataactgcctagctacaattttagttgtctgtaaatatgggaatgtaagggagatgtgttaaaataattgatcatttaaattacattgtttatagaggcatttttcttttccttaattgttgagttaaatcattagatcataaactaaataatcaactctgaaacatataatttgataaaaagaagatttgggttgtatttattattagtaaaatatttggttatatttttattattttgtataaatatattcatttctctttattcattttttggtgcatggagaaggtgaggatggagggaagagaatggtttgctgttgaaaaaaaaattagttagccagtctgtaaactattataaatctgtaatcatcataagttattcctttttatttttgaaggaaagttttttattatctatattaacttatttaatgagtggaccagcaattccaaatacttaattctggccgtacagtaccagttgtctaagattaacagacacattgctgctgaaatgactgttgttgaagtcactaatgagtatttctcattccaatatcaagataactgtgttgactttccatttcaccaaataagatttatttgagtaagtattagtctcagtttaagtcaatatttaactcagtagagatgttcatcac

SEQ ID NO: 124069 - DNA, 4729 bp, Homo sapiens
gacagttccttatttgtgtagtgtcaggctaaatggtggaagggacctggaatttatgtgaccgtaagaagaaatgtgagtgagtagaacatctctttataaggcatgcgtcactgtaagcattggaaaatgatgatagtaatggctgaaggagacttgccgtggtcagcttgtctaaccctgtgtcagcagagaaagacaaagtccaggtcttaggaagcttttccctttcagtataagaactccgtttcaagcttggcatggttagtttttctttgtgtcacttagtactttgttttcagtgttacctgagccatagctgtagcagatgcaagacagaccgatccctgtactagacatgaagtgttcattaataatccagaatcacgtcagatctgctgtcatggcggcggcatatacttcaaggaactaaccttcttagaggagtcgtgataagatcactcccaatgcattatttgattaggctacatctgaaaacaagggatattttattattttacgttggaaagattagtatatagatttaaaaagtagttgcagaaatctacacaggttgtcagtaatattgttagccatgtgaccttattttaagtgatgtcagctttcttcttttagaacacaggatgcttctgggcctgagctgatactacctgcaagcattgaattcagggaaagttgtgagtaatttcagatttcattgtcaatgaattatttcttgatccattttactccatctgattttcacattcgtttttattcttttttccttttttctttgtttttgaaatctttccacagctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggtacgttccagccggccagccatgctcctccagtgattgtggttgtaattgctaagccagtgaattcagcttctttaaggcttctcatttggttacaagatttttttctaaaataaaagttatgtaaatattgtaggaaaatgtataactttaaagagttgaaaggaaatgcaagcttttttctattttgttttccctgtaaaacttcagcataagtgaagttaacttgtagtaatagttgtgagaaagtgctgagactgttgtgggcttttgtagaattttttctgtaaataatttgttgagatgaagttcatataatattaaccattttgaagtgaacaattcagtcgcatttggtgcattcacagtgttgtgcagccaccacccctgtcggttccaaaacgtctccatcacctcagagcgatacccctcaagtagttcctggggtttttctcttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtagaatggtttgactcctttacgtactttctgtcccgatctacagttgataaaattttcatagcagtttttcatctacagatgatttgaagatttaatctttaaagttcttaaaagtaaatgtacagattttttcagtttttctgaatcacttgtcaatgttgttatttaacttaataaaactctagttatataatgttaataacatagatagattggttgcttttctcctggcaggatcatttgagggaaactaagatcttttagttccttcagaattgttttcaaaggccagaatttttcaagaaatgtttcttttatatttgagtgattagcatgagtttgatagggttatgcttcttttacccaagttaggaaataggtaaaaaagaaagtcattttatttggataccgttttgttactttcatgtcattattttataaacaaacatggatttccttttcagttgtcattcaaagccattgtctgtcttctatcatgtttggacttactaagcctgtttcgagttgtgagacacctatcataaaactacccttgatagccttttccttattgatgtgaactagtcagtgaaatcaccattatcaaacaagtcttttaaacttcagatttagggttagtatccagtggggggaatcttaaagtagtggaaaagaactgtggtagtgaataatttaaattctattttcaaaaaacaaagaatttgctccctttagtataggtgtaagttatttatacacttttaaattctcatcttctcagcttttattttgattgtttcttggtctttcctgtctcttccattcctattaattaatctagagggatggactttcaccttattaggtaccttttaagtaagtagtaagcacaccatatcactgaaagatgttcgttcacaagtccttccattgtaaatcttttaaagagatcagtgtgttcatgtgtgtttatggtaacatcatatttattgataaactctaaaaatacagttagttattgtgccagtggtaagaacataaaactaatcctttaggtcgtatacttctaaaggtgcttcagaaccataaatgaaaatgttattttgggaataacataactaaatgtcgtaccttcatgtcgtaccttcatattagtgttttgatttttttaaactatcatgattgtttacaagtttctttctctcgttctgcttgatttcccctcgtctgtttttctccaggaagtagaccaggttgaccaggtaggacatctgctgggagctgatcctagctgtgttgcttagccaagtttctcatgctgctcccatgtcaaataagtaatacaacagctggactgaacagctcataacactcattcagcaactgagacatgcagtactaaaaccctttttgactgtgcaacctttatcggcatttcataatttctgcttaatgcacttcagtgtggatatgaaatgacaaaagttctgtttcttctctttattatttatccttggttcctattctttggatctcatctgaggttgcctggcctgcacatgtggtcgggagaggatgtgatagatcagtacttgatactgagttgcatggtgtccaagccagtgactacaagtatcagggtggctgtgggtaaccatggatacatgtatgtatactgcacagactaccagataatgcacggtctacaatttggtgttatattatttgatatctccatttctccgctgattccatctataaattgtagctaactgaatccatatgtctatgtgcatgaatcctaagaaatagttgcagtggttatttacttcccattgctatgtatgcacccaaattattttgcaaatatctggtatctgtggtaaataccttggtgaaatgggaaggtactggtctatcttcagcagcttttcaagagcattcctttatatttttattacttttgtttattctctgttgcttatggaagtgtgttctgtctacagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaagtaaggaacacatttttgaaggcggcactactctaaataattaagtcatttgttttcttattcagttttccaaactaattttaagatttatatttaccttgattgaaggtgaatataaagaagcatacatttttgcaaaatgtattaactacctatagttatatccttaatatagttatactgaattcagtgagctatgtttcaagattccacattttttttttaatggaaaatattttttaagagtccagattgtttcccatgtgataacatgtctgacaatagctgtctgtcatgctaagattacttaaattgtctatgtattttcagatacttggttcactgtcttcaatcagaacttaataattacatgccagcctttctagatgaccctgaagagaacagtctgcaacgaccaaaaataggttaggatgttttctgactgtctccctctatcccgcttccttcacgtttagcatcattttaatgcttagcgtaggtaagtggaggtgtttttaaaataaatgggatgtccttttgggtttggcaatctttaataaattttaacgattatttgttttgtttacagatagttctcattttggtgtgtcatgctggccatactctttaaaaagtctcttaaggccaaactaatgatgttaagtgtaattagttaataactatatgtagtttaagatcatgtcactgtttcctcttggaatgaagttgatatttttaaagtaattaaacggcacttactaccataggtaccattatctaaatctgctgcacattcaaaggcttcttcctggatgacattttgctcctcttgtcctctcaccctgtctgggcagatgatgtgctgcacacgctcacagga

SEQ ID NO: 124070 - DNA, 1048 bp, Homo sapiens
ttacgtataatttttttctccatttttaaacctttttttaaaagagatttagtatagaggctagacagctggttatgaaaagtcaggacgatgaaactattcatacaccagtaattggtcatctgaatggtcaagtaaatgtttagctttggaagagagtttttaaaatgctttacgaacataaatctaattatacatgcacgtcataaaattaagagggcatctaaaaagatgccctttacaagataatgcttttagttctatttaatgtatatagttactgtaaatggaagtctgtttcctgaaatcattctgcatttcaaagttaaattagcaagttatatttttataaatattacataaaggataatatttttgaaataactttacaagtgtgatattttatgtcctttattcttttacataggcaacgactttgcttaccatggataagtatgcacctgatgacattccaaatataaacagcacctgctttaagttaaattcattacaacttcaagccttattacagaactatcactgtgcacctgatgagccttttatcccaacggtgagtggatgttgccacattaccacacagtgcgggacatgtttgcatggggacatttggatgaaaaaacaaaaggaaatcctatttaatacgttaacttatttattctcatcttacaagatcattttcgtgttgctgtccaagagttcaatgaaaaaacagaaactatactcctaagtagaaagggattttattcaggaaattaggttcttgggaagtcatcagaaggactagaggagaggaggttaggaggctgcccaggactgttgggttccagtgtacgtagccacaactgagtgtagagggtgggtacctctgtcacagatcaccctcttacagcctagctgaaatgagaggcttgtcccttctcatccagaatggagccaggagttttggtatgcctgcctctcagtaggagaaacagagggtgagaaatagtatctaccactgttagctatttataaagagaaatactgt

SEQ ID NO: 124071 - DNA, 1430 bp, Homo sapiens
tccaaactggcaaaaatactgggtagatatttgattccggtcttttatattttacattgtgtgggcttttccctatatcattaaacattctatacaaatatagttattaacagctgaaaattaaagaattgtgtgaggaaaaaaatgattagaaaagaaacttcttgtgattgaacaatttctttttatttaaagctacacgttacttaaaattagtaattaaaatcttggttcatctataaaatgtgtgcggcccagagttgctggctttagaaaactgatgatgggggtactcctgggacctgtgctccctccgtaaccctgcgtctgtctgtgtgtgtgtgtgtgtctgtgagataagctgtgctgcagtgagcagacagcctttgaatagttgttggtcacatgcaccaggcagtgagcatctctttttaattttgcgtttgttttccaaacaggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggtaaattagtctaaatgcctgagtctgagctacgccccaggttgaagcgagcattttattcattgtccatctcatagggtagtccacttgtgtgggagtgcaccctcgtgctgtctggagaagtccgtgttccactgacttggagaaatatttcatggtgatgtaaggtcagaagtgtcgagacacagagcccttgggcatgttttgtgaccctgtagtgagcatctgctctgcgcacttgatgtcatggttacattttctgcctgggctgataacaaggaaccgtttattgttctcccttcttggtattttatgagcgtagtaggttgattcattcctttagcactaaattgtaaactttgttgataccagcatagcagttaagagcaacacaagctttggaagcagactgcctgcattctaaacccacctctgtcacctacaggctgtgctgccattggcaggtgactttggcacctcagtttcttttcagtgaaatgggcatgttgatagtacccagctaagagattcttgggaggactgaatggtttcctgtggagcatgcagaactctagcacagagcgagtgggtgtgagtgctgctgctgctgtggccagcactgccaagctggcttgcgcctgtgtgctggcaagacccaaactccagcatgttgtgtgcttttctgtgtgaagggcttatagccctgaaaggttcgaatacaactgatttcctggattttattatgtcacttttactacattttcttgtgatct

SEQ ID NO: 124072 - DNA, 1071 bp, Homo sapiens
gagtaatgaggaggactcctagaattgttatacaagttacccagtaatttgaatgtaagtagttgaaccgagagtctgacgtgctggcagacaccccatgctcgtattgttttctggctccttccctcttttctttccctttgctaagtaggtattctgaatgttattaaggatctcttagtgtagtggagtaaacggttctgcaaggaagtaatgacaaggctatttggtaatttcttataggagtaagaaaaaagttcttttggaacacagaggagtgggaggccaattttactttactgcttggtgctgaaatgctcttggaccaaaacaaatggataattttaaatgtctggtaattcagtttgcagaggggattaaaggtgtagagtaagaagaatcaataccgtgtgttggatattaagcaattggtaattaatcttgcttcctttatcttgacaagatgtgctttttcacttacaatttgcttgtttcctccttaggattttgcaggttaattcctcacacacgttcaccaggtacttggacaatatattttgaaggtgcagattatgaaagtcaccttctgcgtgagaacacagagctggcaagtattttgagggtaccatgaagtgaaatggatccttaggacttgaagatgtgatgcagatttgtttctttcttacactgaagattggtgtgatggcagagttttaaaatcgctgttaaatactgatattcagaaattttcaagccataattcatatatatgtattttttcctcccaagccatgtctattacagttttgtctgtaagcagtggtgctttttaaaataaagaacacttatacccatggttgtaccagtcttaatacatattttaaaacatattaatatgataaccttaaaatattttcttaaaattctttggcagaaatatttcattcttttatagtcagttctgccttgtcttaaatatatatcaagccatttagtaatattttatatctttttgaaagagtggtaaatcccaaaatttcccagtttcatacatgttaagaacaattctac

SEQ ID NO: 124073 - DNA, 1110 bp, Homo sapiens
ctctgggtgttgctgcatgagtcctgcagcggccctggtgctgtgatttaaaataaaatgactgctgggttttcgcaagagacaaagacgttaggtcatctttgttataaccattttttgcagtcctccccgtggatagtgtaaaataagtttacatttcttctttgaaaacacaaaaagactggtaatttattttgaaaggtaataaagtgaaaattgaattttttccttacgatcaggctttctacctgatagtaatgggagtttaattttgtttcataaactaagttcttcaaatcaatttaaatagcatttgtgactaaattcatctttaagacttgagtcaagaatatcgatttagtttaccagattaatacctgaagagtatctatattaattgaaattttttttactgtttatcttctcatcctttttctttccccatttgctccagtgaacatgattgactagatcatgagttgtctaaccatacagaagcacttccatttcagtcataaaataaacctttgttttcatcctttaggctcagcctctgaggaaagaacctgaaataatcactgtgaccctaaaaaagcagaatggaatgggccttagcattgttgcagcaaaggtaggccaattagtcacgtgcgagttgttctctccagtctttcggcattgaatcagtggttgtcagagtggatcgtgtgggagtactttaccacctgtgtataacgtgcctgttcagttctgtttctgcgtaggagaggaatggtgttacatgaatgaagccagtgtgctcactgggcccaattagttgagggatgatctcctactctgagaatgtagctagagtgatactttgagattgagcagatggtgctcagaaggaaacaatttaaaggcatagtcaaaacttgattcgcacagtgaggagagaaagcattgctacagtagaaaactgcatcgtgggagtggggcacagggctgtcacctcatcatagtgggccactggactcctttctcagactccagtgcacataaaaaccgctaaggactttgctacacaaggagatttctggttctcatttccaggtgccttccagtaag

SEQ ID NO: 124074 - DNA, 1050 bp, Homo sapiens
ccccgtgaaggcgggcatcttctcttgtccactattgaaaggttgacagtttctggttatggtaggtactgatacatatttgttgaatggcagtttttggattggcttatgagttgcagtagtggatgaaagagggaagtatgatgaatctcaagaagatgaatcttgattctgtcttgagcagctggacatatggaggtgtgatttacaaaggcagggaaactgaagggggcaggcatggtggcatcaggagttcagctttgaacatgtcacactggagatgtgggatgcctgttcaggtgagtgaatagattatctagtagatagttggatagtgaagctcagaaggttagagctagagataaaatttggatgtcagcatatagatgctctgaaggaaataaagaaaatggcctgttaattggacagtgtaacattttcagaaatgaagcatctgttaatgccttttcttgaaatgagagaaatgaatctagcagttccctggcatactggattactaaatacagtccattttttttccagtttacttgtaatttctggtacttggaaagtcatctaatacatacacactgccgagataacactgtatagttgataggtatgtgggtctgcttacatcattataatagagtggaggtatttttgagatttcaggggtgtattctgagtgcagggtagggcagtatacagggggatttcaccgttagccctgccctgcgtcttactgagcgtgttggtgtggcagcatcacataggattctgtttatgcctgggcttttcagtcacgctgctgctgtgcatattctgctcctgccactggcagccttggagcacggagcccatggcaccccctctcaaagcctcagtttccttgcctttaatatagtagtaatagttatagttacctcagctcttcagagagagaagctgtgtcaggcatgttgagcctggtattggataatcacctgctgtttgtattcttgttagtctcatgagtgtgtggtatatgttttttctgcagaggaacct

SEQ ID NO: 124075 - DNA, 1049 bp, Homo sapiens
tagcatccagcgcagaatgtggtgatcccggtcttgaaaaaccagctgtcttggttgctgttgaaaactgagagaagtagacggttgattttcagttcatgaagttgttgtggtcccggaaatgaaaatgtggttctctgttgttggaagaacacagtcagtggtgagtttcttcagggggcagttgccggtgttctcgtgctcactgtggtcttgaaggaatgctttttctttcagtgtaacttgtttaaacctgtcaataattaacttgctcatgaagcaacaaccgtttaatgtagcttgtaattacacactctttttttgtttttgctacttttgtgctgcaaattcttaagcttcataaaaacataagccttctgtatgcttcttatttaagaaaacagccatgatatttcatcctgctgggtataatatggtgaaggttgctttaaatatgataactgccgctatgtaacttgctgaagacatggacaagaatatctatgatgtaacctgtatttggccccattaggtggttttaactacagcctttctctaagacctgttttttctaaaagtgaacataaaaatgacacttttaaaagtacttaggatattttactattttatttaaaaataaatggttaattaatgccttaagtatgttcaagtttatgcttttagacaatgtactgatttaaagttttaaaatcttaaaatcttagcttaaaacataagattcctatgccctaaaaatgagatggtaaagactgtttattaacatgccttctcactgtttagagagtcagtttctcgcataaactgtaatttagtcctttgaagactttgagaccttctcttgtgttctttaatggtctaattatgaccatgtgggaaacacctagtcaaacaaatgaagtcaggaaattccgggttcctttttagtcagttccaaagacctattgtgcttacatttcttccacggagatgccagaaacatctttccactaagttgtatgaagtgacactgcccctcatggcttcttatg

SEQ ID NO: 124076 - DNA, 1068 bp, Homo sapiens
gtgtagagagaacatcaaccaagtcatgaacatgagtcagatagaatgggaagaggtgaggggcgatttgggtggagaatgacgagagaggttcatggagctgtgaataacttatgcaggaagctgctgtgaatttttacagcagctggcagttacaagagtctggtcagcatagtgtgagctgagctgtgcttcaggaaatgtgattggatttagagagaccagaagatcagtcatgaggagagcttcctcattttgccagaatttgtctgaaatttataatgtaaacttcaacctatttaaagatagggagtgcagtcaaaatatcagtagtacatgatcagttttgcttcaggatttaaatttaggcattaaattttctattgcatatagtatgataaattacctaccttaaaatggtagaggatttcgggttctttaaatgccatgtgctgttcatgtggagtccacatgttcagcttgcacgttggctgtctgcttgtatagggtggctaggaaggaaaagagcctagtggttgccctcaggtatgtgattactgctctgaatgaaggagttgaaacatggagtaacaggtgccacaaaactgaagtttattgtgaaactggaacaaagacatcttccaaaaatgaaaattgggagtggcagaagagctgactggcaggcagcaccaactgtgtgtgcaggggcttgggttttagggagaaatgaaacagtcctgttttcatttctgatatcattctattttatgattttaaaaagggagttttgttattacagtttgtctaagtaactgtcatttttttggtctgtattaattgtgatcatgtaaaacataccagaaatggaggaaggaggcttgatttattgttctaaaatatatatttggtatttccttgtttataatagtgtcactaaaaatgctgtattactaatattattgctaaacatttttcttgtcagagatgataataattggttatcttagtaaagggatgatttttattctttacaaggtcagtattacattaaccggaagataatgccat

SEQ ID NO: 124077 - DNA, 1816 bp, Homo sapiens
tacatgagttataatactgattattttctgtatgattttctcttactaagttcctctgtttgccacaagaagtttttttatcatttaaaatcttaaactatacgtatgaaaagaacaagggtataagggaggatataggtaaatggtgaaatgtaaaaatactgtactaggttgctttttgtattaaaatgattgatagtatatatcatgcaggtagtttttagtttgcttacacttgtggctgttcagaactattcttaaattaacttcaggattccaagtctctattttactctcatcattaactgatgcatgaataactgatttttcatacttgtaattttcatgtaaaaatgagaaccaggactttgttgcagttatctgtgtacatgttgggtggttttatttttgttttactttcctgcatagtgcatttcttacaatatatcttcaatgcagtgttttcgccttgtttttgcaatagggtgctggtcaagataaactaggaatctatgtgaagtcggttgtgaaaggaggtgctgcagatgtggtcagtatcattttgaaagaagtacattttcagtgtgtcatatattcagcaaatgatgtgagagattctgctgatacttctagttatgtagcactatagtgcttgttggaagaacaaatagagtatctactcatcattaccttttcttcctcccgctctctttgctctctacccctaatccatgcacacacctgtggatttgcctaggatggacgtctagctgcaggtgatcagctcctcagtgtggatggacgaagtctggttggactctctcaggaaaggtatcattgatttatttgcttgaagcatagtattagcatttttaggtgatttttgcattaaatgttgaaattggaagataaaaactatgctaaaacgtgctcatattactctttaccttttatagtgtacgtgacatttcacttgttatcaaattataaatatatattttaatctagtacagtttctttgaaacttgaaagaaacatactcaacacttctttaaatttctgaatattatcttactattcttaaaatgataacaggagatgtgtttgcctattttcatagtcagttttcaaaggagaaaatgggtagtgagtaagctgtctggaagtcagaaccattactcaaaataatagatgaagctgtgtaacatgattttccattgctataatcacagcgattcatgacagagcaggcactgcgttttagtctttcttacatgtgtaatcttcttctcctagggcggcagaactcatgacaagaacaagctctgtggtgacactggaagtagcaaagcagggtgccatctaccacggtctggccacccttctcaatcagccatcccccatgatgcagagaagtaaggaccagtagggaaacaacagtgttttacagtcatggcctctttgaatggtcacaaaacccccatggaggaggtactggtgttactatcgccccagttttaaagagaaagaaattgaggatgagagcgcttcagcatagtgcctgggattcccatgtgaaccttctgaccttggagcccacactgtgagtcaccaggacccctccctgtcaccaggagccatttaacttcacccccacagggctggttgactgctggtgagcttccataggcccggcacatagtaggtgctcagtagagaatgaatgtgacgtgttaaggatgaactgggaaaaaaactaaagaatgaatgaatggattttcagttttgataggcagactcaggatttaaagtgttt

SEQ ID NO: 124078 - DNA, 1627 bp, Homo sapiens
gtgattcatagcacaacttgttaaatgtatacatagacttctaaatatggcctttatggctttctcctccgtaaggcaggattctagaaacctcacaacccagaacctcaagttggtacctaatagtaacaaatcacagccacagccaaggcatcagagaacgtgacttgctgcttcttgaagcaaacacacaccacccaaggggcagctcaacaaaacctcgtgtggtattgtctgccttgctcagcatgttgtttactttttatgtcacgtagaacttaacatcttggttgtctaatttcttagttagtggtcatttaaaagaagcaaactagaatgtgagttagaaatcacagagggaagctgtgaatagtagatgataaaccagggtgagcaagcaaaaaggaggagaactgacagaagcggccgccaggagcggaaggctcacgtcacatgacggctgctcagaacgatgacgctgggcgattaaaagttcagatatttttctacaaagtcagggaaacatatatatctttattgattttttttttaaagatactttaaaaatggttagatttgttgcttaaaatagtgaagtttcagttaatgagaaaataagctttgaaagtgtttatcttcccatcattactaattaagtaaaaatattttctttattctcagtatatttacttaaaagctgttttatgattctgtaggaagaattgacctttatcaccttatttcttatgctaagaacaattcttatggaattttaatgataatcagggtgttgaaaataaaatcttaagagatactgaatatgctttgattccagtttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaagtaagagtgacacttttttgcttcctaagtacacttgtgatcacagtctgaagtgagaggaggcactttgtggtttgttaattattaaaattattctctgcaaacattggctaactaggatatggttttcataagggatatcataagtaacatttctctaacaaaaactaagatggaaaaactttagattcagttgatcccataagcaaatacattaataacatctctatttggggttggtaaattaccaagagaaactaaaatatgttttacatttttttttttttttttgagacggagtctcactctctcgcccaggctggagtgcagtgcagtggcgcgatctcggctaactgcaagctccacctcctgggttcatgccattctcctgccttagcttcccgagtggctgggactatgggcgcccaccaccacgcccggctaattttttgtatttttagtagagacggggtttcaccatgttagccaggatggtctcgatctcctgacctcgtgatctgcccgccttggcctcccaaagtgctgggattacaggcttgagccaccatgcccagccaatattttttacatttttaa

SEQ ID NO: 124079 - DNA, 1945 bp, Homo sapiens
tttaatatactagtcaggtaaatcagttttaaattaataagtctgggcaaaatgaaatgttatttattctcagtatggatcaaacactttttaatgcagtatttaacatatactattttttaaattttaaaacagatcattgaaaatcaagttagtctgtatggttgtaaaaagctcactttttttgttcttcacattttacaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcaggttagaaatcaaagattccacacacttttctcacctctcaaggaggacacactgagttctgagacacaattaatattttctatagaacagcattgttggccttttgtttttcctttaatggttttgtggttaagtttgaggaaaaaaggagacaggatagaatacttaataagaaaaaggattatctgttctctgatgtttgattaacaaaatgttaggaatataaggccttacaatttttaagacaaagttcactgattctagaagtgagaaattagaactcaagtggtgtattttgcactgtatcaggagctatccctgcctgtgggagctcatggtgtggcagggaaatgagacagacacaacagacacagcatggtcagtgctgtgggagaagaggccccagcaggggatggagcttctcagtcttggacgagaacctgggcacagctgtatgcacggaagggccttccaggaggagggaaaggcacagagatgtgtagtagttcagcaggaaccctgggtagaggggaaaggggtggcaagatctaaggcagtgaagataggcggggccagacagaagggcttgacatgacagctaaggaatttgatttttgtccacattagtagacgggtgatgccaatctgagtagttaagctggggaacgttatccaatgtggttttctttttagagagataactgtttgtatggtgaaggattgggagaagaaattaaaggtatgcttaaaaatagttacagtctaggatctgtgacaaatacatgccctggatcgcagacgctctaggaattctgaagattagcattcttagagtggttggaaaagacagaattcagagttgagatggaatttgagctgagccttgaagaatgagaacagtaggcagcggagagaggattgcactgaggagatggacgctgtgatacagatgaggaggagcctgttttctgacggcagaaaatgctcctcaggccacagatgttggctatcaggagatttcatcttggccttttgtctggtgtgctggtccatcctgctgttttcctaggtgggcctgatcacctgcaacggcccagtcttgggagttttggatgcactctgtcaccaaaagctggagttatctgggagaaggtgtctttctccaaatttctctttaaaaattgagtaattttgtgccctagtccttctagtatcttttgttagaacgtaggagaatctgcttcccatatgtcaagacaacccaatttgtagtgcatacattgaatcccatttttatgcacagtatttcctgttgtgtggggctggcattacgtcttcacatttatagtatacagctgctacttgtttctacctcacatggataaacaatacctagaggagagagttgaggaactgagaggcaggccagagtgtggaatgaaaagttatgatggggtttaagcgaggaggtggagagtgcgagccagcagccggggccagtgcaaagtcttaagggagcagagaagtgactcaggtcagcccttccggcagcagg

SEQ ID NO: 124080 - DNA, 1218 bp, Homo sapiens
tagtatttctgtaagtatctttttctgtgaggactaaacttttatttaaaggtctctcagagtttttccaaatgggttaaaacactgaatatttcaaagccttttagtatgaattgcgatatttggaaagtttcttatgaaaatttagtaaaaaatatttgctttttgcttagtagttctgttacaattagtatcttagtctccaaataagaaagctaagggaaattttgctgttttttattttctatgtatcctaatgatgaaactcatttaataccatgtgggcatttttctgtttctgaatactagaagttagtctgtagttctttacctttctcatcaagttgtcgaaacacagatgacgcatgatagtgagaaaatatgccgatggcagattacaggtctaaacctaacttttttttccacacttcatctttctttttttttttctttctctgttacctgcagcagactgctatgccagcaatctctgttctagatttggtatgttcttgtttctttccctttggtacttttttcctgtcttgattttcttttctttcagtggtggctgtttgatgttttcagtagatccagttctccttaggggtgtcctccatcaggagatggagtccctgacactttagaagcatgcctttgaatgttcctagatttagttactctttgcttttctccgttaattttaagtgttactgtttgtttatggttttgaccttttctcggtttcagtcataaattgattccgtgtattcttacgtagtcataaatacatgagcaaatgaaataaattttgtaatgagtaatctatttcatttttttcacattagacatagattttaaatattcagttgttataaactcagctgaaagggtattgacattatttgccagttaagatataactgtctgttggtagagtaagagatttccagtgaacatgtattctatgttttctttaataatataacatggattttaattcagtttatcagccatgccaatttatcagtctgctgaaaaatacttgaggttcatggtctgttgtaaattcaaagtgttcattgtcatattggggaagtttggctcatcgtttagggcccattatgcttgcgtatggtatctttatcacctgctagacaattatactctgatatatttatataaacttgaagacaaattctagtcaacttataaaga

SEQ ID NO: 124081 - DNA, 1064 bp, Homo sapiens
aacttctaataaaatggtcattttacttaaatctgaaaaaagtgtgtgggctgtgctacaggaagggagctagcacttactgaggaccaggtgctacagtggatggtttttcctgtgtcatttaatacattctaccactgtgagagaggacttcagtttcctaatgaggaaatcggtccctaagacatagagtagacttttgcttggtctaaaaaccaggtgttatgtcacttaccagaggtactccgattcaatcattaatttgtaataaatgatcaggtgttttcttcatgtttttgtccctaaaatttttttagggtggacatttttaaagggagggagcataggcagaaaaagtctgtagagtaaaaggctttttaagggctttaacagagtcgtgttttcagtaatttgtcaaaaagtaaagggtattatgaccccattttatgttcagataccagtttcattttcatgatacaaaattataaacacacagatctcaacatatacacacacatatatatgtatataaaacctgaaaatacctgttttggggaatgtggactacccatatagcagaaccttggttcaagcttgctacatactggctttcaaatcccagtgtagttctcgatttagaataactttcagtctgcatggtcttgattcatcgggtaatagttattttttaatctattctgcactctcctcaaagatcacttcctgcaaggctattttggtagcatgtaacttttcattcttttaatcaaagtgctaatctaataggcagtttgccactggattgctgggtgattaaatttgtaatttaagttaaaatatcctttaagtgttactgaatgtgagtaacccatacaattcagtgtactgttttaagctattattttgagtaaattaagagattctcgtttttctcattaatgctttgtgaatggtgggagtaaagcaacatagctttgaagaacaaaacaatttatgttttggagatggaaatacgtgagttagccaaagagtggaaagaaactgccttgatgacattggtgctg

SEQ ID NO: 124082 - DNA, 2123 bp, Homo sapiens
tgtcccacctatgcagaggcgagtgggggcctccctcttctacaagatattcgtagtggaaattaaaaagggagaggagaaaggaggtgtttcagtgtgttctgcaggtccatcaagtggggcctgtttgagcctgttaatttacatgaacgggttaactaaatttgttccagtaaaagaattgtgcttgttgaatgtgtgaatgtagatgataaattccatcttatagccatgattaatggaggaataactgggatttgtggcaaccgtttttaggtaatttattttaaaattgtagagctaaaaaattgtaaaaagttttattttccaacagtgattttaacctggtattttatatttaactttctgtgtgtgtgtgtttgtgtatatgtgtgtctacttgtcttaatgtgtgcattttatgtcttgtgctggtggagtttgtggagggagattaatgtcagcctgttgttagttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccctctggatgaagaggctgtagccgttgagctccctgtgggggcctgtttcatcccgaggggactgcgtgttgctctgtgtggtttgagagaagctgctcttctctgttacttcccttctatgaaggtagaagctttcagtgttacaacttctgatggcggaaaatttagtttttattaataattccttcttggatagtctagtgaactatattaatagaacagtgtactgttcacagaaaagaacttgtagggagttttttgtagtgatatgctctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggtttttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgag

SEQ ID NO: 124083 - DNA, 1860 bp, Homo sapiens
tgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgtatctgctcttggtataactaaaagaggatattttgatttcttcctaaaatgttaccaagcaactgttcttcatgttaatactaagattcttgatagttccatttaaaagccacaagaagtcattctggtttattcctcactccaagggaacacttactttgtgtagacaagaagatgagagtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtagctctagagggagtagggagaaaatacaggatgaaattgaaaacagggactaacaacttttcactgaatgccagcaagctctctaaaattagttttctttggttgaacaaatttacaattcattgtacttcatttcacagcattaaacatttactcgaggcagtttattctgtttgctctttcatcccccttcttatttacttttttcttgtgctctaaaacttttgtcaatctttaacaaaactgtgctgttaccttttttaatgttaaaagaattttaacactgtcaactgtagtttgtgcagatgtatgtcagaaaaaaatgtacagtatgtgtcaaaatatatttgaatatcttgttgctgttgctgttagttcctggctctctaattttctgtctgttagggagtttcttaagatttgaaatacaagttaagaactatggaaagcatatttgttagattgttactttgggagaatgagtgtttttttttttttcttcatttctggtttcctgttaatctccttcctgataactgaagtaaacagggtggttcactcatgtcctccttgtccaggaaggactgctcttctgcattcatgggggctcagtgaaaaagagtgcaagtttgccttttggaaagtgctggccatagaaagccagtgacagcctatttttagttttgcattatctttaaacacagcagtaacaggtaagttaatatcctgccaaaatcagaagaggagagagagaaggaagtaacaggagcgtggaggaaggaaagaaggaaagcagaggagaattcagtccactgggataatggaaaggcataagtgactgggaagcaggaggctgagaatccattccatgcttctgagcagttttctgtcaaataatccaggatagtattaatgtacttgtaagtctagggagaagactctggattgacctgctgcttctgttacatagtaattgtaactattaaactttgacgtcagtgtgatgatgaggattgttccctttgaaggcccagtgggtcggctgttcccttctcacctctgacctttgcactcttgtctattcccgcccgcagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcct

SEQ ID NO: 124084 - DNA, 1038 bp, Homo sapiens
ctcatggtggtttggttggtgtggccggagcatccgctaagctggttcactgttggcttcatgacctccgtgcaggctgcctcacgccagggtccagagacccccgttacagggaaattcctctcatccccttttcctctaactggcttcactccttcctgttacttgcactcttagcacctagtaacaccagcagccagaccttagcaggcgtgcagctgccgttagggaaacccctatgctgactgtagagcaggacagttgtgcaggggacagggcctagaggctgtcacaggcgtgggttcagtagtcattgttttcaagacagcatgtttaaaatatagctgaattcataaggattcagatttcacactaatcttaccttaaatgaaactggaattctggtactaaatatcttcaaatacaagagtattacttttagtgagtgtatgagagtcttctaaatcctgcatcattctgcataagcaatgcatgggactcgacaattctgaaattgtcaaatattctaagagtcagtgtaactgtcacccttacaaataacagattaattttgccagaattctgtctttccccgcccccctggatcagagctttgatctactttgaaggtttaatatataataatatttaggttgagtcactttggaagccaggattaaatcattttatgaaatatctgttgtaagtatctacaatttggtaccttttagagaaatttacggaataatagtaaattttgaagcaggatgccatcagtctccttgtattgaattttataagctgaacctaagatatttttttatgtgtcatgacagaaatgtgaggtttggtagccaagtattataatgaggtgtcactactcaccatcttggctctcagtcctaccactaacccttattttaccgcacacatgaagtacctcacaggaccaggtcatagccgacatctgattgctccacctctttgaagacttcttcgtaatgtacagagccgtctgcaccgtgtgcagagcgcatt

SEQ ID NO: 124085 - DNA, 4504 bp, Homo sapiens
aaaatgtatttttgtgcaagttgtttgaaaaagaattttaatgtgaaaatattgtactacttttgtggcctgtttaatccaatattcattgctgtcagtatttgctaaatagtttgagcatttattactgcagcctgtattacactgtcagatttttccagtgtgaatttttctaatgctacaattaatagaaatacattaacactgatttactgcattatgattttaacaatataacattgattgttacttggatacacttagtgacattattacttggatacattgaaaactttgtatctgcatcacatcttttgatcctcaacaatccaccgaagccagtaggaacagggcaaatgttgccgatgggttgatgttacactcacccagagttgctgtgccagtcagaggcagagctgggccagtgggcagtattcctccctcatagtgaagggcgtcaggtcaacattttagcaccttttgagagtagtaattggattactcaggccaccaacagggatgaatttcaaactgatgaaactttgatacaatatgaggggtcttttaccttcctacttactcagtaaaggtatttttgtattctctgagcactgcatctttatcatgagtaaagcttagaaataatcaggtactttaacttgtactgtttctttcatggaaaaggaccaaactcttacccaggatctactggagcagctgttggagcccatgacgcctgtcgggatgcaaaagagaagcgctctaaaaggtatggacggttgcactagacgaggaacttcatctgtacctgatgagccctttcactcttcacgacaccttgagattatgtaaacagacttcatggcttcactctgtgacctcacctggattgtaattaggaatgctattgccccaagtgttcttaaaacatggaatttgaactcaccagaaaaatcatcagtactattctataacttattattaaatttggcatatttatagatgcctctcaggtacatgtaagatgccttaaaatgctgtattttaaaactgtacccctcaggttacacttaactggtaagagtcacctgcttgctaaaatctaacttacaagttttttgagagttgactatgactgggaaaagttaatgttgtagccaagagaacatgttgccctttttttctagatgggtttaaatacagcccctgtgatttcgattataagaaaggttatagcacaatttaacaaagaatgagtgaaaattttaatcgcccattttgcaaacgtgtgtaattgttgacaggttgtttctagtttgtccagtaatctttgatattgccctcttctgcagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatgatttctgtgtcaggcagtggttttcatttgtggggacgtgtcgtgtgcctcgtcacacagctcacgggtggtgtctgagtctcataagccgttctgctgcccaggccttcctgatgcttccttgatcccagcaagcttaggtgggcattcgagccatttctcagtgacactgtctcttggtggcccctttgaaataaaatatccgtagtaataagtaaatggtgtacataaggcatcctggtgagaagcgtcctagtgcaagaacccactcgggacggcctcgtgtaaaagggtgtgtttgattgtaaaactacacaagtcacattgtgaggacctgggagctgcgggaggcctgggcatgtgcgggcgggaccttctgtgtggacagggctcagcgctgcctctgcgccatctcctgcctctgcctatttccagtggaccttttaatggcctgtgagcagggggatgggacagggcagggatggagaatttttagagctttcatggggggagaaaaggatgggaagttgttggttgaaggatgcaaagtttcagatagacaaaaggaataggttttcagatccatgtgctgcacagcagggtgactgtagtccatgtattgtaaaaataaggacgttcatgaaggaaggagtgtgtcttagggttgtagaaacttgtggagacctttttgatagaacgagatgtttgtgtattagaactatagtattcacttttactatattttaatgcttgaaaggggactttaatgtttgggaatacaaaaacttaggaagtctgagtattattacagattcctttttctcctcaagccttgtgtttctgttgctgtcagtggaaataatggtactgccctacagtggtctgtcatacggaccagcaagcacttgatc

SEQ ID NO: 124086 - DNA, 1209 bp, Homo sapiens
ggtgaggggtgctagtgaccggctgctgaccctcccggacccaggtgagggacgctagtgaccggctgctgaccctcccggacccgggtgaggggtgctagtgaccggctgctgaccctccgggacctgggtgaggggtgctagtgaccggctgctgaccctcccggacccaggtgagggacgctagtgactggctgctgaccctccctgaccggggtgaggggtgctagtgaccggctgctgaccctcccggagggtgaggggtgctagtgaccggctgctgaccctcccggacccgggtgaggggcgctagtgaccggctgctgaccctcctggacccccgtcccaggaacctgccagacgtggccactttcccgctggggcgccgggcggccctctctgcagccgcccatctcgggccctggttgctggcatgttggcactttcagatgctgctcttctttccagcttgcatgttgtttttctattttaaaggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactcaataaacctggctttattccaaagcaccctcatgaatgtggatgggacctccaactcctgccagaccatcaggcagggcaggcttcacagaggagctccttgcagtgcggcggccaccaggtgtcacagcaggcactcgctgtcctcatcagactctccccagaggccaccctgggccctgaaggccctgccccgggaaactcgggagccggcagaagtagctgtgggcaggagggcagggggcgtgagtgccccacagtgggagctggtcagcctgggcccagtgcagatcccacccgtgagctggggaggtgctgctgggcacgtacggccccagagccaccaggcctcacacagagctgccacctccgcctcctcgagttcgtgcttttcctttccccccaggctccctctttcttcaccactgtttttggttgtccaccacactccg

SEQ ID NO: 124087 - DNA, 1116 bp, Homo sapiens
ccccgcgcccagtgtcttaaacgcattcccgtctgccccgcgccctgtgtctacacgcggacctcagtgactgtgagtcgccgtctcccatgggacccaggagttcctcgaagcagtgaatgagcagcgtttccatcccagctgccacgcatgaaatgaaatcaacagtgcactaaatcgtctccgtagttacgtgtttgttcatttttctcgctcccaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactg

SEQ ID NO: 124088 - DNA, 1050 bp, Homo sapiens
aaaacagacagtgcagatagttcctgtctgccaaaaggaggtgttgtttttgatcctgatttcactctcataagctgtggaattctgtatccttataaagaaatgtaatttgaaaagtgaggataagtaaagcagtctgatctggagaaaacccatgtgtgtatgtgtgtgtgtgagtgtgtgtgtatatgtgtgtatgggtgtgtgtgtgagtgtgtgtgtgtggatgggtgtgtgtgtgtttgtgtgagtgtgtgtgtatgtgtgtgtgtggatgggtgtgtgtgtttgtgtgtgagtgtgtgtatgtgtgtgtggatgggtgtgtgtgtgtgtttgtgtgtgtgtatgtgtgtggggggcgatgggtgtcagtagagctttctttttgtgacagtggaacaaggaaattgcttcagagtgagcaggggcagctgccggatttagaagatgtatttcgcgtggactttgggagtttaaattgcattcacaatgcatgttttcacccctttgagccttaagttttgctttccataggtacaacagttccctttctcttctttcccttctcagtcccggctgagacaacaggacatcggcctgaagacccacctggaccagctggacctgcagattagcaagctgcagctggatgtgggcacagcctcaggggaggccctggacagcgacagcaggcccagctcaggtaccagggcgccctgacctcccggacacaggggcaggcacgcagcacaggcagaggtgaagcctatcccgccagcccctcttgggctgaaattccattccaggtatcctagtgtccgtgcagggagatggccgcttcgtcaggctgatctgaaagttaggaggcaacactgaagcctttctcagggcatatatattaattggctacctcgctcttatttttttaatttgcaaaaatcacattgtggtctaagtgacgttattgcactcaggaggcctgtggctgaagcacctccccagactggtctcctcaacttggcaggcaccagggaagaaagagagaga

SEQ ID NO: 124089 - DNA, 1022 bp, Homo sapiens
cgggcgggtatagctgcatgtgctgacctgccagtcctgtgcacacagaagccaggataagggggcttttgtccttcaagtgcatctttgctgggcacaaattcactgcatcatttacaattttgaatccaacctgaaaaatctttgctaaaaatgttcttctaaattatttctttaaattgttatatctgatgaccagtgctgcaggctgagacaccaggaccatgagaactacaagcaggggttatgggtttgagggaaggacagtggccaggaaggagcagcccaggggtttaagcatcctgacggcatctgtgttccttccaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagtaagagctttcccacccccgaccctgggcagtggtcaggccctgaggcctgggaggtctgcttctcacaaacacaattacagattgtgtttatggcctgggagtgcaaaaaatcaaatatgctgtttaattgttgggcgtctgtttgcagaaataataatgataattggcgactcatcacatgccacttgcccaggagagcccaggctcaaagggcatgaactgcgtgttggtttgcaatgagcctttttactgttcagaccacggttggcttcccccagaatggattgtcttctggtatttgaggtgcaaacctgggaaccactggaataaccaaccctgcacctgagctccaaccaaatgttaggaactcaccaaccctgctcctgagctccaaccaaatgttaggaactcaccaac

SEQ ID NO: 124090 - DNA, 1077 bp, Homo sapiens
aggttgaggtgcctcacttagcctgcatgggccttgaggttgaggtgcctcacttagcctgcatgagcctagaggttgaggtgcctcacttagcctgcatgagccttgagattgaggtgcctcacttaggctgcatgggccttgacattgaggtgcctcacttaggctgcatgggccttgagattgaggtgcctcacttagcctgcatgggccttgagattgaggtgcctcacttagcctgcatgagccttgagattgaggtgcctcacttagcctgcatgagccttgagattgaggtgcctcacttagcctgcatgagccttgagattgaggtgcctcacttagcctgcatgagccttgagattgaggtgcctcacttagcctgcatgggccttgagattgaggtgcctcacttagcctgcatgagccttgagattgaggtgcttcacttagcctgcatgggccttgagattgaggtgcctcactgagcctgtatgagccttgagattgaggtgcctcactcagcctgcatgggccttgagattgagatgcttcacttagcctgcatgagccttgagattgaggtgcctcacttagcctgcatgagccttgagattgaggtgcctcacttaggctgcatgggcctagaggttgaggtgcctcacttagcctgcatgagccttgaggctgaggttcctcacttaggctgcatgggccttgagattgaggtgcctcagttagcctgcatgagcctcgagattgaggtgcctcatttagcctgcataagccttgagattgaggtgcctcacttaggctgcatgggccttgaggttgaggtgccccacttagcctgcatgagccttgagattgaggtgcctcacttagcctgcatgggccttgaggttgaggtgcctcacttaggctgcatgagccttgaggttgaagtgcctcacttagcctgcatgagccttgagattgaggtgcctcacttagcctgcatgggccttgagattgagatgcttcacttagcctgcatgagccttgacattgaggtgcctcacttaggctgcatgagcc

SEQ ID NO: 124091 - DNA, 1080 bp, Homo sapiens
ggttaacccacccctcctccccggggcctcacgcgggtgggaagggacagtcccagcgacagaccaggcgcctggacgcgccgtggacccgcgtgcggacggcggggacaggctccggtgctgagcgcctccggtgtccccagcagcactgacccacttgcaggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgagcagcacccgttcggcgaggccgcctaccccgccgacggcgcagatgccggccagaagcacgctggtgccccggaagacgcctcgcaagaggaggaatctgttctctggacgatattaattagcattttgaaactggtacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcacaaagtgtttagactccattttcattaggcaggttgactaaaaatgattgcagtaacaggtttatataaaatagagcaacctttcatgctgtgaca

SEQ ID NO: 124092 - DNA, 1019 bp, Homo sapiens
atattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagca

SEQ ID NO: 124093 - DNA, 1484 bp, Homo sapiens
gattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaa

SEQ ID NO: 124094 - DNA, 3752 bp, Homo sapiens
catagtttaacattgtgaaaacacaaatgtgtacttgaaggacttttttttttttttcctaactgcagcgcttcatttttcctgaaggaccttcttaatgacttttagtactcagtgaaaatacccacacttatttgtaacaatatatttttgtatgaaacaaatatgttcccttgtgacggaaaatgatgttgaagctgtgtgccgtaatagtagctgaagcggataattgtgtttttgtgacttatgtcagaaaacaaagttgatgaaggcactgatatggaatcagttttatataatatacttagaagaaggaggaatgatttttaacataacttactttagtctccactggaaaaagctttcttacatttagaatgatctttttatttttaaaatgataaagctttaaaactttctttgaatattttccatagttttcaaaatccagactcaaatttgtcttaattccaaagaatctttgtttttgccttttaaactccaggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaact

SEQ ID NO: 124095 - DNA, 1047 bp, Homo sapiens
atatcatgtaccatgcactggtgtgatatgtatgcattaaataagttaatgcatatatatcaactgtatgcggtagatgctattattaggtctgttttacaaatggagtgacagcacagagaagtagcaaagacctgggacagtggtcgaggtggatgtgagctggcagccagacttggggctgctgacattttatttacttttttctttttttgggttgagggcaaagaggggaggcacattatctcttagtaagaatcaaatgcatattttacataagtctagtgaaaagatgttcaggctttttattaaccctacttgatgacaaaaatgaaaaattagtactctagttttcaaaagtcttcggggttactcaagaagtttaaggctatcttcataggtcaaagatgagtctgtttatatttaataataaagggaaaccaaaaataaactctctgaacttcaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggtgagaacatttctctctagtaggaagcatttcctttctctttgaatttttgttacattgaatttctgtcatcaccctctccttgaaaaaggatggttgcatgtaatttccagaaagtattcatcaataaaagttacttatagtatgttttgataaaaacaagcagtgaatggcctttggtaagctttatgcttaaaatcgcccctttgtagttaccatgagcagtttaggcaagggtatggaaaattagcttacaatcatttattcaacttgctgtctctttagcttaaaatattgaacaaaacagaatttgatctcttgacacagaaatgtagttttcttagttgaggggagtgcatttgcttaatcttatgcttcctataggaaaatattatgtttagtaatatgttgtacaatttgttgggtt

SEQ ID NO: 124096 - DNA, 1018 bp, Homo sapiens
aaagcacatagaatcttaaaaataaacttgtttggttgaaaaattgatatatttgccttttgcaagataatcttttgattgctcgagtttatattgtgaatattaagtttaattattttcaaatgtactaagatattttgctttggctattggaaaaccattacaacgtggagcggtttgaagaattaaattttgaagagtgcttttgttcacttatccttaaaagagcttctttatttttttattttttggtctaaaataggcttaacagcattgcgcagtgatgaagtgattgatttaatgataaaagaatatccagccaaacatgctgagtattctgttattctacaagaaaaagaacgtcaacgaattacagaccattataaagagtattccgtaagtaattgaggtgactggcattttttatttgggttggggaaaatgacattttagaaagttatatgtgacttccaactgtattttttttttccagcaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgtaggataacttaaatttagtaccccctgaacttagtttattacttgttattgcagagtgcccatcaccccctttatcgttattttttgtaccacctatgtgtgtgtgttttttttgtttgtttgtttgttttgttttgttttttgtggcagagtctgtgtagcccaggatggagtgcagtggcatgatctcggctcactgcaacctccgcctcccgggttcaggcgatgcttctgcctcagcctccccattagctgggattacaggcgcctgccaccacacccagctaattttttgtatttttagtagagatggtgttttaccatgttggccatgctgacacctgcgtgttctttttttcctcagaagttgaga

SEQ ID NO: 124097 - DNA, 1050 bp, Homo sapiens
gaagagcagaaaccaaagcagatttgcatttacgggttcattgaaaatgttcttatttggattggattgaagatcagttttaaattttattccaggtcttgctcatgccaaactcttggacccttttaattataatatgaagttaatacttgtatgactagttgtccttagacagtctttcatttattgagacttactgttcttttattctttctctaattattatttttgaatcttttaaatgtataggatgataatgaagataattcaaatgatgggacccagccatccaaaaggaggcgaatgggctcaggagatagttctaggagttgtgaaacttcaagtcaagatcttgggtactgtcattttatcggttattaatattttttgtgatgttcctctttgccttaacatcctcttccctttcccccagctctggcaaaggcaattattaaaaattgtagaatattttcttcctgttctataatgtgccatcaaagttggtcttgctactgagtgtaattaaaaagcaattttatgatagtaaaatacatacatacataaaattaatcattttaacaatttttaagtgtgaaattcattggcatcagttacattcacagtgttgtgcagccattaccaccatccatttccaaaactttcactaccccaaactttataaccattaagcaataacctccctttctccctctatttagcgccttgcaaccatcattctactttctatttccgtgaatacgactacttagttacttcatataagtggaaccataaaatatttgtccttttgtggctggcttatttctcttagaactttgaatatcttcaaggttcatctttgtagcatatgtcagactttttttctgtttttaaggctgaataatactccattttatgtatatactgattttgtttatccattcagatgttgatgggcatttgggtttccaccttctggccaaggtgaataatgctgcagtgagcattggtgttcagagtttgtgttttcagtttttttggatgtttatc

SEQ ID NO: 124098 - DNA, 1043 bp, Homo sapiens
ttaggtgcacatgaacgctacccggggttacgcacacaaatgcctgtgcgctccgtggctgacaagaggcattttcaactgtgagttttctactattcacaccgccaacatgcagattaaatgaatcaatgtatcccacacacttgtaacagtagcggggaatatttcctgtacaaaaaagatgtcacccctaaatctaaaatgcaagcctctaaataattatagctaatcatgttagatcccttggtattttccaactttgagctttggatagctttgggagctagattggtaacactgggccccaaaattaaccggaaatatcaattatcagctttttttggtttatattactatggacattttcctgtaagtatatgatttatggctgatctttaattttgcattttaatttgtattttaaaagaagacagcgttctgtttgtttcaagttaccttacaagtttacttacttacttgatcaaaggtggtataaagagctgttgacttcagaaaaggaaagaaatgaaaataaacaattaaagcaaaatacaaatacactaacactatgcaaaataagaaaaaattctggtacatggccacacatcccaaagttttttgttaaaacaaacattcatctagaaacactatgagaggaatgtcactgacaaaataaacacattacaaaagacgcaaaaacacagtgcagctggccatgaagccgcattaggacactgctctcaacagagctttagcccagttatctctaaaatgtacaatcccaggccctcacaaatcgctgctcatacaacagaatacttctcctgacgactggtatttgtgcacaagggagcacagcttcctattttctccaatgaatagccttgtctgtttttattttatttcatgcacgctgcttctcagcatcatcggcacggcctacagacatgtgctgtcctgagttctgatcccaactgcaacattttctagacatgaaacctacaggcaaccgattgaactccacagatgcaggttttctctgc

SEQ ID NO: 124099 - DNA, 1050 bp, Homo sapiens
gcaaatatctgtaaaaatttcctaatatttggttaatcctgttttataatttgttctttccttttcaatacttagctgctgttacatacaaaagcaaatgtgtttttaagaaacgagttaaattattttagctgagattaatattgattgatctgtgatagagaatataaacatacatgtaatccattcacttttttttctgatggaggatactgtaactcagatatattaaaagatgattaacagttaattacatttgaaaaataaactatattttcatagctgaatgagttaatctaattaatgattttcttccctataaattaccttaaaaactgatagcagacagtcatcaacgaatctgagtagcagtacaagagaaaatgcaagcaactgattagttgtttcttttgaaaattcatgtaagttgatctccccgtggcttaaatgatctcttatgcggggaccctcctgatggttcaggaaatcccagagaaattcctttcagaaattaaacagagaaaatattttgttagtatccgcagcagagagacgtgcctggtgttgctgaatagaaggaaagagtgcatccatcaagtcctctgaagccctgggtgggactctgctggggagagctcttctcctacacccacaggacagaccagggagccagagaggctgtggggaaagcagagctgcccaggtggtactggagcctcatcaaattccagtctttcttgttttcaccttcctccaaggaagggaactgagtgtgaacatttgcaaatgagcttttccaaggcaataaaagaaatcacggctctttcttgtgtgagcacagcccctgcactttctcatctgctctttcaccttcaaaagtctgttgcttcttacgacacaaatccaaggcctctcccacaggttttagggaaaagaggtcagaaaactgctgcccttggcaaaccgccaatggtcagaagcatcacagagactcaaggtggaaagaacattaaactagttcaatcatcttattttttgatggtaaaaatg

SEQ ID NO: 124100 - DNA, 1041 bp, Homo sapiens
gggaggcagaggttgcagtgagccgagatcgcgccagtgcactccagcctgggcaaaaacagtgagactctgtctcaaaaaaaaaaaaaaaaaaaaaaattgtaggtagttacagattttttaatttgtcagctatcaattcactgactttgtttctcataggttttagttggctgacttggatttttaagttatgtggttatatcagctgcaaataatgtaatttttatgctttttaaaatatgtatatgcttggcaattaaatgtttatgcgatcctttttttagttgtattcatttttagtgtttaagtaactatttcctagttacatttccaattgtttggaatcttttttttcttattcatctccagttttgtgcacagagggtgggtgtggcatttgtgatctattattgttaatggcctccatttaaaatcattttattggctgtcatttgcctgccatgtcaagcctattttaatgaagcacttgcttttctagctgcatagaattatttgaagaaagataatgagaaatggggactctaagtggcctacagttcaatagaagaaagctaaaagcccacccaaacatgatagtaaccactgttttctctgcactaggaaaaatcagccgtagaattgttgattagtcttgcagaaggctatagttctcgctgtcatccggtttttcagcttaaaaaacaggtatgccaaatgcagggtcccgggaggggcgtgtatgtctctgaaaccacctgtcttctgcagagatgctggaagggtgcagtttgcttgctgagtcagactttgagttgggcagatccagctttttaaccagtgcggggcctgctgtggcgctggcctggttgctcagtcttctgagtctcaagttccgtgtctagcagttgaaagtaatgcggtgctgacggcactgaggtttttagtgttaaatggatgagcactgggaagtgtttttgctgagtcccctggcaggctgttattgctgtcagcagtaacgcagagctaggagcagttttt

SEQ ID NO: 124101 - DNA, 1634 bp, Homo sapiens
gggcttcatgggggtcctgcagggacagtcccaaggtgacagctgctgcacctcgagtgcggcctgaactggagaggcacctgcacctctgacatggctttggatgctgcacagcatcgtcacacctgctgtgttctgttggttccaggccagtcgccagagctcgtgcagatttggtgggggcctccctctcaatggcaggtgtccaaagaacctgtggacatggtcatagccaccccagacgttcactcccttccaatccactggtagtttccgcagccttcccccatctgaatgtactgaagaactgacacccaccatctggttttaaaatgtttagaatttgtaataatttacgtattttctagagagtgatgtaacatccataaaaacacagattttctaggaagttactgtgaaatctacaaaagcaataaaacatttcctcccaggtgctgagctgtgaggagagcatcagggtttgggctctgctgcctttccccgaagaactcactcggcaagccgtcaggtgcgtggcatcctggggcctggctgacctcaagcttgtctggtactattagtttcagcagcatttcttctttaacgaggctgtgggaagataaaaggggaaggaggaatttctgggccttggtggctgatgcaggctgtggggagctggaagtgtcgctgaatgcgatcttccaactggcatggggccctggtggagactgaacatggaacgagaggcaggttttgtgggtagacagtggcgtccatgagaagtaccctgagtagataggaagaaagatgggtctgaagctcaggagagaagtagggatggagacataaattctggaatcgtaaacaacagcagacatccttgttcagcaggaagaatacgcaggtggttcatcgtctcgtcgtcactggactttgctcttggcatatggcatcgtttgtttctccactgtattgtcatggtggctttttccattttatatttgaggaaagtgagattcacagtcaggtcgctgctcagtgaaccattgaacattcttgtgcacaggcactgatgtgagcactttaattgtcacgtatctttaaatattttctgtttttcagattagaagataattctgaaacaaatgcctgccactctttgattacaaaaatgacggatgagctgtatcaccatatgcctgagaatcgttgtgtgttaaaggacttggatcgtcttcctactgagacgtaagttccaggacatcctgacaactgttgaaacattgattcagcagattagcatagcaaacttagcattttctatgttttagattttataaacttggtagtagtcttagaatcccactgttactgctccaggaggaattatgagataagttttgacaatctctgtgcaagcttggcacatctgatgaggctgtgaatgccacattctgtttgccacaattcagtgtgtttagttaacacttgccgcgtgtcacggttgtccctgcagaccaaccagcgatacgccgctagccctggctcccagaaagccgcagccttgcaggtgcagaaggagagtgaggcccaggtgaggatcatgatgcctgctccaagtctggctctgtttg

SEQ ID NO: 124102 - DNA, 1033 bp, Homo sapiens
tctgggaccatggagatgcgccagttcacctaacgtgcacagctctgggatgtggaggggactgggggacaggagaaaacccatgccgaacccataacgaatgtgcttctccacacgggcagtggccctcctggggcatccatttcttttctcactgatgttgtgacgaaacaatgttgaatgaaatgatgttatttgaggacttcctgtgctgattttcatagaaagttgtagtacatactattttaaatattgtttgtaatttgggcatgtggaaatgtgggttctatctatctaaatgaatatttggatttaaaatataacagcagattaacgtgattaacagcagattatatttggatttaaaatataacagcagattaacttgattaacagcagattaacagcattatggtttcttcacttatagagtatattttagaatgtgctacatccttaagaaatggccattttggatacatttctagaatttttgggttgagtggtatctgtttttaaagctttacatagatatcgctggattcccctccagaaaggtgctgctcaatttacactcttaccagcagtttataagacaaggtcattctcttactaccactctccaaaaccacaatatttttacatgtctcaactagtttcatgggaaaagtaagatcttaactttaattgggatttcttcaatctggtggcattgagcctgctttcctatcgaggccatttgtttttctctggtgagagttcctccctagatgtcagagggcagcgagcaggggggctgctgggcgcagactgtacctgcctggtgccctgtgagcgtgcatggcccctggcagccctgatgtagaccgggcgcctcagatggtgactcagagcaagaaatgcggacgtgcaggatgggccgggagcaagggctatgctgggcactcctgccggccacgggcctcggggctggaagcaggcattgggctctaaggattaggaaaattattttttgagaagttgggacttaagg

SEQ ID NO: 124103 - DNA, 1054 bp, Homo sapiens
ccatcgattcgcaaaggaacaaggaaagaacacgttttacctggatggatggtccccctcacggtggccttggaacccgcttcagcgggagaggcagcgcctcactcacggctccccctggccgctgctttaccagggagcgccaccccgtgccccgccagaggaagtgcaggcgccagcacagcacgggccgaaagccacactgtgggacccgcagcgcagctccaagaaatccaaagtccattcacaagaggagcttctccgccaaatcgttgaaaaataaaacgagaaatgagtcgccaccggtatccgctttagtcagccgtacgaaaacgcaacccggtcagctgcacttctgctgccagccctcctccagtcaagcaccggcctcgagaagggcaaagggcaggtaggagttccgacgcatgcggccacggggcggagtcacagttcagaggcctcagctgaacctgaagttatcctaagctcgagccccagagtgaggactcggggtcaggcatccgattccccatcagctcctttactaaagctgtgcagagaatccgaggctatgagtgggggtgggggaaagatgtacaggatgctttggtttcactcctgagatacgagaacgtcctctgaacacacatgcagatagctggacttctagacagaggaaatccaaatcgtttctttcctcccagcataagggaacggtccggtaagagctggtgtttatcgatgctacgtgccagaatggggctgagcacggcgcctcactgtatcctaacgtctaatgaggcagggaatgtcactgtcacactctgcagacgaggaagccatgctgtcagcaggtacacatcttgccacaaaaccagtaacctgtggcactgagatcgcacaccggtcgtccactgccaagtccgtggcctccttctctggggtttgcctgcctcttgatggcggccatgcctctgtcctctcgcaggggctggctcttccagtggtcactactttttggttgcaagcagcagagattccctggagggcttgt

SEQ ID NO: 124104 - DNA, 1023 bp, Homo sapiens
ttgttctttagacccaacaagccagatctgttaacgccaaaccttcattcccaagacaaccctcccttttgatggccctaaggtgctgccccctaatttcatgacttctgccactgcaaaagcttcccaaattcgtactgaggccacgcctttcagagtggatgcacgaaggagggcggttcatcggaagtgaatctgagattaaacccatgtatcttagctccccagtgctccccttcatcatttctagaacatacgtaatagcatgtcctggtcttcttggtggtctccttagggatataggggaagggcagttttcatatcaactttctttatgttaccatgaattagctgcttgctgaataaacttctcagacaaaaatcccacacttcccgagtattcgcccttccacaccacagtcacttgctctagtgtttgcacacagttacattattatcaaaactgcagttcaactaaatgctccaagtgcaggtgaaggtctgtcctcaaggtgctgcttgaagcaggtgactggaacagttccaggtccctgctgttctggggtgtcagcatcagctccgttcaggggtgacagacagcaaggccccagccgggagaggccaaggggacgggagtgagagggagagctcagaggcagggcaggagcctcaggatgggagatgccagggccttggcaggcggccaccccaggaccaggcaggctccccaagccaggggttctttcccttccaagagcaggactgaaaggaggctcaggagtaaggggcaagggcggatggtggcaggtgcagggggtgaaggggccccgcctgggaaaagatggcaatggagctcaaggaaatagaagcagctacgttgccacggtggccacagtgcaggagcaggtgctgctggggagctgggccccaggctttatctacactgtctcaccgtaagtccgctcccgacttggcaccattgtctgactccacacattgccatagccctgtcaggcaggtgct

SEQ ID NO: 124105 - DNA, 1056 bp, Homo sapiens
ttcagcattcagagcctctgcctctactggggattaatgcaggtttccaacatctctgtgtttggtcagtgctgatctttttcctaactggcgacttattggttccaggagagtactgggcaggctgcaaatgtctgtgttaaaacagctctgctgggctaagacaggacagaagcagacagcaggtggatgagacacaatttcctatccagcagaacctgcagcaagctccacagcaccctccatgggctcagtcttgctcccgggaagatggttaattccatcaggtcagtatttccacacctcccgagcctccactttcctctatgtgttctctgaaacccacccccctgggcttgccacttagatgattccagaattgcctcaccaccctttacttgcagaacctggccttcatgttatggggatgattaggaaagaaagttgcttcaggaaatggccagaaaggggttccacagaactggcttatgaaatagttttgcagaatctgtaattagtaagctggaaacaaaggcaaaagaaaaaacagaaaatcttattgtagaaaacatgctttgcagtgtttgaaaaggctgttcttgttaaattaacccattaataaatacaaaccacataatatttgcttttaaattattgtctgtagtgtcaaaataactggtctatgaagccagtgggagtctgtctagttggaaaatagtagtatttattctttgaggccccaaacataaaagaaagtgttgtttaaataaaaacatggtgtgtgagcatgagaggtgagtggacaatgggaaattacttaatgagtacaatactcatcttttgggtgaacactaacagctcagactttagcactgtgcaacatatccatgtaacagaattacacccgtaccccatacatgtatagaaataaaaaagatgcatcataaactgaacaaaacagcctatgatatatcttgaagaaatcatgctttaaaaatgataatttcattattgtatgggagaaaactcacatggctcataaatgaaaaacatgaa

SEQ ID NO: 124106 - DNA, 1023 bp, Homo sapiens
gcactttaccacaccttgctcttataaattggataatcccccctatgagtacatgtagcattccattttcttacagctgtggagtatttcagtaccacactgtatgggtggttggtgttgatagacacagattctttcaaatcttttgttataacagataatgctgttatcttgctaatataccattttgcagccatctttggaatcagtccctaggagtgacattgctgggtcagaggacacacatctttgtaattctgtaggtgttgtcaaattatcctgcatgcggtcatgtgattcgctcttcccaggcatgaaggccactacttctccacggctccctacctgcacatcaggaatgtcttctgacatttgctgattgaataggtttcctattatattattagtaaggctgagcatctatttagtttcttttcactggaccattccatcaaagttttttgcctattgatctattgagtttttttaatctttttcttattgattttttggagcttttaatatattaaggatgtaagttgtgataagaggtgaaaatacattcttttcctcagtgtctgtcttgatttcttaatttgctgatggtagtttttcatgcagaaattcctattttgaggtagtttaacttataaattattttactgcatttggatttttcagttttaatttaaaaaatcatggaatttgtccatgatttctgttagtatttttatggctttactgataacatttaaatattttatctatttgaaatttatttttatatacatggtgggacatgggtgcaactttcatcttttattatttattttgctgaatgctactcagttgtcctaatgccatttatcacatagtttttttcactaacaactttagatgtcacttttatgacttactaatttccctcctatttttgtgtctatctgtatttcctgtgcttttctgttgttctgtgtgtttattcatgacccagtacaacaatgttttagttattaaaactat

SEQ ID NO: 124107 - DNA, 1147 bp, Homo sapiens
ctccttccactgaagctgcggataaacaggaccttggaggccagtgagctccctgccccagtagggacgtggcctgctctaggcagagggcagttgagcaaaggagagaggcatcaaagtagaatgacttcaacttttttaaaggttgaaaaacgctgaataaaggattactgtaaagagtatgggattgtttatatttgctgagtaatcaataccacatattgctttcacgttgtttgctcagctctgttccagggcacatccaagaagcatgggcatgtttctgtgctcttacaaagcctcctttctattaggaagcctgcagcacacacaaaacagccatcagcaagagtgtctgtggccccagtgctgccctaggcagcacacgagagtgatggactttgagtccctttattttctgctctctggaaggaggggttttaatagaatttatctttttatatattctgcctagcattagagaagcagacaattttagtcaatcattcaagaccatcctgcgacctcagcttttgtgctttacaaccttgtaaagaaacacagcaacataattaattacaattacagcactgtgatgtgaaatttcagccaaaaatctaagtcagccaaaaatctaagtcattgcctttggcctgaattcctttagcataatcttaagacagaacacgcatgcctgatccaagggcctgtgcacatcaggtgcacctcccagcaggaaaggctcggaggcgtgggccaggggatcatgcagagttgggctttcattcagcatccccgggaatcaggacattgcactcacacacacgcttgccacacagcctggcaggagccaagacaaggttgcaacactttcatctttaagaaaggagtttgaaaatattcgctgcaaattaacacaacttttctggctggtatgtacccacaaatggatgcagctgcaccccggaccgacctgggctccctgaaagatcagagggaaatgtgagggacaaacccattcagtgcagagctctctttcttcaagcaagggaaaaaagatttccaaatttgaaaatgaccttcgcacctcccctcctttctgttcccctcttcagtggaatgtttgaacaagcactgatgactcgct

SEQ ID NO: 124108 - DNA, 1079 bp, Homo sapiens
aatgtactttgatgtaagccatccttcctgcacatggccgagaagttcacctctactttatagcaaggcttcttcaaagaaaagcctttcttcaatggaaagacgtccttcaatttacatgctaggacaggcatggatattcatggacgggcttcctaaagcagatatatccacccatttcttaaaatatttgcctagacagttaagacctttgtatagaggcctggctgggattaaggagctcgcctgaagtgcccagagtggtggagggtgtggctggtcccagggtcagaacactcatgcctgtgtgacacaccccagctgtgtggcctgggtgtgtagctcacactctctgagcctccgttcctccaaggacaaaatacaatagtctgtcttgtctagcactgagtttgcagaggggccaccaccaatgcaggcgaagagcccggcctggagcctggctgagagggcagggatggaagacgtgatcgtgggacagtcacatgagagtgctttggaaagttaaggcaccacagaatctccaggtgtgctcttgctaccaggccatgacccgcctgtccacgcgcctgcagggtgtgggtacatgtatattaagtgtgctgatgagatcgcatgcacgcccagcaggcctcccgccctccaggcacgtagaaacctgggcacagcgcctgaacaggcaggtccaggagccaggtgtttggcgccaggtgcgcgtctgtggaatttggctctacagaggtgactcagcagccaggcactcagggccccccgggtgctgaagcgggggcagagcccgggccgcccaggcaggtactgttgtccagactttcacccaggaatgcttcttccagcttttctaaaagggacactggcatcggtcctatcctagaaataaacagccaggaaaccctacccctgaggcatctctgccacaggcctcctggtcaaaggcggagcctccccagccccgggcctgccctacccacctgaggcttcccagtctgagctggtcagctgggttagctccctgcactccctccccaaccccctggccacgc

SEQ ID NO: 124109 - DNA, 1056 bp, Homo sapiens
tctctccatctccacctctctgtatctctccatctctgtctgtcttcatctctgtttctctccatctctgtttctgtccgtctctgtatctcttcatctatctctctctctccatctctgtctcactctgtctctcttcatctctgtctctgtatctcttcatctctgtctatccccatctctatctctctccatccctgtctttgtctctctctgtctctctccatctctgtctctctccatctctctctgtatctcttcatctctgtctctctccatctctgtctctctccatctctatctctcttcatgtctctctgtccgcctcatctctgtctctctccatctctctctgtctcactccatctgtctctcttcatctctgtctctgtctgtctctgcctctctccatctttgtctctcttcatctctgtctctctccgtctctctctgtctgtctccatgtctgtctctctctccatctctctctgtctctgtctctctccatctctgtctctgtccatctctgtatctcttcatctctgtctctctccatctctgtctctccatctctgtgtctctgtccccatctgtgtctctgtccatctctgtctctctgtctctgtctgtatctctctgtctccatctccatctccgtctccccacctcccgctcgccaaggctgctcccctcaccaactcccctacaccatggcttctccctgtctctgactcaacagggactgagtgcagcaagggccctgggggaggtctgggctttctactgccttctggttacagcttctcctcccccgtatctgtccttcctcctggcctaataagtccacattttatttatgtgtgagtacatgtgacaaccaataactaatgtcccaattgaaaaggaaatataacacaaacttaccttagtttgtataatatcaactttctgtctcaatccaggtcttgtccaaaaagtattgattgaggcaaacccctggtacaaaatagaaatttagtgaaattcagcccatttcacttatgtaactccatcaag

SEQ ID NO: 124110 - DNA, 1217 bp, Homo sapiens
acactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacgtgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaat

SEQ ID NO: 124111 - DNA, 1351 bp, Homo sapiens
atgtgggtcaggctggtcttgaactcctgacctcaggtgacccacctgctttgggcctcccaaagtgctgggattacaggcatgagccaccacgcccggccttctccctgtactttaacccacaatgttctctttctctcttgtattcttatagcacttttctataatattcatgtgacagtatccaacattggttgtgagtttccacacatataacgtcacacttcctaacgagacttagagactcctgttgtgcatcctctcagtggccaaacactgaggcagtaatggatcttcactaacaaatccatcagcggatatattttcaatcatggcatattggctgggcagatacacatacctttaagatttcagtgtctgaaaccatggttacttgttgctttacttcaggccccacatttgtggggtcttcttgtttaatttcagggtttgtacacatgagagcttctagcttaaattcaaaatctgttgctacaggtaatttttgattgatttcagcgtgtgtacacatggagtcttcttgcttggatataggatctgtacatatgggaacttcctgtttggattcatggcctgtacacataatttcttgcctagattcagggtctgtccgtattaaaacttcttgcctggattcagggcctgtatacatgggaacttcttgcctggattcagggcctgtatacatgggaacttcttgcctgggttcagagcctgtatacatgggaacttcttgcctgggttcagagtctgtatacatgggaacttcttgcctgggttcagagtctgtatacatgggaacttcttgcctggcttcagggcctgtacacatgggaacttcttgcctgggttcagggtctgaacacatgggaacttctcgcctggattcagggcctgtacacgtgggaacttcttgcctgggttcagggtctgaacacatgggaacttcttgcctgggttcagaatctgtatacacgggaacttctcgcctggattcagggcctgtacacatgggaacttcttgcctggattcagcatctgaacacatgggaacttcttccctggattcggcgtctgaactcgtggatattacttgtttgtccaaagttattacacctttgggtttttggaaaaaccatggagatttttgtcctggtaaaagatatgatgccattcctttataaaaaagagctttgtttggtcccagaggtaatatctcttctaattttttctcaccttgatacaagtaaagaactttcgatatatggtctgacacagctaatatgatgttaccttttttgtcaaagttctcttttacagaggtgtagga

SEQ ID NO: 124112 - DNA, 1233 bp, Homo sapiens
acccagaccctaactctgcttttctcagaaaagatgtgcttttcctaactccgtcccacatcttcagtctggaatgttctgtgctcttcagtgtagccttcagcgctcacctacttaaaagtcctttctgctgaagcctgtcttcttctaggagacttagtggacatctgttggggctctcctggctcttattttcttcttagttatagcaattctctgatcactttgcttgcatacgtccacctctccgggtcatgtgcttctcaagagtgggagctttgccagggaatcgttgtcagatttctgatgtgtgtaattcatccaggtctggaagggtctttattcagtctgaaggacattttaattttgtgtagtattttcatcacaaatcctcgtacacatgagggtattggaagaaacttgaacctttcctttgtgctcactgtcacatgacatctcacccaagtttcatgtcccaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactcattttgctataacttgtcttctctaagcaggacagatataggaagtagaatttcttttaattttcttcatttttcccacccttttctatttttctgagattttttttttttttttttttttttttttgcattttaagtaatgaaaacaggtcatgttaattttcccttacactaatgaggtaggaatttctctgtaaaagttgaccttttgagcaaacttatcttatgaagagggctctggtgtttacgcagccagcttgcctgaagggacctttaaaccatccagaagggagagtatttactagggttttattaagactctaatggttataaatgaaatatcttaagatttttcacttctgggactgttaagccatctggaatagctattttggagaaaaatcttcaaccaaaataaaactgtaaaaaaaaaaaaataggcctttatacaagctgtagcca

SEQ ID NO: 124113 - DNA, 1199 bp, Homo sapiens
tttgtgtattctcatggcttccaactgttttacatctgcagtggttaattctcttgtcatctttacctgaagatcataaaaatgcctttctccctcttacccaccctttctgtgttactcaatattgtattttaactcccaagcctacagtttacccttgaacaacacaccaacacggggattggggctgtctgctgggtggcacctgtgcaatggtgactgggttctggctgtcacatgtgcaacagtgtgtgtgctgcagctgtcaccagtgcaacagtggctgtgttccaactgttccctgaagttttagccaaggtgatagtccgttttgtgtcacgttttgacctgatttatttttgcgatgatttgggattgtgattggataccatccttatgaatactgttttcttctttaaggaaagggggctgtatacagctttgatccagtagggtcttaccagagagactccttcaaggctggaggctcagcaagtgccatgctacagcccctgcttgacaaccaggtaatgatactgtgtccaggtaatgatactatgtccaacttgtcatggtgttcagttgaagtgccttcctccaagttctcctcttcattagcttaggagagccaagatataaagactttcttataaattactgtttgagtttggcagacgtgtcctacagaaacctcatggtctctctctgtgttctgcctactctcttgtgggtccttacctactcccatggttttgattgttttcctgtattctcatggcttccaactcttttatgtctgtagtggctaattctcttgctgtctttacctgaagatcataaaaatgcctttttccctcttaccccccctttctgtgttacccaatactgtacttgaactcccaagcatacagttgagccttgaacaacacggggattggggcgccagttccccgagcactggaaaatccacatataactttcgactccaagaaaacttacaaataagcctactgttgactggaagccttgccaataatgtaaactgtggattatcacgtattttacatatgtattatgtgctgtattcttatgataaataaactacaggaaagagaatgttattaagaaaattataggaagagaaaatacatttacaatactgtatttgttgatactgtaagtttacatcatctgtttac

SEQ ID NO: 124114 - DNA, 1086 bp, Homo sapiens
aagtctttgatccacctgtaattcatctggaataaggggtaagatggaatacagacccctcctccccagaagggtgactgtttgtcccattaccatttagggaatagtgggaatcagaattttaaatttaaaattgccgaagatatgttttgctctactatctaaccagctcagttttctgaaatgtgctttttacagaacagacaaaacagtcattggatgcagcggttttcatggagactgtcttacgctgacaaagattattgaagcaagactaaaggtagatgcttttgtacatttctacactattttaaattaatagtaattcattaaattcttttaagcctacagcatgactgttggtcagatagctagagagtcactaggttagtagatgaattacaaatgtatgctagaaatgaaatgatatcattaatgcagggtcattaaagtagcataatgtgaaacagcagcacattccatttgttaaagtcttgtatcatatgaagggttctctacccttttagaaggagcctgggaggagttcttcttctgaagatactcttccctcaaaaacaaagcaaatcaatttctgtggcaggagagagcccaggaaagatttgacacaggagcttggtttgcatcaccatcagttgacaagcttttcctctttacagtgctgtgctcttagttggcaggatgcatgagtagaaatacgaaagaatgaataagctgggagcttggatgggaggcacaacatgcaccattaacgtctgtcacctgaccagcttcagttgatagccagctgccagaagtcaggggtgatcacattctgttttgcctattcatgaataacacttgagattatttacacttatgagtggttactggagtatatagtatatttatttaactgacacatgctttttgaatgtgtagaaaggatttcactcagtatttatcaattgttaatgcttttttagaaacttacattgaaagccatagtgacttacatttattggcatatttatatgataattcctaatgcttattttataaatgggagttagaagacaaaagtaaaca

SEQ ID NO: 124115 - DNA, 1022 bp, Homo sapiens
atctatttgtcattatataagggattgggtataaagaaataagcattatataggcgttatataaggacttggatataaagaaatgaagcaagaaaaaaaaatctcatcttctctaaactcatagagcttgcgttgtagtaccactgtctatacctgatcctcaagggcacagatgtggtatttagttgttctgtattagtagtaccttgcgcgagtaagtatttaatgtgttggtgatgataattcattggcttttctgttaactcctgccaaggagactttgccctgatttaggcttattaataatttttttttcccagacaactcgtagccaggcgttcattctcttcccgctcatctttcctcttcccatttgaatcatgtttttgttgacatctagagtattttatcccattatgtactatggagcattcttctatttgtagggataggattaccaccctggagaattaatttttttcttttttcctcagtactatactggcaattgctggagaagattttgcaattgttgcttctgatactcgattgagtgaagggttttcaattcatacgcgggatagccccaaatgttacaaattgtaagtaaatatttctaaagacatttcacaatgcctttgtaatgatttgatgttgtgagagtttctacttctaaatgatttgtttcatgagtttttaagttgctgttgggagcatttttattagaaaaccattttctaagttaatgtttcctaataatttaatgtgcagtcttaataatatttgctgtattcagggtaccaaaagtgctttcggtaacctaaatgtgttcaccccagcattttaccatgaaaaatttcctgctgtgtcttaacatggtggaaggccagagaaagaaagaagagcaagcgaacccactgctgtgataatgtccattcatgaaagctgagccctaggacctaaacacctggtcccaactcccagtaccatcacaatggcaattaaatttcaacatgagtttt

SEQ ID NO: 124116 - DNA, 1042 bp, Homo sapiens
ggcaattgaccccccccccccccctcagcctcccaaagtgttgggattacaggtgtgagccaccgtgcccggcctcctctcctttaaaatacttataattatgccatcattctgttcatctaagttctaaatcttggatgtcataattggttttcccagttcctaaaacatttgcgtagatataaaaatttgtctattttgtgtgtttgtgatgattttggatttactgttcaccctgctaccttactattgcattagtagtattagaacagtgtttctgtcccatttcacatactatgttattgtcagagcagtcttcctaaaaccccactttgtaaatggaacttttctctctcttgcattccttttttaaagaccaggtctcactctaatgcccaggcacgatcatagctcactgcagccttgaacacctgggctcaagcagtcctcccacctcagcctcttgagtagttacaactacagatcattcttgctcagaataccttcatgatttcttgctaaaattccaaaatctttagcttggcatttgggattttctacagtaggaaccctgtccatcacataaaccttaacgtcactacatgtgcttatgcaaaaagggctgcctgaatgagttgcttgaatgtatgtactatttgaataattacctgtttgccattgcttgctgtttatattacctggaatgccatccttttcttcttgagagctttagcacaaatccctcctcagtaaaaatagtggcttaagtttcctgagtgcttacgtctgtgaggcaccatgcctttaatttccactattgcattgaagcagtggttatagttatcagtcaagccttgtacattaaaatatacacacccaaatatatatacacaccttgtgacacaggtactgttatcatcaacttgcatttggaggatttgtccaagatcacatacctagtaagtagcaagagtgggtctctgtctcatgtaattccagagcccaggtgcttagtcatactccagtgccatagcacttatag

SEQ ID NO: 124117 - DNA, 1881 bp, Homo sapiens
gcagttgtttcttagtgggacttcagcacgccttgattttcccttctgtagttcattgtggcgtaatcatatgttatactgcttgttttctttgtactttttattatcagtgaggttgtgagctctttaaggataggaaatgttatatacattttttattagccaggacaattaacgttcccaccgttattcgagttgccgttgcgccatagttctgacaatttttttgtatggtcagacttaaatttttgtccattggggtgaattccaatgttttcttcgagggggaaaaaaacaaaaaacaaacaaaaaaaaccctttacatccctgtcagcgctttttggaatgggcgggattcaactaccaaagggacaagccgccgtgcagccctccaggagcaacgactagcgtgagatagagaggccgggagcgaacttcaggagaagccggaagtggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggagggtaaaaaccccagagagctgcggctttcactttcgcccttcccccatctgctgaagcctatttaggagtcaccgccgtgatggcgctgccccgggctcctgcaggcctcagaaccctgagctgagggggtccgcacaaggccggtctccctgccgtcctctcatgccctgtgtttccctcttcaggctcgctttgctcaagtttacttggtgattgcgatacagccttggtttttagggtttcccattacagtcatgtcatttgagtttttatgtggaccgccactccgtgctccttgctgctgtaagacagtaaagtagaaattgaaacatagcctctgctctgtggaagaccattaaaactggacctcatgtacacgtttcttatgccagccggcgagggtagagggttagcgtctgaaacttaaaagttagggttgtttggtctgtgttgttagatgcatagctgggttggtagccgagatgtctaattgtagccgcctgatttctgttatttctaattgtagcagtttaatcattttgttttatttcaaatagaaggtgggattggctgagcaaacttagtttcatagataagtgctttttttttttaacgtttagcttaagttcaggaaaacaaaatactcagaagatggaccttttagtatgtgtgttcttgtatgttatgttcaagttttggtttttattttaattaccagctttatcttgagtagtataattttccgtggtggcacgccagagatttagggttatagaaagatgctctgtttaagactcttgacagggaagagctgtaaattgaaacagtggttatagttaccaatcaagccttgtacattaaaatatacacacgcaatttgaacgaaccgatggttcttaaaacagaaaatattggctgggcagtgtggctcgcacctgtaatcccaggactttgggaagccaaggcaggaggatcatcgcttgaggccaggagttgaagaccagcctgcgcagcatagcaagaccccatctctacaaaaataaattttaaaaacaaagcaaaaatgttaattggttcctcataaatttgaaatataaatgcacattttgggagtgtgttagaaagataacgaaagtctgattttagccttggttctgccactaaaggacactttgggtacttctgaacttcttgaacctaaatttccttatcttccttagtagcttcatagtttttggtga

SEQ ID NO: 124118 - DNA, 1232 bp, Homo sapiens
cagatgtgtagtgagtaaagcgatgatgatttaagaaaagtcagataacaggcacagtttgcattaatgtgttctaaagaggtaaggttattacatttataaaaattcagggctttatctttgtgcggcttttttttttttaacagtttcattacagtaggagcttgataaatgatcactctgaagtatattggattgaatttgatatttacttaattttttgcccaagacattgtagaggatgtaaaattggaatatttaaagatctaaactttgcctaacagtgctgtgtatacagtgcttagtgaatattctgctctgatattacattttgcttaggaattatttttctctaggtgtttttcctcaaaagtttttaatgctggttatgacagctcgattttgagcattttccgattatttaaacatgtaacaaaatgatttttgttttgttggcgattttacatgcaatcgccggaaacatggaaggaataaaactttaggattataaggtaaaaacaaatgtattccaaaatagcttcattggttttcatgtttgtgttttgtatagccatagaactggcttataggactgtacaggttacctggatccttaaattaaactttagacttttttccaaagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcaggtaatatagcaggagggagagaatagggagggcggaaatctgaactgcaagagatggtatcaaaaggcaaggaagggcatttaatgatctgtttttgaaaatggtttaatatgttttttaagccttattttgttgagaagttctattaggctttgaataggcacaatggtgtttatttgggaagtctggaagctaagttatatatttatgaaacacctaatcttttgataaacacttatgagaatgttccaaatgactatatagggtctttgattttgaaaatcaccctcaccaaattattttctagttttatttttccccttttacatttcaagctctcaaccacccatctactttaaaaatttttcagcctgggtgcagtgg

SEQ ID NO: 124119 - DNA, 1260 bp, Homo sapiens
tgtaatatgtccttcacatcttttgcccttttttattattttatttgttgatcttcttttatggagttgtcagagctctttattattctgtttaccagtcctttctcagatgtatgtattatagttatttttttcccagtctggcctgccttttaattttctcaatggtgtctttcaaagaacagaagtttttaatttttccgaagttcagtttatccatttttcttcatgtttatccactgtgtggtattaaagaagaaagcaatgtgtataagaatagctggttcttccgtaattaatgtttaataaccccattattctccgaaggcatctgtctttgcacacctgacctgctgttccaccaagaaagttccacaaacacttagcagcagccagcctaacctgtttttctccttgctttccacagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcagtgagtacttcgtgttttatgtttcctcccacttaggagtccctttgagttatgttcctgctctgttttcagatggatccttttattaagggagggagtggcactaacggtaattgtgtatcaaaatttgctttatctcacatttgggaaagggaagcaaagctatcttagtcagtgtcctcagtaaaaggctcttaacaggtttagaaatgtggtcatttgtgtttacatacctgagccaataaaatttaatctgactttcactgtcgttattattatattatagacatttccctgtatctgatatcgctaaatcacaatgttaggtagtctctttcccttatgctattttaggtctttagtcacaatatcagtataatttctggtagt

SEQ ID NO: 124120 - DNA, 1070 bp, Homo sapiens
cacttagctcttgtttttcaaaagatacttactttgagagaactgggcagttcatgcctgcttgttttcattataaatagttacttaggaatagggtggtggtggtagcttttcagagctcacagatgagaattgagtttgtctgtgagaaggctaagggcaggctctggagacagacagactcaaatcctggctcctccacttgggagccattgcgtcctgagcaagttgcactctacctttaagcctcagcttatttatccaaatgtgggaatactggtaacttctacctcagtgcgttatatgtattaaatggaataatctatataaaatgctcaacatgtgcatgatacttgttaaacaataaatgtgagcaattaaaaaaaagtaaagcctggttgaaataatcagatgtctgcataatttctaacgcctcatccaatgaaacttaagtaatttaaatagtcgtgttttctttttaaatctcttacagaaatattgtatccacagtgaatcttggttgtaaacttgacctaaagaccattgcacttcgtgcccgaaacgccgaatataatcccaaggttagatctattttaatgtatttcttttttttttcttttttgtctcctctgccgtgtctctatattttaatgtatttcacgctataaaacaaatgtctgtagatcaggccaggcacagtggctaatgcctgtaatcccagcactttgggaggctgaggaaggagaatttcttgaacctaggagttcaccaccagcccaggcaacatggcaagaccctgtctcttaaaaaaaaaaaaaaaattggccgggcttggtggctcacacgtgtaatcccagcactttgggaggccgaggtgggcggatcatctgaggtcaggagttcaagaccatcctggccaacatagtgaaaccccgtctctactaaaaatacaaaaatttgccgggagtggtggcatgcgcctgtaatcccggctacttgggaggctgaggcaggagaatcacttgatcctgggaggcagaggttgcagtgagcggagattgcgccattgc

SEQ ID NO: 124121 - DNA, 1043 bp, Homo sapiens
atgattttacttcattacgtattgataggcttgtaatctgatttattaattccattaaggtagaaaaggtttattggtttatttgcctcaaaattcatattaataaaacaaaatgtatcagagaagctatagtcatgataagcagcaaatataaagtagaaacagaagcacttgtatttattgagaacataaccaaattttgcaaacatttctcttgatggaatgctcatgtgaaagaacatacagatttggtataacttagtcacaattgattattttctgctccttatgcaaaggaatatttgttacatgtggtgtatgcaaatcctttacagatatacagaaatacagaacaaatattttgataactagatgtactatgtccttcctaccagttgtgatttttttgtcaatgggtggttcgcctaacaacattgagcagtttggcatgacctcactaatgattctctctgaccattgtagcggtttgctgcggtaatcatgaggataagagagccacgaaccacggcactgattttcagttctgggaaaatggtgtgcacaggagccaagaggtagccgtaagaaattcattcttctggtctatgggttatgaatgaaaaggtgatatctcattgtttttaggttattaggttagcactttaacatgttattattgctttcttataaaaaccattttaatatgattctattaattatttttatttatttatttattatttgattctattaatgttagatagcagtgatttcattttcttaaaaattagatatgggcaggcgtggtgtctcaccaaggcgggcaaatcacttgaggccaggagttcgagaccagcctgaccaacatggtgaaactccatctctactaaaaatacaaaaattagccaggcgtggtagtggatgtctgtagtcccagctacttgggaggctgaagcacgagaatcgcttaaatccgggaggtggaggttgcagtgagctgagatcatgctactgtactccagcatgggagacagaacaagaca

SEQ ID NO: 124122 - DNA, 1016 bp, Homo sapiens
ttttttttggtggagtcacctaggctggagtgcagtggcacaatcttggctcactgcaacctccacctcccaggttcaagtgattctcctgcctcagcctcccaagtagctgggattgcaggtgcctggcaccatgcccagctaatttttgtatttttagtagagatagggtttcaccatgttgaccaagctggtctcgaactcttgacctcaggtgagctatccgccttggcctcccaaagtgcttgggattagaggcgtgagccaccatgcctggcccacattctgcttttcttatgtaagctctgaactgctaagtcgtagtttattcaacaaatgacataggaatgtctattcatgatgagtcttggtataaaagaggatagaattagtgaatacattgttcaataataaatctcatcaacattttctgatcaaaatgaagtttgttagttttcctctcagtagaaatgcatgggctaaaatacagaaatagtgatgactgatgatggtgataattcacatccataaaatctagggctacaataatttggcggattgaaaggtcattttggcaggcctacagttttctgtcaaggatccaggaatactttataaggaattgtgaatgcctgtcagtcttttctcctattgcaagaaggctgaccagtttacactttattagtttactgttttggactttttataagttattagtctaaataagtattttagctggctctgagtatgaataactcacttttttcctttccctagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtaggtaagtctgaaatgtattatgattgttattggcaacagttcatttataatctaaacattgttcagaataaa

SEQ ID NO: 124123 - DNA, 1705 bp, Homo sapiens
tagtttgtttattcagtatttttccttgtacaggtcctcattttatctaaaagcacacaaagctcttgatttctaaactttttgcaattttccttctagttatgagccagagttatttcctggtttaatctacagaatgatcaaacccagaattgttctccttatttttgtttctggaaaagttgtattaacaggtaagttgtaacaggaagtagtatctgaaagtttgtaagtgttttgagtatggcattttctcagtgctgaaaagaaatttcagtgttcggacagtgggctagcttcttgtacaaaggcctcccacccaaagtctgatgagaaacgtgcccactaaaggcacagtgagagcagggaagtctgaccacagctctgcaagcagacttccatttacagtgaggaggtgagcattgcattgaacaaaagatggcgttttcacttggaattagttatctgaagctttaggattcctcagcaatatgattatgagacaagaaaggaagattcagaaatgagtctagttgaaggcagcaattcagagaagaagattcagttgttatcattgccgtcctgcttggtttatggcctggttcaggaccaaggagagaagtgtgaatacatgcctcttgagctatagaatgagacgctggagtcactaagatgattttttaaaagtattgttttataaacaaaaataagattgtgacaagggattccactattaatgttttcatgcctgtgccttaatctgactgggtatggtgagaattgtgcttgcagctttaaggtaagaattttaccatcttaatatgttaagaagtgccatttcagtctctcatctctactccaacttgtcttcttaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttataccttgtaagagtcatgtgatcatactgttttctacaaagttgtattttagatataatgcctgaaaccattttggtgtttgcttcagtcagtatttcattgtatgctgcaatgaaaacagattaatgatctgagaaccttccat

SEQ ID NO: 124124 - DNA, 1035 bp, Homo sapiens
gagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggctcattcttagtcccttcacaatatattcataggattaagttgccaacattaggtagtaaaagcatcatctgggagatatattttgatgccctctgagtcagataaactgaaataatcactttgaggtgattgagaaggcattagtggcacactggtacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatat

SEQ ID NO: 124125 - DNA, 1096 bp, Homo sapiens
gctggctggagggtcccacgctggggattcctcctcctcaaactcagcactgggagccccttccaagaccgcccaccaggcatcttgttcatggatggggatcacagccagggtgagtagcgacaccaggacccgtagtcgggccacaccctgccccacccacgcaccccacccccccaccaccaagatgcctccctgtcagccccacgggggccactctaggaccagaagcagggaaatgtcccacccaggaggggcccttcacgtccagatgaggtctcgtcataaccttcagcacctccgggtttgtgtgaaataggcggattgtctgggctccgatgtgtgggaagtgagtttccttccacgtgcaatgaggcagcccccttttctgtgaggaatgcattttctgggaactttgctgcaatgtgttctggctggtgtataaataattccgcacatcgccgccctccggtccttcctgggccctgtgccattctcattcccagttctcctgactcacacatggccgctgaaaaagacctcctgtgttgagcgggaaggccttggctgcagctggtccaggtcctggccgagcccaatggggcccctcctgcctgcagccctgtggctggagagctcgccgtcctcacgcaaacagtccagaccacagcggtggcacatcgtgagaatgacagatgggggatgagcaaggtgccaggggttttaaataagacggccgcgttttgccaaacacctaccccacggggctggaacaagtgacgcagaaatgggcaggaagcgtggaccgcgaactcggggaccaaaaggtcgtgccggagtcactgccagggagagccccgcaccttccagagctctgccggctgaaagcctggtattaaacagcttaatatatctcgctaatgacaggtggtggttttctgctgtgtgagtgatgagaagattacccaagatagaaaggctaatttttgcctccgtgccttcatttagtgagtcagggatctagtgtgtttggaggaataagaaagtgtctgtcttatctagttttgggcctccctgagtttggccctggagaagg

SEQ ID NO: 124126 - DNA, 1050 bp, Homo sapiens
cttcaatagctaaactgtgggctgacgctccctggagccatctcaactcggctgcccaggacccttccccaggccagaggccaggaccccacatacagggctggggacaggcggggtggacccactgcctggggtgctggagatgggcagggtggacccactgcccggggtgctggagatgggctgggtggacccactgcccggggtgctggagatgggcagggtggacccactgcctggggtgctggagatggggctgggtggacccactgcccaggatgctggagatgggctgggtggacacactgcctggggtgctggagatgcccggggtggacccactgcctgaggtgctggagataggcagtgtggacccactgcctggggtgctggagatggggctgggtggacccactgcccgggtgctggagataggcagtgtggacccactgcctggggtgctggagatggggctgggtggacccactgcccggggtgttggagataggcggggtggacccactgactggggtgctggagataggcagggtggacccactgcctgaggtgctggagataggcagggtggacccactgactggggtgctggagatgggtggggtggacccactgcctgaggtgctggagataggcagggtggacccactgcctggggtgctggagatgggtgggatggacccactgcccggggtgctggagatgggcagggtggacccactgcctgaggtgctggagatgggcagggtggacccactgcccgggatgctggagatgggtggggtggacccactgcctggggtgctggagatgggtgggatggacccactgcctggggtgctggagatgggtgggatggacccactgcccggggtgctggagatgggctgggtggacccactgcctggggtgtcgggtacaggcaggtggacccatggcccagctcccagcccagcagcctgttaggaaccttgtacaggggcccttgacaattctgcttttcttctggaaggtttgggaagtattcgcacg

SEQ ID NO: 124127 - DNA, 1033 bp, Homo sapiens
atgagccattcttggcctcagtttcccccatctgtacaatgggagaatggggcttggtctctagacatgttctgtgagatgctgtgagcctaatcccaattcctgtcagggtactgcaacatggccaatgtggcaaatgtgattctggaaatttcttgaaaacttgaaatccctgtgtgcccctgattgggttaaatgttttcaccctgttttcctcctatgcagccatgtgtgtgctgggtggttcacttggtcggtggtctcagtgtctgtctttcccttctccctgcagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgtttttttttttttttttttacaccataaagtgattattaagctttcctttttactctttggctagctttttttttttttttttttttttaattatctcttggatgacatttacaccgataacaca

SEQ ID NO: 124128 - DNA, 1379 bp, Homo sapiens
agttttaggggtgattcttgccggccaggccacctgggcctgggctgctcagagctgtgtttggtgagctgtgggcggctttggtgagcgtggtccactctcggcatcttgagctgggagcaaagggtgggcttggtagactgggagctattccccctctgtcccttgtctcaagaaatttgccagctcaggctttctgggggtcaatgagctagcacggctgccgtcttctctgtttattaagccagggctagagggtggcggggcacggggactgtgctctgtggacgcagaccacatgagtctcctgcgagccacttctggtcctgttatatttctctgggcctcagtttcctcggatgtgaagaagtgatagcacccaccgcacactcagaagctaagtcattggtaaagcagctaatgcaaacgtggctatcacaaggcatcggaaaatgggagctggtgttattgaattttctcctacgagtggagaacggacccgttactctttggtttggccatggcaagatggccaccaccaggatgtgattcataagtgtcactttttcatgaaaagaaatgctgcttgtaacagttggttgatgggaaattcttactgcatgagtagttctgttctgatcttattttgggtctcaaaaaaaattagtgtcattggaacattgagtcattttcggtaaaaagttgggctccgggcgagcttcgtctttgcctgacaccttctgtgaggtttgcgggcttcattttaaatccgcaggctcctcgggggtgcggaggaagctgaggtttctccggttggtttgtggatagtcacggatgcctcgatgggctggggagagacactttgggctgctagtcctgaacccaggaggtgcagagcccattagccgtctggattggtgaccgggacttcccaagcttcccaggagggggcagggagatctctgtgcctctggagcatcctggctgtgaggctcactgtctccgcgcctgttcacccttggttatatggtggggggggcaggatggagggagatgggaagagactccccagctgggaccagggggccaaggcaaggaggcccagagccacccgcggtgcccaggtgcgggcagtgtgtccatgggcaggactgtgggtcctctccctactgcgggatttggagagacctgagactcccccagcctgtctgctgtagccgtcagcgcctgtgaaggggtggtgtgtgcagctgggtggggtggcggggataggttctcagttctgctccccggtcagtgctggtcttggctctgggccactgccccacctgcacctggccgcctggctgtaaacacggctcgcagatgccagcttctct

SEQ ID NO: 124129 - DNA, 1048 bp, Homo sapiens
cccagagctgctgcgccaaaaagggccagagagccggtccccgcccccgccccggcgctccggccgctctccacggttcggatccagggccccagccttcctctctccataaaaggagggggagtcagtctttggggaaggaggggggcgggtttggggcactcacctggcggctgccacgcgcccccgcccaggatccgaggcctggggcatctgaatgaggaccctccacccacatttccacttgggagcgagctccagtcggggaaagggcctgcagcccgcctcgtccccaccctgggaccccgcgccccccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagctcagagcgcgatgcgggggaggaacgcgcgcggaggccgaggtctgagcgtggctagacggctcccacgccgagaaagggcgggtgcgcctgggctggatggatttcgcctccctagaccaggagggattggaccctgactacaggtccaggtgctcgtcagtgccctgccagggggtctacgcgtcctggtaccgggtccagcggggtggcgtgctgtgcagaccccgaggctagacggcctaggcccctggagcccaggagacgcttccttgggtgagcagcggagaatcccgcccggcccagccgtcacccccaaccctgtcgattaaacccctgcccccgtcgcggtcgccctccctccagacaaaggccgttaaggcgcagccccgcgggcggtctttcatccccagctaggccagctctagcatttcaaaggccgaatccggagagcgcttcgggggctctccccttcccccaaatatttggggagcgacgcctctccctccgctcccagtgggtcgcgtctacacgcgcccttccacacacctgcaggccccctccccacgtctct

SEQ ID NO: 124130 - DNA, 1034 bp, Homo sapiens
gagaatgaggaggacctgaaggacaagctggactttgcccctcccaccccaccccattaccctccacatggtgagtgaccgcggcagaggggagcgccaggaggcgagcccttgttgggtgggaaaggggcttctgagcctgaaggaagcttcagctcttgcagttctgagcccaggcggccgcgtcggaaaggtgcaggcgtctccccactgggctggggctcctgcatcctgggcagagcacgtctctcctcagcatctggagagcccccatgtgccttgcagtgacctctcccctcctctggccagctttattttaaaaaggctgtgggcttctgaaagtgtccagcgcactgccagatggtgtccgcccccctccgttggctgtgcacacaagggtgcattgaactctgggttcctgggcagctctgctggtggttggggggtgttggaaacagtgggatgaggggcttatcatttcaccaagacagagctcagcacgagggccacgggtgaggtgaggtcttcttcatggttccacatgatttccaacctgggaacagggtctcctgctgcgtggcctccccgcccttcccacatttgctccctggccatgttgcgggcacccatgtgcatctctccgcagagcccagcaggtctggctgagtctgagtggaggctcccaggtccagccccaacacatttgctctgccacgccgccggcccaccttgggcttcatctgtttagaaaccgccctcctctcgcggggctgagtgtcttccacttgcacgcggtcaagtgctttcatcacttgagtctatctgcggggcatcttcttaaaagtaaataatagatacgcactgacgaggacaaaaagtaggtgaagcgcagcccacatcagatgcccagcccaaatcagatgcccagctcaaatcagacgcccagctcaaatcacatgcccagctcaaatcagacgcccagctcaaatcaatcagatgcccagcccaaatcaagacgcccagctcaaatcaca

SEQ ID NO: 124131 - DNA, 1102 bp, Homo sapiens
gtgcagaggggctggtgtgtggtgtccactgtggaatcccacggtgcagaggggctggtgagtgtgtgatccactgtgggcttccacggtacagaggggctggtgtgtattgatcagcttagtgatgggaaggttgggtcactggtgtccgatgaggggtgtgtggtgaaccccacagctgggacacagcatcctttgggccagacttcactgcctgggaggcgtgtccggctcgctggcctcagggacgttctgagaccacacccggacccttgtacctttcctgagggctctgagcatgtgccaaggactcactctgcctaacacggggctctgtctggtgcacggctgtgtctgggaggccacggcgccgagagcaggagcccggctgagaccctcgggtttggctctgagttttctcatgtttctttctcgcagtgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgtaagagcacttgggagatgcgggagtggagaggaggagcctcccctgcccggccgtcagccatcgtaatgacatgtctgtgggttgccctgtgccgccaggctgggctgtcggaagcacccagcgacgtgtctgtgggtccgccccgtgccgccaggccgggccatcggaaacacctgcagtaaccggagtgccctcgctgatagcccttgttccggggcctcgtcctgggctgtgcagagctccagccccagccccagccccagctgcaggcggccgctcacgtttacattcgttgctgcccctttcttggccacacaccacagttcacgtgtttgatgactcaggaggcgtccatggccgggaccctctggcccatgctgctgggggtagatgtggggtccacgtcatcccacccctgaggagcgtggtcgcacgtccaccatcccat

SEQ ID NO: 124132 - DNA, 1074 bp, Homo sapiens
ttgttattcaccctgcagtttcttttctgattctgagatgcttgtgagagcttcagccatctaggaacgcatacgctgctgcttgaccacgctgtagcaggtagttctattttagttagtaaaataaaaactgatttcagaagaccgagaacattttgacacagtgaggatttaaaaacacatcttgaagagagctctgagtttctctccgtgtttcttggaaggtgcccctggtttcacgagtcagccactttagggttcccctggtctttttctcaggatatatgaggggactagattatgatagaagtgttcctgggcttgtaactatggaaacacttgtctcgtctgtttagaaaacactgctgctggccgtgtttcctgtgagttttgagggtgacctgagttgagttgcgtgtaggcagctcaggttgactgagacaggaatgcgctcgatttcctgcccgttaaaacactctgcatttctttcccgccctctgcagtatggtttgaagtggtgaacatggatttttctcggcttcacatgtacagtcctccccagtgtgtgccggagaacacgggctacacgtatgcgctcaggtgagtgtgcacctgcacgtggggtcctggccttgcaatgcccactcgctgtcgcggtggcgtggaccttaacaggaactccatagtactaccgactacatgctgtattttgaaggtgaaaaaaaataataaactgtatcttatggctttagaggtggttttttcttacggctttaaggtaaactgaatctgttcatcctggtgactgggtggttagtcatcgcacatggcttgctggcttcgaccccacccaggtggttgtgatgttgagaagatgtctctgtggtgatgcctggtgtttgtgagaacgtatcagtggcttggtatttttaagttaacagaaataacctggaaaattatttcccatttcaaaggaaacatcatagaacagcgttgaagctcagggttttgagaacacaacttttgtctgaggcggagttttctgcttttattcatattccgatccactgaacc

SEQ ID NO: 124133 - DNA, 1100 bp, Homo sapiens
gaattgtctgaagcctttagataaattctaaatttagaaggggagcattgacggcccgatcacttggcctcctctcctgcgtggattcattctacggcgcactggtgtattggattaaatctcacgtccgcgtagtgttgacgaggaaacacactctgatgtgtttatagcaaggacgtaggtggggactcagggctctagcatatgccctcaagcagttcttagggtgagttgtagacgctgggccccagcatctgggaatgtgctgtcctacatctgatgtgaaggaagagtggctggggcagatgtcaggagcccatgctggctgacctgtgtgccaccgtacgtttgctttagagtgaggttgtcacccagtaatagttgctcttgaaaatccacagtacattgcactttcagtttatggtttgttcattttgtttcagaatgggggctataagcactgcttacctctgatgagctttttccttctagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccaggtgagcaccgctgcacttcctctccatctgatctctaacaccagttaaaaccaagcttccatactttttggtctgtaaagccgcaccctgtctcgagcttaaggatatgtgtgtgtatgtgcgtgtacagacacacaaacctgtcatataaagtggtagtttgctgcaaataaagactgaaaggaactctggaatctgtgtggcttgtctagtattgatgttctgctgttcttgtttcaagttctcttcgctggtgcacgccacgtgcagtgccagcactcaggtctggaagctttgtggtcctgtggtgggagctcagctacagctgtcctaccacatgtgtaaagaggaaggaatcttacagattacacatgctgtcgtggacgatctccgtgtccagttcattcttttttctggag

SEQ ID NO: 124134 - DNA, 1043 bp, Homo sapiens
agctttcaccttcagtcagaagatggtatctgcatatatctggaggcattttaggaaataaactgtgaccagtgccataatgctgatttattaaccattgtaacctttacattttttaatgggttttgttcttatttgataagctgagctcaacagcaaaaatgtgtgtgtgtgtgtgtttttttttttaggtcttgatgatgatggtgatcttaaaggtaattattttagtccttttatcttcatatacttttcaaaatagaagttttagttaaatatctgcagactgtgataaacaggttccatctactgtttgaaaactttaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgcacacctttatttttataaaacggcacagatgttcacacatactgaaggagtggctttgggacgctgctctggtctgtcctgtgaagagtggttatgccagtgttcgtgtcgggaaaacatttcccgtggtcgctagccctgtgcttatggtgatggaggggccttcagagaacctgtaggtctgggaaggacacacgtgactctggtttgttctgggacagcagcagtcactgcaggaaa

SEQ ID NO: 124135 - DNA, 1075 bp, Homo sapiens
gctgggctcttccccaagtgattatctttggtgtccattctaaaagtgcctgaaatgaataatttggctacctgacttatcaggaagtagatattggctttatgggaagaaataacgcatgttcatggttttttaataggcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaaggtatttaaatattttttccctcctttttccaccaatcacactttcgcagtggagaaagtgctgtgactttcctcgccaggcgcctccctcgctgcctcctcctgtggtcttggtgctggctctctcctggcttccccctctggatcttgcatccctgggagcttgtggaacttttcgtttgttctgtgtgtggtttggttccctcagagctgatcagtgttgaaacatctttaaagttatttcttaaacaaaaagttaatgtgctcaacttttgatttttattacctttttaaagcaaaaactttacctgagtggtatttagaacctgttttttcagaactttttttctttttgagacggagtttcactcttgttgcccaggctggagtgcagtggtgtgatctcggctcaccgcaacctccgcctcctgggttcaagcgattctcctgcctcagcctcccaagtagctgggactacaggcgcacgccaccacgcccggctaattttttgcatttttactaaagtagacatggggtttcatcatgttagccaagatggtctccaactcctgacctcgtgatcgcccgcctcagcctcccaagtgctgggattacaggcttgagcaactgcgcccaacccagaactattttaagcaggccaatctttgtattgtttgggccacacacacgattcagccagagggtgggggccctttcacgtctcttctcgtggcccggg

SEQ ID NO: 124136 - DNA, 1028 bp, Homo sapiens
gcacatcctctgatcatgttgacttcatcagggtgcgagaagcacttgagcttggcgtcggtgagttccctaagcctcttttgcgtgtgttgcagctcatgccagttactatgggagaatgaatgtgagagaggttctcagagaggatggccacctcagtgtaaatggggaagcgctgtgtaagtatggcttcgttttcctgtgggcgtcggtcgtggagttggtcccacacgctgtcatgttgggtactagcagtagagaatgaacggcccgtgtgacatggtggtcctcactgatgacgacgggctgttggagctgctgcttaagccctcatcacagaagctcatagccaccagatcgcatttgctttgattgttgactgtctcgtgtgtaattgagtttcccagtttctacagactgccattgctatgcacggctgagatggacagagtttgcttgtgaatccgccacactcactgcctgtcaccacacctgcaggcgacgactgtaagggcaagaggcacctcgacgcgcacacagccgcccactcgcagtcgccacggctgcccggtcgggcagggaccctctggcacatctgggcatgtgcaggttgtctctcgccccgtctccgtctcatctcgccctgtcaccatgctatttgtgtcttgtgtggtttgtgcttggaattcaagtgctttaaagtcttgctgtaaaaactgacaggaatagtattaactttggtttaaaacagggtgaatctctctcgaaaagctcccttgtaaatattttttggaagcggagtctcactctgttgcccaggctggagtgcagtggtgcaatcttggctcactgcagcctccacctccagagttcaagcaattctcctgccacagcctcctgagtagctgggactacaggcgcacaccaccacacccagataatttttttgtatttttagtagagacagggtttcactgtgttagccaggatggtctcgatttcctgacctagtgatctgcctgcctcgg

SEQ ID NO: 124137 - DNA, 1025 bp, Homo sapiens
cactgctgtgagccaggcacttcagttgggtgtcctgttgtaagaagtatttttaaatgtcagataagcaagtctttggagctccttaagtgttctaggatagttcaaatgcacatttaaagtactctcatgattcagttagttttaattttaaaaacataatagtattcatcactgtacaaagtacagaaagtatagagaagaaaatgagaagcacccatagtcagccatgtaaggatcaaacctgatactccgggtttctgtggattcctccattcgtgtgccgtgcgccccagagctggcgtcttgctgtaggacactgtttggaggtttaactgactctgtgctcatgcttgtttgactacctggtttcatttctctcttgccatttcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggaggtgggtgctgccgggctaccaggctccatggtgacaccaacgcgcttctgggtgccatgttctctccttttgggagacagaggggacaggagaggtgccgttgtgaaaaggggttgccctttctgttcttagttgttgagagcagtgtgccggagagggagtgggtttcccgtcgtctgccgatgaccaggagctgtgggttccatagcgcacatggaagtggtgggcgggagacttgtgataaccccaagcgggaagtccagcggtcgtggagaaccgtggtctttcctgtcctgttctccagattgccctcttagtggcaggtcatggcgctctgtccctgcagacaggacagccgctgagatggacacaaaccgtctcgtgtgggtcccagacgcacttctcggaggcagcctgagat

SEQ ID NO: 124138 - DNA, 1057 bp, Homo sapiens
ttttctcatcagaccaagtttgttgatggcagggcctctccgatgcacctgtgcgcctcgctgcggggtgcccggtgggtgcttgcgggatggacacgcacctccagagggtgtggacatgccccactatgtccttcagctcctaggatgtgggtcgcacacatcccacgagctcacctatttctgttctttttaacatggtcctgcattattggaggggttattaaatttaatatgaaggaaaacactgtcacaatgacattctagattttgagaggatatataattcttctgaggtatctaagataatggacccgaacagtggaagtgatttagttaaaataggacatttgtgtccgtctgctgttttactaggtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcggtgagtcggcgagtcggcggcaagagatgcttacagtccattctgtgctgagactgaagacctagctgtgaggtgtggatgttgatgtcttgttttaagagtggtctggctggggtgtgcttagctgacgtaagtgagatgagacgtgcctgggcagtgccgtgtgtggagggggcacctgtgcggtgagcttcagctcttgctgtcagtgtcattactgagctgcttcttgggagttctttatactttgtgaatctttttgtcccaaagagcccatctgcctgtgtggtggccacaccttctgcagttccatgaaagtctctccgtgtattagtctgttctcatgctgggcaatttagaaaggatcattgactcacagttgcacatggctgcagaagcctcacagtcatgggggaaggtgaacgag

SEQ ID NO: 124139 - DNA, 1060 bp, Homo sapiens
tcacgagaacagcacgggagaaacccccaccatgactcagtttcccccacccgctccctgccacaatgtgggaattatgggagctgcaattcaagatgagatctggttgggacacagccaagccctatcactcagtaatacctaaattcccagaatttcctgtgttccaggcttgaatgctcatccttgctttattcgtgttttatggcatctgggggatttttctggttcaaagattgatggtggccatggctgagacctgggggaagaggcctcgtgccctcccatctccatctgatggccttggcagtcgggcgcaggactggagtgtggagttgacttctgccatgcctaggaaccctacatagtttccgttgagaagatgctctaatgtaagtgtctggtcctcatccatggcactaaaacccacgtctctcctctcctgttctggtgtttggtcttccgtccctcgtgtctgtccagcaagcacgtgccatcgtgaacagcgccttgaagctgtattcccaagataagaccgggatggtggactttgctctggaatctggtggtgagtaaatagacgttctgattactaagttagatgatcacctgttagcaggggtgtgcacttgagaggctgttgcctaccccacttccagcagtaaggactcctaacttttaaacatctgagaaagggagcatgattctgggcatgaccctggtgttctttcttcctggccagttgtgtttggggggcacaagttctcccctggaagggctgggggtgcatgcttgtggctaagtcgaggttcacagcacagaaagtgtgctcgactgttcactctctcctgtgctgtgatcggggattgttcagtgccttcaggagagactcagcagtgaccacacagctctccccgagggcgtccactcagcagcaagacagaccgagagcagaagcaggctaagcagatggaatgatgggggctgtgtttcaggacctcagagaaatacaaaggccgctgtggtcggggtttgggaaaccctgcaggggcacaagcct

SEQ ID NO: 124140 - DNA, 3329 bp, Homo sapiens
accctgactccccacaccccagcttaggccggcactcgctcccttctgcctgctctcttcccaaagtcggtcttctgtggcccctcctcctgctggtgaggcctcatctccccgggctcagcaggtgctccagagcttccactgtgagtgctgagggcagcagctgagcatggtctgtgtgtccggcggggtcacttctctgccactcattagtgtgtcctgttttggcctcagttttcctaatgtgtataacggggaatcgtgctgacctcaggacatgtcgtgggttacatgaagccctcaacaaaacacaccccttccttccagggaaggcctcgtgactgccatggaggaatgaccttctcttactgatgtggagggaaacggtcctgtttgcttagtgctggctgtggaagggaacggtcctctctgctcagtgttatttttccattcgttcataattgtgtatggtcttgttttcagggattagaaaatgagtatcaggaagaagggcagcttctgggacagttcacgtatgatcaggatggggagtcgctccagatgttccaggccctggtaagaactgggactggcactgcctggggtctctgagtcccacaacttctcgtgacagcagggcccagctggcatcaacagactggaaagcagcgtgaggaccatcctttgaaaaatgttaacctgcgcttcctggctctgcgttaatgagcctttccatggctaatagcgttctcagttttacccgtgcttcatgccctgtgatacattacttagaaggatcatatttaaaaagttaacttccagctgggcgtggtggctcacgtctgtaatcccagcactttgcggggccgaggcaggcggatcacgaggtcaggagttcgagaccagcctgaccaacatggcgaaacccggtctctactaaaaatacaaaaatgagctgggcgtggtggcgcacgcctgtaatcccagctactcaggaggctgaggcaggagaatcgcttgagcccgggaggtggagcttgcagtgagctgagatcgtgccattgtactccagcctgggtgacagggcaagactctgtctcaacaacaacaacaaaaggttaatttccaactcagctgcttcctgtcagacgtcatatttggggaagtgattggacttggggttattaatatgaaatacatgtgtgtgtttttcccaccttgatttcagaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtctatttcttttctcagtttgtctgtttctgcccctgggatgtgggagggactgggtttgctggttcttgttggcaagctctgtagcacagcctttgaatggtaacctgtcctccaaggccttgaggcctcaagtgtgccaggcacctctttctgtagggcaccatttccacttggaaaacggactgaattacaagttgcttgatgggcagaacattaggaaaactgatgcctttcctcaggacacagttttcatcgctgcttctgtagctgaaggcaggtgctggcaccaggtcacagacgatagcacacacaccacactattttgcacctggcttttccccagttaccaagtgtgtcccgtaagaacctttttttttttaacagctgtttttgtc

SEQ ID NO: 124141 - DNA, 1125 bp, Homo sapiens
actcgggagccctgctcttcttcagccatggccaggtaagccgtcttgcttcctcctgcatccctttctgctccgggcaggcaagtggaggtgggaatgacctcccacctccactgatgggcaaccttgcgctgccctgggcctcggccactggggctgtgggtggcagaggggcccagagtcccccctggcttggctgctccactctcaagactggggctctgcgctgcgtttgtgcacgatggggctgagagggcgttgtgttggtataaacgtccccgtccattttcatgtgattctcggccaggagctctctttttcggcggcattgccaagggacgtggtgctcagaagagactcctcagcaccggccgcactctggcttctgctggaaacccagccttgtctttgctgtcctgaacaggtcagggctttgttcttgattcttgtgtgttgctttctcttgtagcaaaacagtgcagcagacttgtccatgctggtcctggagtccctggagaaggcggaagtggaggtggctgacgagctgctgggtgagcatccggcccttcaccccgggaccctgtgacagcggccccagtacgcccctccccgggtctctgcgctgtgtttcgtgtctgcgtttgggggtcttgtgtgctgtggggtgaactctgctgcagaggcagttcccacccggtctcagtgagccaggccccctggctgaccctggcgcgagcacacggcaggctgagcaggacctgctgtgattcgtaggcagggcatgactggggccctgtcctctccactgctccgatggacagtggcctccccgccagctggcaaggtggggcaccactttggcttgtcggcctgtcctgtcgggtgacgtgcggttggcagagcccttctgtgagctgcctggctgcaagtcccactcctagtccctgctgctctgggagatgccccgggccagagccaggtacccagagcggccacagctgttcctggactccagctccccacggcaccttccccagcccccgcctcggccagggcgtccgtccttccttcctcgctgtgctctggggcatatggcgctggaactgcggtgggcagctcagtgtg

SEQ ID NO: 124142 - DNA, 1022 bp, Homo sapiens
aggacgggcttgggagtggtgtgtgttcatgagatgttgagggttggttgttgggtcagtgtggtgagaacatcaggctggtttctgctgttgatctacatccgaggtgcactggcctgggccctgattatattgcgccctgtaagttgcttctggtaggtgagaagggtcacatggtaacactaattggttatcacaacgaacattagtgcagttggattaagcagctccaagagcttggagaatcaagatgttgcatagctgagtgacttttccccgtggatctgttgatttggtgctgcgtgtgaggcctgggctggctctgagtccctatcaggacctctgcctgtgggctctggctgggctctcctccagggcgggcaggtgggctagaattaacatggagtgtctttccccctttccttttctgtgttatattcgtgaaatgtatttacatttttctgtctttcctttgcagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtaggtgtctgtggctcttcgggtctcggcttccattgctgccttggctgggcagccttagaacaggtccccttgtcccctgtccgagccgagctgcaggataaactgagttcactctgggcagagcccacagtgcacttgtcagcctgacccatgatttttcataagtttaaccaatgttaagaagtattttagaaactccccctttcccgacgggcactggagtgccctacacacgcccctcgcctctcgcccactgccgggaggccctgtggtctctgctgtactcaggcctgcctcggccagttctttcccgcactatctggaaatgcgtggaattgtgagcatctaccccgcggcccctcccgccagctcgctggggcgtcctgcaggccaggctccggg

SEQ ID NO: 124143 - DNA, 1222 bp, Homo sapiens
gcaggtgagtgttgggcgcgggcgcggtggtgtgtgcaggtgagtgttgggcgcgggcgcggtggtgtgtgcaggtgagtgttgggcgcgggcgtggtggtggttgcaggtgagtgttgggtgtgggcgtggtgtgtgcaggtgagtgttgggcgtgggcgcggtggtgtgtgcaggtgagtgttgggtgcaggcatggttgcaggtgagtgttgggcgcgggcgcggtggtttgtgcaggtgagtgttgggtgcgggcatggtggttgcaggtgagtgttgggtgtaggcgtggtggtgtgtgcaggtgagtgttgggcgtaggcgtggtggttgcaggtgagtgttgggcatgggcgcggtgtgtgcaggtgagtgttgggcgcgggcgtggtggtgtgtgcaggtgagtgttgggcgcaggcgcggtggtttgtgcaggtgagtgtggtcctgttctgctcacccagcacatccctgtgtgtctctgtcccagtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcggtaagccggggcgcccttgtcacacccactccagccctgggtcggtgtggggtcatcatctctgcccaggcaggtccagtgcggtccttcacgtggaagtggttttctgatcttttaaatgtttctcagtttacttttgttagtaggaaattattagatttcagagttgagaattctggcacggtggctcgcagccccgtctccactccagagctccccatccctgaggtgtcttccatttcctggcagggatcacatcacgtggctggctgcgtgctcccccgtctctctgtgcgccatgctaggtggcctccgtgagcctggtgtgcccgggacgctgccagccgtcgtgctggggcaggcagtgctgccgtggctttggggtcgcggcggggcgggtgtctcactgtgggtggtggttcgtggcaccgcgggagaggcccctcactgagccgcctgccttcccagcgtcacctgtctgggtttattttagt

SEQ ID NO: 124144 - DNA, 1087 bp, Homo sapiens
gacctcaggtgatccgcccacctcggcctcccaaagtgctgggattacagacgtgagccaccatgcccagcgaggtgtacattttgaaggctgggagctgcagggggcacccacagaaccacagcgtgccagggcctggcgagtcatgtgagccagtgttcccacctctcctggtcacaggagactcgtgacgcgtgcccgaccctcacagccaacccagctccctgtcactgagctgttccgggcacattagccggggtcctgtcctgcgcaaggttctgggctctactgtggacgcccctcccccgccgtcgccacacctgcgtccgagtgagggggatggcctgggccccatgtgcctgcctggacgcagaggggttctgtgggagcctggcctggcccaggcgggtggagccttcgactccttgcctgtccgtggtctcccgcttgcctctgtgcccagagacttccttttcctggctgccgggctgtctggggaagcagggcatcctggaactggagaacaatggcctggcttctccccccactgggcaggcccgctgtgccttctttcccgtcagccatgcactctgctgacttccttcaagggaaagaggaacggggagccaggtgatgggagacttagaggctgggagagaaagcccagatgagcctcttcagaagtgggctcttttcctacacgaaagcctgagtttgttgtggcggcgatgaaagattctggaggctccctcagaaggcaggagagaccacagagaagggccgcctgccccccaaccccatgctgcaggtccctcttgggccaggcttgaggaacagagctggcacatgccctccagtcacccgtttcactctgagcactgcctgcccggtggcgggggtgatattcagcttccggggcccgccactgcaccctcagccagcagggaccctgtgggcctctcctccaggccagccccacccttgcactgagagaccaccagcttgaccaccagcttctcccccagttcctggccaccctcccaggccaggccgtccctggcagctgctccttcctggctcccccact

SEQ ID NO: 124145 - DNA, 1044 bp, Homo sapiens
ctgcactctgctcccgtgatcagactccccggaccgtcacgcgggtggcacctgtgcgtgtgcagcctccgagcctggctgtccccgtgcctcctgcgcttgagatggtgtgtcacgtcgtgcacaccaggtggccgtggctgctcgccactgagcacggggggctgtgccgcggtctgtgtcccgccatcgtgggagcgacatttgagttctttccagattgtgtctattataaagctgctttaaatgttcacatacagggtttcatgtgagcgtaattttattttgggtggatcgctaggattgggcatcgctggttcttacagtgtgtgcacatttagcttcatacaaagctgccaaagtggccactctgttttgcgtttctgccagcacctgtccttctaaccccagggaaagcaaagggtcctactgagccctggaattccctgggaggaggggttggcccttcacagtctgttttggtggccggtttccggccaagagccaggggcttgtgggactcgttcctgagccacgcagaggggctgccaaggtcaggttcggggcctgggggaactccccaaagccgggaccttgagaattgtgtgttcttgacggcagcatgggccctcgctgcttaaacaacccttcagagaggttctagaaagcatgggcgccacttctccagggctgcttccccagagctgggaggccggggactccagtggtgagggctggtggctcctgcagggccctggaccctctggagggcatctgggagtcacccctgcccctgagccctcccagcccccgccagggcctgcctgccacggggcccctcagaggagctgctgcccctgccacttcccgtcacacgtctacattgggcagggaggggggttgtgcagattccctcagcacgctggtttattgaatgttttcccggcctcttcctgggttttattatcatttttaatggataagtagttataggctgtggtggtagctcacgaaaccgtctccccagcgtagacagttgagtgg

SEQ ID NO: 124146 - DNA, 1041 bp, Homo sapiens
tccaggccgaaggggtcctcaggcaccgccagccccggctctccaggcggaggggtgggtcttcctcagaagggaacttcagcgaatctcactcctacttctaggtgtcgttttccctctgtaatgttttgaagtggtgagattgaatgctgagtgatcctttgtccgctgagtatgagtaatgcggctgctgcagcctgaggcgtggttcagagacctgcgtgggctccccccttccccctcccccccaggagagctggtgcaggcagaggactggggtgctgggcctccaggtgcactcggcccctcgggacctgctccccgccaggagagctggtgcaggtgcaagagtggggtgctgggcctccaggggcactcggcccctcgggacctgctggggctcaaggcatctgtgcaatagcaatttaaagtctttcagatgtgtattttaggaaatatacacacatttcctaaacagaatgctgtgttaattttttaatggaaaaatactaacgtggagttttcttccagcagtagaaagttgacaactctaatatgtacctttttgtatttggatgataaagagctgatttgctcttagacattttttgaccagctgtgaagttgagatgatttcagcattaaaaatgcctgagacacaattttgaaagatgtgagtcatgagaaagtacagaaaaaaataagtaaaataaaaattcaaaccttgaaatagctgagacatgtcacttaaaaatagctgcaccctgctagtgcaaacccatggcttctggtctctctgcccatcccagcggctgaggaagagctcagctcccaagctctccactcacgtgccctgggtttcctggggagcctgccctgggcgggcgagtggccgatactcctagatttcctgcttgcagcatagagtcagcggatcggggcatctgggtcttggagcgcagccttctcctgtgggcactgggcgggtaagtaacttgtactgtacagctactgatgtaagagacagggcccggactgcag

SEQ ID NO: 124147 - DNA, 2642 bp, Homo sapiens
tcagaaatgtttcctgcagcggcaggcaggtgcagcggcaggcagggttggcggggaggagctgggtgacaggctggtcaccgctggcctttggaccctgcggggcgagcgctttgggattgtagcaattctgtgtgaggagtgcaaggtgaccagtcgtgaggtttcctaagcagccccagggtgaccaggcaagcgtgaccctcgcgaggccccgaggagccagaagccacatctgaccgcagtttagagacatgacgtggccgtgccttgtgtccacccaggtgtgtgcagctcccgagtcacaccctggctgggcctatgcggccaaggctgtctacacggcactgctgaacctcacatccgactgctcggtgctgtctggaatgacggccttcagggcagcgtgacagaagcggttcagggccggcaaatttgttttctgctcaatgtacagcctcagcttgtccctgaaggtctccccgagaaagctgtagatgagggggtttaggcagctgttggagaaggcggcgaggttgacaatgtggcccgtgagggggtgggcatggcggaaagactgcttgcagggagcggccccaggctgcgtccgctgcaggaggtgcacgctgatgaagacgttctccggcagccagcagacgaagaagaccagcaccaccgcgaggatcatgcggagcgccttctgccgccggggccgcagcccacggtgccggtgcgccctgaccagcacccggacaatgagggagtagcacaggccgatgatggcgaagggcacgatgaagcccagcgtgacctcgagccactgcacctcccggacatccgcgaaacagaagcaggcctcgtcggtgtgctgcaggtgcacggcggtgaagggcaccagcgtggctgacacggatgccatccagatgaggccacagctcagccgggcgtggtgcttggtgcggaacaggctgcagcgcatggccctggccagggcgatgtagcggtcgaagctcatccaggtgaggaagaagacgctgctgtacatgttgacctgcaggaagagcgacatgaaggtgcacaggacggcgatgtcgtagtaccgctcgtgcaggttgaacacctcaatgagggagtcggccaccaggatgaggtccgccaccgccaggttgatgaagtacaggtcggggatggtcatcttctcgcggaagctgatgttcaccaccaggatcaggatgttgcccacaaagccgatggggaagaggaagatggtgtagaggcacgagaggaacaggccgatcacgtactgctggtgctccgagagctcacctgtcccattggccagggcggtgcccaggagcgggtgggacaggttgagctcgggggaggtggtgttgggggccgcaggctgcgcggtgcctgggtacatctccaggcccacgccccgggcttgggaagtcacatccatgtctctgcaccgtgcagctttcaagatttgccgaaaggctcccagagctctgttttaaatggtgaatccatctttagaaagaagcgtgattctccttgaagtgagcctggcatttgtcagacaggaaactccccaggaggagcacctgtggtggtttgggttgggtttgttaactgcagagagtgggaagaacagatgctcctcacaccggcatggtgcatccgtggaggcgagggccctccgcgtgctcgtccggcgggcgtccctgcgggtgtcggccaccgtgcacagtcccgcgtggagctgctcactctctgggtacctggagaagcaacaggagaggatgaagtctcatcgagtggccccagctttgggacaaggcctggctcccctggccgggtgtctgtagagtctgggtgtgtcaggagcactggggagggccagaacctcagctttatgagctcgggaggtggctgtggttgagctgaggtggaagagtcgcctgtgggaagtacatggccttctttcctgcaggtcccacggctgctcagctgcagctggaggctggacgtgagtcactcccacaggcaggggtgtttttccctttatagccacagagcaggcccaggaagcaatgaaggtatgggcacggccgccccaggacaacggcatttgtgaggagaggggaaaatgcatttcagcagctgatggagaagtaagataggaagggaaagccagtgtttctgagagagagagagtgggtccagaaagctggacatcagagcagaatcttctcttacgataaaacagaagttcagcggtttcctcatgctagttctgtgttctaggtaccaaaaataaacttattttcgtaatatagagtgaaaggggtcattgttttgggaaataatatgtacgtttttatttcatgttttaacaaattattgtaaaacctaatatgtttttgcaatgctgtttgtaacctaggaagaaactccagggagagagtccctcccgagcttatcctctgcagagagggagaagtgggctgtccgcccacggcggtgcccgggctctgccgccagtggggagggtcccgtcacccaccccgtgtcaccctggctctgccgccagtggagaggtcccgtcacccgccccgtgtcaccccggctctgcc

SEQ ID NO: 124148 - DNA, 1012 bp, Homo sapiens
ccgcccgggaaggagtcctgtggagcgtgagatgtgaagtagatgagctccgagtccctgcccagcgctgccatccgattccagctgttctgcatcctgtggggcgtggtgacccatcagcacctcgtgatgcttacagaatcttctcagtgtggacggtcgaagcaagtccgtgcccctgccatgtgggtcgcacacctgctccgaacaggaacagcaccagcctgcagagaacaggagcagctgctgctgcccgggcggcgccttctgggagcgggcactcctggctttcagggcattggttgctgggggacagtgtgaaaacacagtactcagcaagccagtgccatcagggcgctcactcgcactttctcttaaagcaagtttatgtttaaaataacggtagattcttagtaaattaaaaaaaaaaaaagcatgaggggcctgtgtggcctggcttccccaggacatcgacgtggatgcctcgcacagagctcgtccagagtccacggttgtacgtgcgggtgtgtgcgtgtgtgtgcgccctgcagtttttccaggtgcatagcttcctgtaaccaccactgtggcggtcaagatacaggaggatcctgcactgcacggctcctggtgctgctgctttatagacccttattcatccacggtgcaaagaacatttggatctctgggctttggcttttgtgagtaaagctctgtaaatatgcctgagcatacgtttccatcgctctggggtaagtgcccaggacgtggctgccgggttgcatggtgcatgcatgtttagatgtttacgaagccgctgcgcttctccagagtggccgtgccgttttgcgttcgcactgcaagcacagctgaggccggaccccgcaccctcactggcacatggtgtgatcgctttttcttttttttttttttttttagccatttggatcacagcactcccgtttcgaagaggacagccgattaatgtcctaggaattaggagaagcagaat

SEQ ID NO: 124149 - DNA, 1923 bp, Homo sapiens
agcgttgggaagcgacctggagctggttccttagcctttggaggagctggcagcgggaagagggcctgggaagccagggaatgcggtctcggtggagcccggttcaccagcaggggtcggcagcacgttccttccgagggagctggcggagggagctgccttcagctggattctctgcaaactgcatgcccctgtggccagtttccgggctactgggagggttttcagatggagtgtgggggctcaggggctcatgttcttgtatgtctgggagccagtctcccagtgaaatggggtgtctctgctaatatggatatttccttgctgactctccctggttctcatgggaaattgttttaaaaaaaaaaaagtttcaagcgttttgtgaagctgaacccaagtgcttaggagggtgggcggctgggcctggggagcagcattcctgggctccgggggagcgtgtggaaaagtactgcgctgcttccctcccctcccccagtggatcctggatgaacctccggaatccaccatcgaggatggagaagcctgtgtccccccgtgggccattgtgttgtcctcccagcaacgtccgtctggggagcctgcgggtcagcggccactcccggggccccgtgcagcctcttcccacagcatgagcactctgagcttgcgccaggatcgccgccacgtccccaagtgatgggaacttcatcgccccttggggagtgttccttcagcgttccggttcccactcaggcctgtgggcttggcccgggaagcctcctgggccgggtgcactcactctcccaggcttcagtccctggtgcctctgtctggcgttggtgaggtttggccgttcctcggtcctgggcaccagggcctcagggtctcggctctgggtgttgtttgctgagctccccatcccggagggccctgctggcctggagtgctggggaggtgggcggcttgtggtggcccggcaggaggaacagttgctcccatgggcctgtctcgtgtcttggtgactgggctgtatgattgcccactggtcttaggagggactggcacctgccgcttctgtcctcctcagctctgcgggcaggaggttctgccgctggggttggcgccttgggcctttcctcttgtggaccagaggggtcccagggtttgccctgtctgcttcctgtttcatagctaagccctccccggggagctggggtttaggagttctgttttcacgttcctttaacccttccaggcctggtttcccacttgagcgggttgtgaggatgaggtttcaaatgacacatgtccttcgggaggactgtggggccccggctgagccaggcctgctgcccagcatcccttggggtcggcggacatggtgggaggtcatgtgactcggcaggtctttctgtctttcaccctccccctgcctctccagtctcactaaaggggacccttagcttctctgtttctgtctgaagccacggagccgtatgcgggggaaggcggcatacgcgtgaccaccccatgcagagccagccgagtggctgctggtgtggaggcccctgtgatgacctggccgcctccctgctgctgtcagtgctgtttggctgcctggaaatggaaggtgggctccctcagtccactgctgtcagcatgtcagcagaacccccctggcttcctctgcctcgtaagaatcccttatgtgtgcaacactttccgtccccacgagcatcttgacagctgattcttagcagcctggaggtgccaggggcagaggcgtgggtgctgtgctggtttcagtcacctggccagctggtcctggggaagagactcacccctggtttctgactctggttacctcatggagcccactagcagagaccaggatcccttcctgtggctggctgcgagccg

SEQ ID NO: 124150 - DNA, 1001 bp, Homo sapiens
gtcatggcactcttgttgaaaatcagttgacagtaaatgaaagtaaacgtcattttccataacaaacattcattatctcaaagcttgagtcactttcccttagaactattaaaaggaacctttccataatatggaaaagtcttttatcccttattagcaaatagacatagtgattaagtttttaaatgataacttacagaatgaatatagattttacttaacttttatagtaatgggtgtgtaaatatttgctgaacttttcttatttctctcacaaggtaattggctggcatggtctcttgtctttccagagcccctgtgtcaacagtatctcattcttccaagatttcttattacatagctaattgaaatctgtagcctctggcttctgatgctttttaaagataaggctcaattaaagaataaggggcttggggttttctgattccacaataggaatattcttccaatgtgctgttaccagtgatagccccgagtgggatggggggaacccttgtgcaggctctgccttttggacagggcctttgctctttgactgtctccttggtttctggcctcacctggcatcccaggcctgtcttgacctcccctgactctttttcacagcgaggggtatttagaccacacctgggccctaggtgggctcaatgctgccaggccctttccatgatgatcatgctttttaaactgctgctcttctgtaacctatcctgctttactcttttttttttttttttttttttttaaacacaaggtctcattcttttgcccaggctggagtgcagtggtacagtcatggctcactgcagcctcgacctcccaggctcaagcaatcctcccacctctacctcctgagtagctgggaccacaggtgtgcaccaccaagcgtagccaatttttaaaaaatgttttgtagacgtggagcctcgctatgttgcccaggctggtctcaaactcctgggctcaagcagtctgcccac

SEQ ID NO: 124151 - DNA, 1044 bp, Homo sapiens
tgacagtcccacccaggccctccctgggctccaacctcttctaagcagctccccaccctccctgggtgtcccgtggcccctcgtggggccccccagtctgctccttcaggttcctccactcccagctgcagtgctgccccgtccagtagacctccagggctccattcctgcaggcactgcatacctactgtgtgctgaggaaatgcctactgtgtgctgcacgcctgttatgtgttgatgacacaattgtcgtgtgctgaggatttacctactgtgcgctaaagatttatctactgtgtgctgaggatttacctactgtgcgctaaagatttatctagtgtgtgctgaggatttacctactgtgtgctgaggatttacctactgtgcactaaagatttatctactgtgtgctgaggaaatgcctactgtgcgctaaagatttgtctactgtgtgctgaggatttacctactgtgtgctgaggatttacctattatgtgctgaggatttacctactgtgtgctgaggatttacccactatgtgctgaggatttacctactgtgcgctaaagatttatctagtgtgtgctgaggatttacctactgtgtgctgaggatttacctactatgtgctgaggatttacctactgtgcgctaaagatttatctagtgtgtgctgaggatttacctactgtgtgctgaggatttacctactatgtgctgaggattcacctactgtgcgctgaagatttatctactgtgtgctgaggatttacctactgtgtgctgaggatttacctactatgtgctgaggattgacctactgtgtgctaaagatttatctagtgtgtgctgaggatttacctactgtgtgctgcacacctactatgtgttgctgacacgattgtcctgaactgaagctgaagctatgcttactgtgcgctgaagatttacctactgtgtgctgaggacactgcagggaccacgacagacacattcctgtcctcacattgctcacggacaggcagtgaccagatacacacatg

SEQ ID NO: 124152 - DNA, 1512 bp, Homo sapiens
gaggctgggcttcgggtgggggccccagcccaggtgttcacagtcaagccgccgccagagcaggcctgccttcagccccgggctgggaccggccagtggcacgtgcgtcctgccttctggataggggcctagggtccctgccgttgccgccaaccatcacgagaccaagaggtgaaggggccttgatgggggctggaccccttggtcacacacctcccacctttcccccggtcagaccaacctgcagcggctgatgagctcggccgaggagtgttgccgcaacctcgccttcagcctggccctgcgctccatgcagaacagccccaggtgaggccaccgccggcctctgtcccgccgccaccgctgggccctgctaacccaggtcaccgcttgacccgcctggtggccagaccaggcttccaggcggctcagctcgccctgtcgggtgggggtctggcgtgggcacagggtggaggttcccactgaagtgtgtgggtctttcagcattgcagccgctttcctgcccacgttcatgtactgcctgggcagccaggactttgaggtggtgcagacggccctccggaacctgcctgagtacgctctcctgtgccaaggtgaggactggccccccgcccagggccctggcagccctcggggaggccggaggtgcgtcccccgagggctggctcttgggagtcccgaggtctggtcactgcggccaggatgttgtggccagcgtgacgtgcagggccccgtttcccccacagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtctgtgtgctctctggtgtcccatgtcgccctctggccagtgagagcctcaaggaccctggccttggcttcccagccccacagtgcagggagttgagcagggtccggggtggtggagaccagggccaggctgggctctcccttgggccagcagttcccgcaggtgttgagggtcgggggatgctgcccacttggccgcccccgccccacgtcatggtctccctgtcgagtgccggccctgggccctgccgggcctcaagtcctctgcccacggggtcggcctctgttgagtgagtccggccttgtcaggctgcgtgggggactggcccagc

SEQ ID NO: 124153 - DNA, 1016 bp, Homo sapiens
gtacccgcttccccaccgcaggccggaacctgcagcctgtcttctgctggtaccacagagggcagctgactttctctaatcatttctgcttgtggtttttttcacttatatgtcattttatttgttgaaatcacacttgatgtgcagttttgtggagggtttttgaggcagggtgtctgttgccaaggctggagtgcagcggtaccatcatagctcactgcagcctcaaccccctgtgctcaagtgagcctcccacctcagcctcccgagtagctgggatcacaggcacgtgccaccacacccagttactctttttgtatttttgaaaatagagagggctattttcattgcccaggctagtcttgaactcctgggctctggtgatcttctgccgcggcctcacagagtgctgggatggcaggcgtgagccactgcgcctgcttggccgatgtgtagttttggcttgtttcccgctcattgtatcatttggtgtggagctttgcttttattctgtatggggttttcccagaggctggctgtggcctgcctgccctcccgaggtgctcatggaagccgtaaggagccagttcctctgctcatggcgtgccacgcggtggatcacggccacagctggcggccaggctgagtgtgggtgggcaagtgaggggagccagcggccccggcctcagagcgcccctccctgcagctggacggactcatccaccgcttcatcacgctccttgcggacaccagcgactcccgggcgttggagaaccgaggggcggatgccagcatggcctgccggaagctggcggtggcgcacccgctgctgctgctcaggtgctgtcccagaagccctgccctcgccagacactggtttaaccaggggggtctgcggctctccagcctgggcaacaagagcaaaactccaaaaacaacaaaaaaaagcatgttcccatgggctgagcttgaccgggggaagtcaggactgagctgggcctcaggtgggaggagct

SEQ ID NO: 124154 - DNA, 1056 bp, Homo sapiens
gggtccccgtgtgtcctctgccagggtagccacgtgccactttgtccccgcagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatggtgaggaccgcgccgggctggcagacggctggggggcactggacaggggctcactcagagtggccaagctgcctggcaccccgaggcctgggcagtggcttggggggtgggtacccgcgtgggcccaggggagcccttctaccgtggggcctccctggatgggatacaccgatggggtgagggctggagccacagggcactcacacagacctcccacagtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaaggtaccttcctggcaccatcctcttgggccacggcggccctgggaagacccaaacctgaggctccttctagctgcccagtgggggacggacagtgtctgctcagcactgtccccggaaagtgcccacagaggtcccctcccagatggctcagggcggggcctcttgagaatgagttggagcttcctccttggggggcccctgatcactgctgcacccagcaaagtgagccccggccccggccgcactctccagccccggccgcactctcctctccggccccggctgcactctcctctctggctccggctggactctgctcttgtgtcccacacatgctcaccccacaccccaccctggctagcccacacccactcagcggcccccacccgacctgggagtgacccacatgtctctttgtcccttgcgcagtcctccaggggctgatcgaggtgaggtccccccacctggaggagctgctgactg

SEQ ID NO: 124155 - DNA, 1018 bp, Homo sapiens
ctgcccccttgtgcggccccaggtctcgggtggggtcaccgagcccacgtggcccagggtctcaggtggggctgccgagtgtgcactgccccaggtctcgggtggggctgccgagtgtgcactgccccaggtcttgggtggggtcaccgagcccacgtggcccagggtctcaggtggggctgccgagtgtgcactgccccaggtcttgggtggggtcaccgagcccacgtggcccagggtctcaggtgggtggggtcactgcacacaggcagccccaggtctcgggtggggtcccgagtgcgcattgcccgggttttgggtggcgttacggagcgcgtgcaccctcagccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagagtaagatgccagggacctgcggagtgggttcacacacgctgaccgagccccagcccggccaggcttttggggcctgggtgcgagcgggtgggtgatccgaggtcgggtgggtgtgggtggcactcgagggcaggcttagacctgtgggttggtgaggctggcacagtcaggagggagccgaggcctgggcctgccccaaccctggggccaggcaccccctagggccgtgttttgagcttggagggagctgttggggcctcagtgctgactgagctcacccagcttctgaagtccttgggaagtgctggtgacggtgggggcatctccaactctggtttctgtggagagggaaggacctgctccctggcccctggccgcgcccaggtgtgaccctgctacggtttgcagattacatggcccacctggtggaggtccagcatgagcgcggcgcctccggaggccagactttccactccttgctcacagcctccctgccgccccgccgaggtactggggaggggtg

SEQ ID NO: 124156 - DNA, 1048 bp, Homo sapiens
ggttcgggtggacgtgggtgggtggtgacccctgttgggaggcagacacagtcacaggcgtcgcccttgggaagggcagccggagaagctggccctgtgtgggcctgggcctgtggggtttcccagtggctttgcggagccagagagctggatgggacctggtccagccaagcaaagccccgagggcaggggctggatggggacacgcacatgtccccttggccacgacaaaatggcagtgatgctgcttgccttcctgcagcatctgtgaggatcaaatgcgtgcacctacgcaaagcatccgcacatagcaagtgctcacctagcacaggagccccgtgctcctcccaagtctcagtttccttctcgggagaggaggtgcctctagccttggcaccagcggtgcttggggctgggccccggtgggtctgaaggctgctcacccgttgtccttcctgaagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccggtacggtccaggctgggcttgggcaggggctgctgactcaggggtcccgggccccttgcctgctccttgtgggcctgggcagcctccggctgtggcagaggagaagactggccgggtagcctcaggggatcctgcagaccatatgtcctggccacagcaggctgtgctggaccctgggaggagacctagggcagcctgtgctggccccgtccgagagggtcttactgtcaggctcaggggtctagagtgagaaacaggtcctcgatggaaaaaagagaaagtggtctggggttggagaggaggaggagaagtggtggggcctctgggtgggtccctgaaggatttgggggttggagctgcagccggggaccccagcaaggactgagcaaggggcctgggcccacgtaggtcagtagggctggtgc

SEQ ID NO: 124157 - DNA, 1050 bp, Homo sapiens
cactgcagcgccctcgggcgccatacctgttggtgctgcgggaaggggcctgtgacagggacagcactgtcgggcagcctcccacgcggcctctctctgccccagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggtgccagccctcgccgctggggcgcctttccctcactgcgggttccacgcgccgccatccccctcgtcctgggtcccatgcacactccaccccttcggatgctctggctgagcgtgggtacggggatgagtgaggctgtttgcggtgacgcgtcccagagggtagcataggctctgtcctgtgtgaggacctatgaggggctgaccaagcacaggggaactggcaacccctaggctggatgggatgaattgctgccggcagcaaggggagcacgggagcagggaggcagggtggggctgcgggctgcctggctgggttggagacttttcgagggctgtggagggagctggcgctggaaggcacagtgagggtggatcacagagatgccaggtccctgcagccaactcgcagccagcctgccggggtggcctgttttgcggacggggctttgtggatctctgttgactgaacctccctcctgtggccagactaggaccttgtgggccaccggccctggtgcccctcctgtcaggcccctctcccaactggtcctgggctctctctctggatccctgcttgtgtgtgtgtatgtgtgcgcatgtgcaagtgtgtgcgtgctgcacccacgtgtttgtggagtggggctcccgggtgtcccttctggatacagaccccgtgccgcgcccacgtgggtgtggagtggggctcccgggtgtcccttctggatacagaccccgtgccgcgcccacgtgggtgtggagtggggct

SEQ ID NO: 124158 - DNA, 1020 bp, Homo sapiens
cccgccgccatggggcgctgcaggcatcaggccggcgccgcgggcctctcgcgcctccttctgggcccgcttcccgccgcactgttttccttccggttgttccggaagtcgggtcctcgagggcggtgagatcggtttccgattccggggtggccgggtggcggcggcggcgctccggtcgcgatgggccagaggtaagtgagccgcggcctgggcgcttcctcattgccgggcgagcgcctggttctcccggctaccgctcccggcctctgggccgtcccttctggttctgccgcctccagcccggcgtccgcgtcgcctgctgccgcccgactgagccgctcccgggcggctgggaggcggggtccctgcagctcctgcagcatcgccccgccgggcgggcgcgggaccactgtccccgggtcccaggcccaagccccgtgcggcaagggagcgaatgagcgagcgaacgagcgaatgagtgaaggaatgaccgcacgctggctcctccgcaggtgacgccgcagccgccgggagccgcgagggacggggcaggatgaaccgggccaagcccaccacggtgcgccggcccagcgccgcggccaaaccctcaggtgcgtctccctcctcgctctgcagcccgggggtctttgggggtctttgggggtctttggggatctcagctgccgcggatcctgcgttgggcttggttgttccgcagccgcggctgtttccaggaattcggtctggaaacactgctctcggtcctcagcggctctgagagtccctgggaggcttgggacagtggcgacttccttcgggaccccggtgatctcgtttcaggctgagctgcaaggcggccgacagtagcggaaggtctccccagccaggaggcgggaggcagcacagtgtagcgtagcacggggtctgcggctgaactgtcggctcagatcctccggactttgccactcgcctgctgtgtgacgctgggcacgtcgcttaacctctctgtgtcccttt

SEQ ID NO: 124159 - DNA, 1063 bp, Homo sapiens
tcccagcgctagggggttcctaggcgcggcgcttcgggggtcctggacacagacacgggggacagagctcctaccagcgacgatcccgagggtctgcagcagaggggctgaggcccgggacgggggtggtcgcagcgccctttcctgaaaaaacggggttcggctctaaggcgcccccaagccctgccggcagcgcggaacccgagccgctcagaagcccgggagccccaagtctccgggaccagaagcgccgcggccctgacttccggaaggtggacggaacccgcggacggggcgggcccgcgtggcgcacgcagagccacttccgggcgcggcgccggcttggtgagcgcgggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgt

SEQ ID NO: 124160 - DNA, 1033 bp, Homo sapiens
cattcatggaaggatgaatgaatgaatgaatgaatgaatgaatgaatgaatgaggggatctgagggacttgggagaagcagaaacagaaaagagaaaggagaagttcagttttttccagtcttgaagctgagcgctggcttggactgggaccctgagacctgcctgcccaggagggcttccagaggagccccccaggagtggctgtgggctccccctggcccctgggcctggacctccctctcacccacctcagggcctcggctctgctccgggaggtggtagctcagcactgcagccttcgccactaagtcatgcttttccagtctctctcttgaacaacatctcccaaaaagtgtgatttttcgctccatgctgtctgacacagcagtaacagcccgttaagcaaaataatgagaggaataaaatccgctgagacgcgggacctccagacccacccggcacacaaatcttgaggttatagagcccgcggtctacaggctttcagaggatcaaagtgccgggtgggagacatcaggccgggcgagcgggcggcccggggtggccctgtccctgcagcctggagctccgagcagcgtccctggcagcacctgctgcagccgtgacgggggccgtcttccgtctctgagcggcgggagcctcctggtagcctcccgggctgcatttttgcaatctggggttctgagccccgtgcacctgccctgaagtgttacagaaatggccccggtcaagcctgggactctctccagcccaggccgggcttcctgaactcctcggcccaccgcagagacccagctgcctctctggcctcccttgcctgtgtcctgaggacctgggcctgcctaaagcccccagccctgctccccacccctctcccggcctgaatcccacccaagagctcaccctctcctcagacctgctgggggactctcagtctctatgggggctgtgtggcaggcggggcccacaaaccactgccacaacgccccctgtaccaccactctcccaacacct

SEQ ID NO: 124161 - DNA, 1094 bp, Homo sapiens
gtccccaagcccttgtgtcaccttcccaagatctgaggctgctgaaccttctggttgctgcagcctgggccacggcccacacctgccttccaccccggcttctgtggcatcaagacgggcttggcagctaaagggccacaaacaagccccctgtccccaggtgcaatctcaagtctgcatctggacccggggcgccttcctgacttggtctccccttccccgtccacatccgcatccggaccaggggtaccctcctgccttggtctccccttccccctccacagccagggatctccaaagcaccttcctttcggggagcccggggccggcacctcccctgccggctccccgggagggtctacaagaggctgggccccccagccagcgctgagatgcaccagctccggccggcaggcggctctgctctgatcatgggattttcctttccccgggaagaggcagaggcggggctggagcagccctcacacccccaagggacgtgtctgggtgggctggagagagcagaggtctctgataacatgtgtcccttgcgggctgatttaataaaccttccccacgagtttgtcaaatcctcttcacgcgtctgccaggtggaatgggaaagaaacagcgtgtgaggaccccaggaggcgccaccggtcccctgtccctgcccagccctggctgccgggccagagaaagttctggttctggcagattccccgcttccccccagctccttagtgggcacccaacgctaaatggttcttaagccgctaatgactaattttaagggattagtgctacagcaatcaactgtaattgccaggatgtaacaggatttggggggccccagggctccctccagcctcccggcaggctggagaggacagtgccacctgccggggcctctgagggatcaacctccctccctccctcccactgcacctggcaccgggcagccagcacaagaccattgcagggttagtctgtctctttccttcccacagacaactcgtgcaagttttggagaaatccctgggttttctgcagcccctcacttctcagagtggggtccctggaagcacctgaga

SEQ ID NO: 124162 - DNA, 1150 bp, Homo sapiens
tacagagatctatggagccaaggggctagttcaccaaaataagacctggccgtgtccaccactctgctggtctggctggggttgccgtcacagagccccacggcggggggctgagaccgcaaacgtgtgtctcacacaattctggaggctgaaatctgagatcaaagggcaccggagttggcccctggggaggactctcctcccggcttgtggacggccgccccttgtattcctgtgtgacctttccactgtgcacttggagagctctggtgcccctgctggatcaggacccacccttatgaccttcatcagacttaacttccctccttaaaggtcctatttccaaatacagtcacatggggattaggttagtatctaaatttgggggacacagttcagcctgtaacagttgctctgcacagccccgctcggttacatcatagatgttcgcacacgtctgtgcacgtgaactacctgttatctgttgcacatgcagcgttactaaacagggttcccttatacctcccggggttcctggagtggcgtcttctcttttgctgggaaccttgccgcctttcctctccctgcccctcccagcccgtgtgggccacctgctgtgttccacgccttcctttctcctctgcttgtgcagcggaaggttctgccagcaggggagttagtgagcagccagtggagggtgtgcccagccttcctgctgcagacccgcccccaagtcaacacggacttccctccctgcgtgccagaacttcgcgttgttcttagtggcatctggggtcgaggagggcgactgtcagccagttgggggatgttttcttcttggtctctcggcttctgcttccctgtgagctgggcagcctcagcccaggtcctatccggtactcagctggcctcggtgtgcacagcgcaggcttgagtgcagccgtgggggcgggcagggcagcagcagggcccctgggaacagctgagtctgaagggtcagaagccatggcccctgtggggggctctggggcagccaggggagctgctcgttagtcgtctctggggcagaaggaagggaccttcacctggattgggactgggcctgggtccccagtctcacagggagcttgtcctgattgtacctgcccag

SEQ ID NO: 124163 - DNA, 1022 bp, Homo sapiens
catctgggatgcccctggaccacctcctgccctggtggtccctcccccactgcctccagacttctcaggccaccctctgagtcccttggggcccccagccacagccacgccatgcagagccctaaccccggtctgcggcccagcgccgccaccttacccgcacctctgaggggtcgcgtgagtgctgcatgaccgttctcctccagaaagcagcagaatacatgaaagagggctcacagagcactggccgggcccggcaccccatggcgtctgcagatggccgctgccctcaccctccttcccttcatctccagggtgggcccagcagcagcagcacctctcccacaccctctgcttctcctgggttgcggctgtgacccaggaagtgagagtgggactctccacgacttggagaagggttccaagccctttcgtgggacctacttgctcttacttcctgcgttactctaaccactctagccacctggtttaagccccaggagcacatccgagtgtagtaagtgttcatcatcatcatgcattcattcagcaaacacatcttccacatggagcctgtgccgggatagtcctcggtgctggggctgtggtggtggacaggagtccctgtcaccgcggagctggacttctggcgtggaggacgcctactgagatgagtgtttaggctgatcggggtgtcccgctggcaacagcagtcacccttggcagccggcctctgctgggcccctgctgagcgggcgccgaggcaccgtgctgcttccctgctctgcagagagagacggaggcctggcccttcgcagcccccatctagcgggagggtctcggtgtccactgtctctcccagtggccgacggcccaggtgaggggctgcccgtacccgtctccctctgcttccggctcccttggtggccactgcactgtgcacttgcaggggctgccaagccacagaagccaggccagccggtcccctgcctgtcagctgctgactcacaggggtctttgtc

SEQ ID NO: 124164 - DNA, 1003 bp, Homo sapiens
cttcacagatatgtatttagaaataaagctgtatagctgggtctcctaacctttcacctccttatcacccagagggtgggacttccccagcatggctggcctcggacacctggtcaccgtcttgctgtccttgcaggttgaaggtcgaggagctggaaggcgagcggagtcggctggaggaggaaaagaggatgctggaggcacagctggagcggcgagctctgcaggtgagggcggggcagcctctgggtgaggcactgcctgggcctctcatttctttgggcgtcgtgaacgaccgtggttcctgctgccacagaacacccgttttctggctcgtctgtctgaactctcctccctcccatgtgcacccccttgcctggcagggaggccatgccgctgacaggcctgcactggctgcctctggagtcctctgcggcccgcaccacccacacgcctggtgtcggtggagtgggctctgggcagatttgcactatgcccacccgggatctgctgtggcgaggctggactgctgtttgtgttcttttaattgtactttctctttggttttcatcctcctgagttgctgcatggcaggaagccctcaggttcgaggttaccgggtttttggacaggccattgattttatcttggcacctgttagaggcagatcaaatctattttttatgaccagtttctgacgatgggaggagtgacatctgtggtgatgggcggctccgagccgcgctggcctgtcctcagcctaggacctgtcatcttgttttaactgggccgtggtgtacagggagcggtcacggggctgctgcccgcccaccagaggctctgcgtcagagctgctgaacgtctttctgggtgttgggctgagcagagcctgaaccctgctccttggtgcccacgttgcttgctgactgggggccaggcatccctgcaggcaccacttacggcttccctgctccagcttccagccctttccccaaggtgtcct

SEQ ID NO: 124165 - DNA, 2095 bp, Homo sapiens
agcgcagtggagggagggaggcggagatgtgacgctttgctcagcggagggaaaatcaggctgttgggggctccaggacaggcctttctcaggtctgggttttaaaattggagaaattggagtatcaaccatgtttttctttaggctgtagaaatactggggggtggggttgttgttttgtttattttcctctctgtgttctgctgtgacctttcattgctgatgtagtttgcaggggaacccattgtaactgtattgtttaatggcaggtctgagactcggtttccattcctctgccctcatctgagatggctcagggcaggcctgaaagatgctcctgcttcagtgagcgggttagtggggactctgtggagtgtggggtctggtgtccagcagtgtgtggggttagggggctctgtggactgtggggtctgtggactgtggggtctggtgtccagcagtgagtggggttaggggactctgtggactgtggggtctgtggactgtggggtctggtgtccagcagtgagtggggttaggggactctgtggactgtggggtctggtgtccagcagtgagtggggttagggggtctgtggactgtggggtctggttcccctgagtgcaggtgttcaggaaggatgccagggtcctcttctgcctgtgtgggggcttggcggggggttggcagggggttggtgggggacacacccagagccttcctagttcccagccctgagggctgtcggtgcttccttctcagtgactgagctttctggacccttcagtgaggacccttttcctgttgcctctggaacagcctggggtgggtggagggatgctcccatctgaagatgccctgtggagaccctggtgttctgtgtgtcaacacgctggctgcctcactgttggcctgaattgaaacgtgcctgggggccatgcttctgcatgtgcaggaggccaggagggttagaaatggagttgtctgagcacaggccaagccctcggcattatggctgagccacctgcccggcacctgcagctgccctggagcatggactccccatgtccaacagaggcacggacgcctcggagctggcatcttgacccgggcatcggcccttgtctggctgcaggtggttttggaggagctgctcactccagtcctcttttgtggggagagagacagaaactggtcttgggccctcaggtggggtgggtgtggccgcccctggagtgctggcttctccagatatctggttctggtcagggggctgtgaggtgcgcttggtgcagcgctgggctggaggtttggctgcttttcaacctgtgttttttctcttttttagcccatataatttctgttccttattcatcgtacgcagcaccgtttaagcgctaatgcctgggccccaagctgcagcatttgacttcgaatttggtgggaggattgcccccaagcagaatcatgattttacccctccctgggttgagctcctgttcctggccccgtcctttgtttggagccgcagggctcccgagggacgagaggaggggtctcgctggctgtgtgcccctcttgccatgcaaagcccttcagaggaggtcctggggagagcagtgccaggcaagggggctacagacaccgtggttggggctggcccctgccaggcatgcctgaaggccagtggcctccctcccctgccccccgccaccgcactgggctgtgcagccctgggctccaggttgccccttctctgtgtgacccagagccctcagtgtcatggcttcttcccgggggttacaggtgcatgttcctgtctgaagggggtctctgggctgcgggacagcctgactcccttttcattttatggtggaggaacctgagcgggagctcgccctgagctgggatggctggagtcacccaggtctggctctgaggcccctcccacccagttccctgtgactggctcggcagtgggtgctgtctggggaaggggctcccttgtccctggaaaggctggggcctaggtggtctgcaccctcagggcttgtgtggagaagccacattctaggcagggctgactgtgtcact

SEQ ID NO: 124166 - DNA, 1014 bp, Homo sapiens
ggtggcacgcagtaaacagttcaacccaggagttcaacccgggagctggcattggggcatggatgtgcgcgctggtggccattcattactgatcctccagtttcctttgtcgtctgtgagtgggtgcgctcagcccagggggtgttgtgtgcgcagcgtgtggtgcagaggtagcacctgggacagggggccgggcactgtgcgtgtgggcacagggagcgctgctcctcctccttagacctgaggctcctgtctgggcaaggtctagccctccacctaggagcttacggaatcttcagtggggacagatggtctggaaaggactcacctcttttcccacccttggttgaatgtggccccttgggcacaggcgggcagcgctcacccctttcctacactaagacgtcctcacggcttagtgtagggcaggcgggtgaggcggggtttgtgtcgcttctgatctggaaggggtttagcagctgaggagatgatcgccacgcagagttccgtctccagaaaaataagaggatttgcacagttcttgaacttcacccttccaaagttttcacctcttgtagactagaagttttaagtgagcttctgtgtgtcgaaatcatttcatgggcagtgccccagccggagcctgtctggaggggagggttgggtgggcacgggcgccgggcctgggaggaggaggacaacatgggtttcctagctcgctggacggccctgaggttgtgggggcctttggtggctgaaaggggtcttgtatttctgtgcacattgaaaggcgatcttatttgcctgcgctgccgtccagctgaggacagggacatagggtgcctgtgagtgcaggcctggaaagggatgggactcccctctgtagggagggcggggcttcagtccacctggggcgtggggcctgcgccaccacccgcatcccaggagaggcactgattgcagggctcggcctggggcttacatgggaccctccttgactccctagaggcagcc

SEQ ID NO: 124167 - DNA, 1023 bp, Homo sapiens
gggaacctcctggtttcttaagtgaggccagcggttggaagctgatgggcagagttcccttgacaggtcacgtgtgggcctgagtgttcttgtgtgctgggtctggcctgcagcctgtgacccacgcgacactggtgctgctgcccacaccctcttagtgccagggctcccggccgtgatgaggagttacatgcagtcactggatgtctggtgtggttttcatccctgtggggctccctcatggtctagtggagccccgcagccttctgggaagtctgtgcccggcttccttcctgccgttgctctttgatggccaccccggcccgctcagggcaggaagtttctgttcttctctgctctgctttgcaggtggagagcctctggcactttctggcccgcgccagcctcaccccgaccctgctgtgctcgcgggcctgctctgtgttagcaagaaggtgggtattgatcgccgggcatggactggttgtttatcctgacgaaggattgatcccagtcgcccgtgtagccccaggccagggatgcaggatccgtccagccagccgtgatgaagctgttcactcagccatctggagggagcggcgtgcctgctgctctgggtctgtgtgccttggtgtcggccagtgcccacctcagctctgcatggcagcccgcccagctggggtggtcgaggagcgccttctctcaaggcgcacccaggagggctgcgagcctccggctggtgggggctctgggcctctgcttcccattggaggctctccttgtgtgcttgacattttagtacacggtgcttggagtgtgtggttttatttcgagacctttattaaacggctctagtctaaggatttaattgttactgatagctaagagtataattaccttggtaaaatatcatgactattttaagcagttgaaaattggcttctggaactgggtgaacacaaaccattttcctgtttgaaatgagccgtttctccagtgccccaagcttccgcagtatggctg

SEQ ID NO: 124168 - DNA, 1016 bp, Homo sapiens
cccagtgcttagcgccaggctgggctttcaacctcacagaatgtttttagaacaggccccccaaccaggcgcctggcgcttgcttccccgcaccacgctgcacatctgcggtgattcagaggggaagcgctggctctgcaatctcgctcattcagaagtcccgtctcctgaagggctgcgtcgccgacaatttttcccattgtgtgtggagttgagctcccttccccctccctgccgtgttctgggatcaccctgggagtctatttgaaatccagaaactcctgaaaggccttaagtagctattcagcagtgcggaaatggcagtgagggggttgcacgtgcagctctattttaggatgtcctggtgggctcgttcctggggtggggcggggcttggtggggtggtcaccccaggcttcattgctttgccctcttgtctctcccatgcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggtgatgtatgcccttacatcttgatcagagtcgcagggagctgcgggtcagtgcacacctggttagctggatctcactgtggaggcaggagtgctgcagccgggtcagggttggcactttggccctgggttgccaggagggttctgggaatgccagagagtgctcagccccggtgctccctgtgggactctctgggcctgctgcgtgccccacccttttcagttcctccagcatctcagtgtccacccctggcctggtgctgagctctggagagggttccctgtcactgcggaccccctgcaggctcccacgtgccttgcagtcagcaccctcatgctttcccatccagtgatgccatttacactgtgtgggtcttggcctgggcttgggatgaaggctgtcacctgcttccaggtgtgcc

SEQ ID NO: 124169 - DNA, 1090 bp, Homo sapiens
gggaggctgtgtgcgcagcacagggaggcgtctggaatggccgggtgggggtctggaacccatacttggtagcgcctgtttggtctgtcccgtgctcttcctgcgagccctcgcgggggccctgcacttccccaggagctgcctcagagatgtgccagtgaagaagggatggaactgatcgtggatcgggccggctcctggaggccacctgggcccatttctgacagccgctcctgccgcgtccctagctcagaaggagctcgaggctgagccgtttccccagggctgctgcctttgtttctcccattctgaaaggagatgaaagtttctactgaccttagagagaaagccagagtgaaaccccctctgccaacccctggctccctgtgaaaagccttcctggtaatcaagtgtttacagaggaaggctttgttcagaccctttctggggctctgtatgtttaaacaaagagctttttagacctaaacacagatgttcatttgaaaatgaaaaatcaaattaagcagaaccagcctttgaaagttaatgccctatagcaagtaaaacaaagggagaaaaacactgtgttgtaaattttacttaaataactttttattttaaataaagttttaaactaaaaaagtataatttgaaagccactcatcttcctctctgtcctccagtagaacatctgtgctgattctgacgcggatgaatgacatgaattaaaccaaaaccgtcggagcgctctttttaccataattacaccttgttcgtttgtgagacacaatgtggggatgaaatgccaattaagcctgctatgataatgaggtggggcctgaatagtgatcagcggacatgaatcccaccggaattcatttgctacagcccccaagtttgttctcttctgatgggaatgttatcgtacataatgaaaatctttagtgctccttgtatttaaaaatgatccattttggggtttttggtcagcaagttttaaaacaggtgttttccgagcacctggatgggtttcatgtccccactgagcatcctgttggtggggggtgggggggtgccggtgtctcctgtc

SEQ ID NO: 124170 - DNA, 1084 bp, Homo sapiens
gtgaagtcccgggttgggggacatagacccggtgcccatcctgccaatgccgggttctctgtggccccccagtatggtctgggggcctgtctgaggcaccatcatgtttcaggctgcagctggctgctgggcctgagatcgagccccatctctcctgagagggggtccagcccatcctggctccaggggaaagcctgggtcatcagcaggcatggtcgggtgtcatggctgtgccccgcagcacgcggtgtctgcctgcttggaggggcctccgcagtggggcactgcgtggccctgtaggatgcaggcaggctttggcaaggctggccctgctctaggtgggtgtctgaacctgttccctccccaggcagagcccgcaaggcgagcacacgctccttcatgacggggccgggtccagcgtccgctgccgctgggctctggggtctgtccggggtgcctccgcctgctgctttagccagcttgtgttgcttctttcagcaagatgagctgccgttaatatttcacacccagactgtttccctgaatgttttgcatttccatatttaaaatggcatttacatattcatggctttttaaataagtttttattgttaagggatgtggaagtggatgaaatgtgaaactcccccttttattcaagcactagaaaaaaatttcatcccaaatgcaatcactttctgagtgtttagctctgtggcagttgccataggagattgttccagaagccagtgggtcccagggccatggagccgccctttctggcatgcagggactgggggaaggcaactgccatcagcattgctttccagccgaggttgggcatggaggcctggttgctccttggggtttctcctggcgggggcctggcctcgtgctgggatgcggggccggctcccacccacatccatggctcttgttttggaggaagtgtctaaggcagacgaggctcttcatcttggaagtggctaagccagggatgcctggcttcttttctcccttctccctggtcactcggcgtccctgccctggttggcctcttgctcccggctttgcggctgcggct

SEQ ID NO: 124171 - DNA, 1224 bp, Homo sapiens
tgaaaccacaccttgcctgggtccctttccatggggtaagagtgacctttcctctgtctgctgggaagagtgtgagtggcatcgtctgccatgtggccagggtgtcacggagcggcccaggctcttggtgagagggactggtgccccatgtgaatcccctgacttggggttcctctgatcttgggaccagagagtctgagctccagcttagtggcctcaggctgggtgcagcaggtgcagcaggtgcagcctcaggcaggtggctcctgcagaacctgacccagggccgggtactgcacagcatggcattagtcccctgtcttcaggaaaacaccagctgctcctcccgtgttctggggccatgcatctctcccaacctggcgaccccacctttccacacaattgtgttgcatcagccagaaaagtccggctgacatgacgccctgttgcccttgtgactttgcagttgtgaatgctgattgtcctttggtttgtagcactgaggttttgctgtctaatgtattttattcctatttctgcatacttttcgcaaaacaagccctgcagagacagcctgtgtcgcttgggttgtgttccctgccttccgcagggctctggctggagccccagcctcagcagttttggactgtggtcctaggccctgtggatttctattctttgaaagcttgaggtgtcttgtttgctaattagtttgatggctgttgctgtttcattcattttccacctcggagtcctctgggtctccagtttttcagactcggtgaaactggcactttgggcttcagctagagccccaacatctgctattagccccaaaatagctgtggcttgggctggagctgctctcgcctcggaaggaaagcagtaggccggactccccacagccctctgctgctctgcgtgcagctgggcttgagtcaaaattcagctgcagatagaacaaaaagactttcttccccttgaaaacccaccagttagaatttaaaaggcttcgcagctgaagcccgcgtgttcagcagcagatgtcacagcttggactgcagttggaactgtcactgccgtgtcatctccgagctgaggctcctgaggcctctgaatgccttccactttgtagttggtgaagtgcgggtttcagaatggactgtcgggagttattcttaggccgtaataatacttggcacggctcctcctggttacgagcac

SEQ ID NO: 124172 - DNA, 1040 bp, Homo sapiens
agagcctgtccccacaggtgtcagtcatggcgatgtcggctgcagtccttctccagagccactgagactgcccttcttgttgaagatgcaaactctggcctgtgagtttatcccgagctttcaggcaggcgtttacagagtcgagcagaaacttttcacagatgacaaagacttgatggcaatggttaatttcttactgataatttttaagtgtgaaatgcctgatgaggttttatataattttcaaacatgaaatgtctgatgtggttttaatagtaatgcaactaatgaggaaattgggttgtttctgtggcatccaaaacaaagataaaaaggcgattaaaaaattagacaaaatattactaaggataataattcagcctgtttcaaagaagtcagtggatgttaacatctgattcattgaaatgggtgaacataatttttatgaagaaaacagtcttgagatgtacaatgttgagacaaaatattcccggaatataccaaagcatatcaaatgaagagactgggtaagtctgagatagagtgaaccatttttaatttcataaaacctcatgaatacatctgctgtacatgaatgcatagcactaggccacttgagaaccagtggcctagaaagtgccagattcaaattaaagaagtaatgtggctaatcattttaggtcattgaaattgtggctgtaacactatgttgttactgcctgatatcagggagagcacttgaaggactcggatacagaaaaacttgaccagactatttcataagcattttggtctgtgtttctcctgacattaaaacatattatggaatgtgaaggcattgacagatctccagggatttccactgaagcgcaccatttctgaaatacgtcttttaataacatattagcgattcacagttcacctggagaaggctgggtgtctcttctgatttcacaaccctggccacacagctcaccaagcaaacagttattactagcgtatgttttttagaggagctcttgcctatcttttgataaatt

SEQ ID NO: 124173 - DNA, 2112 bp, Homo sapiens
actactttaaagaactgcagggtgtgctggagtgcagacggactcagactccagcagcccctgttgatggacacttagggtgtttccagcttctttccccaattagccatgctatgctggttgggtaaattcttaaaaggatgatttttagttcaaaagagatgtgcgtttgagactcctagctggtgccacaccgccctcccgaaaagcatgagtgctgtgcgctcccgtcacggcgtgtgactgccgtcacctaatgggggtggtgtgctttcaacgtttctagagagattcagctcgaagtcacagtacagtgaggagagcaggcatcttcaaaggcttggcttttcaaaactgtcatttagcagctcccactgagggggaccctatgaaataggaagggagtgggtgtcaagtcctgtagccgagcccccacttcagggaggaaatcatttgctcgtggccaagatgccgctgtttttggctccttgcctgtcccgttgtgcctgaatctggccttgcttcccatcccggcgggtgggcattatacccgtcagcaagggcaggcctgagggggtgaggaggggctgcagaggaggctgggctggggaggtgggaggcgggcattgctggctcagagtcctggcagctgtgcccacctggaactgctgacccatcccctgtagtcaaagctgggcacctgtcagtgctgacctggacattttcccaaaaacttttgtagactggtcagatgacaagtctcagggcccagcttccctgatgtgtgaggccaattaggaggacagtgaggggatgcatgattttcctctaaggaagggtctaattgaccagcctggacagttttattatcctagttaccgtgcgcgtgatttgtaattacccggctgttgagttgatcaataccagacgccctggtggtgcttgggaaggtgggcgactgtcaggtatgttggtccattttaattggcgccggtttggttttctttggggcatgggaggaggagggggagaagcgtttggccttctggctacttgtgtgagcatggcccttcttctgggcctgcatgccggatgcctcgtggtctgggccacgtttccccttttcgtttgttcattcgttcaccatgagctgctcttgtggagcccatgatctggagggagaaggatccctcaggcctgtgcgtctgtggtgtgcaggtcccaggaccctggagctggagagtggcgagtgtgctgccctccagaggtgcaggccagggtggggcgtgagccaggttcccagctccgtccgagcacggtgcctgccatctctcctcttctcaaccccagctcctcctgtggctgagtcctggccgctttctgccttggggttgtgttggttttccgtaaacgcatcctctcaatcctgagcattgtgagttaagagctggggtctccctttagcgcccctgagccagacgtgcagtaggcgtgtgctgagcctttgaagagtggaggaccgagcgagggcgtctctgtgccttgcagttggtggtgatgtatgggcggagcctccagtgctcttggctgctgtgacagggcccccctggggtcctgcactatcccagcgagacccccaaagcaaggccagcagagagcttcctgacagctgcctcgctttggcgacggccctggctggggtgcagcctgtgcccctctccgcccccttgtgaagtttcggatgggcgttcccagcagtgctgacaggctcacgccgcccttgggcttcattccaggtacggtcgggcaggctggagactgtcagagtctgggggcggtgctgtgggtgttgggaccccgcagggagaggcgagagaagggcttcccagaagagaccgttgggctccacccctgcatgtgcctgactgcacagacagctgagtgctctgcggcgtgtccgggtggaaacgctatcacttggtctcggagctctttttggggcttttctccaagctttgtagatagggctcttctacttataggtctctttttaaattgattttaaaaagtctaaggccagagtgacaggctttagacaagtccggctgccgt

SEQ ID NO: 124174 - DNA, 1050 bp, Homo sapiens
tttctagagcaattttaggttcacagcaaaatgagcagaaggtaaagctcctgtgtaccccctgcgcccgctcctacacacacagcctaccctggtagagtggagcacgtgtgacggtgatgaacctgcctggacacatcagtgtcacgcagagtccacgggtcatgcgagggtcactcttggagtgggacagtgtatggttcgggcagatgtaaaatgttctatatttgccattagagtgtcacacagaaaagttttactgcctaaaaatcctctctgctcccccagtcaatccctgcctctctccttctgagcccttgacaaccccttcctttcccagaacgtcctgtggttggatcctgcagtgtgtatagccgttgcagaccggcttccttctcttagccgtgtgcgtgtgattttctccaggtctcttcgtggctcatttttcccttcttctctgtccctggcctccatcaggatctggagcagaagctgtccctgcaagagcaggatgcagcgattgtgaagaacatgaagtctgagctggtacggctccctaggctggaacgggagctgaagcagctgcgggaggagagcgcgcacctgcggtgaggggttgcgggggatggggcagccgcctcgagtgagtctgggtttgtgcacatggagcccactgtgcagaccctgtaggggcagggctcccgggctcttggccttatccctagggtgtgtggctatttgagcgactctttgtggcactgccagggagatgagagagaccaacgggctgctccaggaagagctggaagggctgcagaggaagctggggcgccaggagaagatgcaggagacgctggttggcttggagctggagaacgaggtgagggcctgtgtggtgtgcggttcctgtgggtgtcctctgccctgcctggaggagcctcggtattgtggtcacgcccaccagctgctcacctacaacatggaggttgctgtgatggggtgggaggcagaatcgtggtccccagagaggtccatgcctcatcctcagag

SEQ ID NO: 124175 - DNA, 1006 bp, Homo sapiens
gtgccaggcctgagagtccgggcccatcttggctggtggaggcttttgcttctgaagccgcctcaccaagcctcctttccagggcccctggctggggcccggtctcctctgtcagctcctgggtggcttgtggcaggctctgggctgtgctgctctggagcaccaggaggagggtgggccctgcgtgtgagcgtctgcctgacctgcatcctccagaaggaggtggctctgccccctggccctctgctcccctgctcctcttccccctgccctctgccccccttgcccccttgccatctgcccccctaccgctctgcccccctacccctctgcccgatgcccctctgcccccttattcctctgcccctctgcctcctgccctgattatagcacgtgggtggtgtcgcctctccactcttctcatctccatgtgcaggctccttccacgcacgggctccactcactgagcggctctctggtcccctctacttttagaccatcaacgcactgaaggggaggatctcggaactgcagtggagcgtgatggaccaggagatgcgggtgaagcgcctggagtcggagaagcaggagctgcaggagcagctggacctgcaacacaagtgggcggggccagggtgtggggtcgggggtcgggtcacgtgtgggggcatgcgtcccacctctctcctggtggctgggtgggatgtggatacactcccagatgctgtcctaattcacagacactcaagaggggcagatgctgaggcctctggagccaggaccgtgagcccagaaagtgtcctgatgttcctggagcagaatgggggcagcaacttcctccccctccttcttagagagggctcctgcagagccagattttactttattttttgagacagggtctcactctgtcgtccagcctggagtgcaatggtgtaatcatggctcactgtagcctcaacctcctgggctcaagtgatcctcctgccttagcctcccgagtaac

SEQ ID NO: 124176 - DNA, 1023 bp, Homo sapiens
aaccccatctctactaaaaatacaaaaattagccatgcgtggtggtgcgcacctgtagtcccagcctgtgggactcgggaggctgaggcaggagaatcgcttgaacccaggaggtggaggttgcagtgagctcagatcacaccattgcactccagcctgggcaacacagcaagactctgtctcaaaaaaaaaaaaaaaagttaagcacttttttgcctttgtaattatgaatttaaatggatgatgaatctgttttttgttgtttgtggacgtttagtgtgtttgtgttcgctcatgtatgtatgcgacaggtagcccttccctcagccctcgcttctgttgactttggacagacccctaggactgggttataaggtccctagcgatggcggtctctgcagccgttgtgctcagaggcctggctgagggctccaatttccccgtagccttccctgtcgtggatggtggtcttttctggaaatagctgttgttttgtcaggaggcttaaggaggcacgtctggatttgcatatctttgactgtctgcaaggtctacaggcatctgatggcgtcggataattgcctctgaactggagcctgtgtgaactgcagtcctggtgaaggttgcttgcattttagaaacagcccagacatgggcactggtggaaattggaatcttctgacctctcctgtcctttgtctgtggcgatcaagatcgctggtgccaagaggaaacatgaaaatctgctggtgtgggggtggaggcgtggtaggggtggggtgggcgtgcagcgggggtcctggaggggtccagaaactggccgcgggtccttcctgtggccgtgctggggaggcgtgttcaggctgttcccctatctgcttctggagggaacgttggcaggagaggaggcgtgattggctcccgagaagctgctcttgccttgcccatgctctgggttccagttcccatgtgctgggctgtactggagttgggccgggggctgtccccgctgcctgcgggcac

SEQ ID NO: 124177 - DNA, 1048 bp, Homo sapiens
gtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtaatgaggatgaaatataaacgatcgtcaggttcctcacgatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgtt

SEQ ID NO: 124178 - DNA, 1028 bp, Homo sapiens
cggcatgagaagggcgtgttgcacaagcaccagcgggccctgcacaagtacagcctgatgaagaggcagatgatgagcgccaccgcgcagaaccgcgagccggagtccgtggagcagctggagtcccgcattgtggaggtgggtggcggggcggccgagcaggcccgtgggagcctttcccctcccggccatggtgggacccggagccgtcctggtgggctcccctgggttggctccttgtgtctggaacagagctgggggtgcagtggaggcagggagctggcccgcgtgcccagagcgatgcggctccctgcacggtgctccctccccggccctctcttacctcgccaccttccaaatgcctggtgaaggctgaaggagaaggggccgccctggctcagggagcacgctggtgttcgggccttggtgctcccgtcgccggctgggccgggtgcgaaaggcggctgtttgctccgcagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggaggtgagtccgccctgctccggccgccgtctcggccacggcctttctttgtccctccgcccttccttcaagcccggcagcgcggtggccggccgccctagagaggttctttagtggagttgggctccgcatgggccttggaacacggtgctcgcccggatcttctagtctcctgtgtagccaaaatcagaatcgtgagggtgtccctgtgattcctggggggcggagggaggagcagacagggagagtttgcctcctggagggatttgagaagtcggaggtaaagcccgcagagctcccgcaccctgcggctgagagaaggtttctagcgcttcggagcgccgcaggtggctgttcttccagagagccctggccggcttcctccagagcagatggcggttc

SEQ ID NO: 124179 - DNA, 1082 bp, Homo sapiens
gtaataaccagcatcctgacctgtttcatctcagaaggggcagaaagtggctcaggcacatggggggtcatatttggaagaaacacgggagaatttcggccctgaaacacggatttctgagcacgagtaaatgctcaccagtttctagtctggtagttttttcactgtcaggatgagactttaaaaaaagatcccaggccaggcgtggtggctcacacctgtaatcccagcactttgggaggccgaggtgggtggatcacgaggtcaggagttcaagatcagcctggccaagatggtgaaacccgtctctactaaaaatacaaaaaaaagttctctgggcgtggtggcgggtgcctgtcatctcagctactcgggaggctgaggcagagaattgcttgaacctaggaggcggaggttgcagtgagccgagatcgcgccactgcactccagcctgggtgatacagcgagactccgtctcaaaaaaaaaaaagatccctttgacttggggaagaacagaccatgggctggcagcgcttcctttgcctgaggggaggggagaccccacccgggactctgcttgccccagcagtgcccgtcacctgtgcacacatgtcacctgggggctggttgggaagaagagacgcagcaggtcctgaggtgcagccccagggccaccctttctcccgggctcccagggtccccacaggccactctttgagcagcagggtcctaggacggggtcacgcaggttgccgtggaggacatctgtcgggggggatgccagactcgactgccaggtgagctccaggccttgagtgtctcctctcctgtgtgcttgctccctcagtgcaatagggtctgacacgaccccgctgccctcctgggccgctctgaatagcagcacgtgggggtccctgaagcaggctctgaaaggcctgtctgtggaattcgcgctgctcgccgacaaggctgcacaacaggtgagtggatcggttctcccaggcgcctgttccagagaacacgctatgcctttgcatggggagtgcctcctgcttagatgggcgtcacagttcgtttttgtt

SEQ ID NO: 124180 - DNA, 1037 bp, Homo sapiens
ttttgtacagatggggtctcaccatattacctaggctggtcttgaactccagggctcaagtgatactccctcctgggcctcccaaagtgctgggattacagggctgcgccactgtgcccagccaaggctccagcttttgagcagctattctcactggtcattcaccatctcccctgcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccaggtaactggcaaattgtgtgtgtgtcggggcaggagggggaagaaagggtcacgtctcaacatctcagggcaggagtggtgtgacaggagaaggctgaagggtgagtctgtgtggctggcttacaggcaagatccagaactcgcagcagagtcaggctgcggaggtgacttttccacacctctgctccccgcacctcactctggcccagccacgtccccacctggtcacccctggtccagtttgtcctccccaccactgtgctctggagtcctgtttcttttttttttttccccgatgtggagtcttgctctgtcgcccaggctggagtgcagtggcatgatctcggctcactgcaaactctgcctcccgggttcaagcgattctcctgcctcagcctcccaagtagctgggatgacaggtgcccgccaccacgcctggcaaatttttttgtatttttttttttagtagagacagggtttcaccatgttagccagggtggtcttgatctcctgaccttatgatccacccgcctcggcctcccaaagtgctgggattactggcgtgagccaccgcgcccggcctggaggcctgtttcttaggaatctcccgcggacggtccacagagcacaaagcgggatccacaccagcctcg

SEQ ID NO: 124181 - DNA, 1046 bp, Homo sapiens
ttactgtttaaagtatacaacctaggctgggtgctatggctcacgcctgtaatcccagcactttgataggttgaggtgggaggattgcttgagtccaggagttcgagaccagcctgggcaacatagtgagacccccccgcatatctacaaaaaatacaaaaattagctgggcatggtggtgcacacgtgtactacatttatagttccagctacttgggaggctgaggtgggaggattgcttgagcccaggaggtcctggcaacagtgagctgtgatcgtgccactgcattccagcctaggcaacagagaaagatcctgtctcaaataaaaaaaatagaaaaagaaagtatgagacctgtatggcagttagcgcagtagttaggggagctgtcttgggcatgagaggatcatgggtgaagtgtgttacctgtaacagaagcatctctatttctccatgttcgaggggcgttcctgctgttccctggccacagagctgccaaactctcatgtctaatgccatggctataatatggatcaggaaacttctgcttccatttcctgagaacagtttgttaatttcagaataacatagtagcttagagaaagtttttttgttttgagactgagtctcgctctgttgcccaggctggaatgcagtggcgcgaacttggctcaccgcaacctctgcctcccgggttcaagcaattctcctgcctcagcctcccaagtagctgggactacaggcgcccgccaccatgcctaactaattttttgcatttttttttttttttttttgagacggagtcttgctctgtcacccaggctggagtgcagtggcgccatctcggctcactgcaacttctgcctcccgggttcacgccattctcctgcctcagactcccgagtagctgggactacaggtgtccgccaccacacccggctaattttttgtatttttagaagagatgaggtttcatcgtgttagccaggatggtctcgatctcctgaccttgtgatccgcccacctcagcctccaaaagtgctgg

SEQ ID NO: 124182 - DNA, 1535 bp, Homo sapiens
ggactttagtaacgtaaactaaacggtttccctagcgaaaggctcagacgccctgagcaatcgcctgttgagtctccactcttccagggtattaactgttgagttagaggacattttcctagcattccgggtactaaaatcatttcttgtccccgccttcagctccacaaatagttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaaggtgagggcgcccggggcggggctggcgagcggcgcgggagcgtggctggggttcccgaggtgggagatatcgtcgggctgtgccaccggttcgtgcagaagttccagcgagggtgtccgtgtgttcctgagaagccaccgagggaggggttcccgagtgccctggaagtgttctgagagcccagcgcctccccttttctttcctgaaaaaggggacagggtggagctcacttcgggagccaggcatttgcatgacaaccagaaatctgagagggtgggagagggcacatggggtactccgttatggctgggtgtgctgtgagtgtagcagctgggggtacggcaaaaaccgaagacccggtggcaggtttgcgggtctacgtgtccccagagctgaccagtcagacctcccaaggtctggatcggaggaacagcttgtggcagagccggtgattttgtcctcctgcccctcagaat

SEQ ID NO: 124183 - DNA, 1109 bp, Homo sapiens
gctaaaatcttctgtaaaaagtcagttttcattgacattgggatgggattctgcctgcctagatgttgcaacaaacctttcaaaatctaggcatctctggaagatctaatagtggatattcttgagatggtcttcttcatttgcattgtgcattgttaaaagcttttcactgttattctcctgtagtctttggttattaccagaacttaattgacctgtcttgactgtttacatttccatcaaagggagagaggagagttccagtccccccagctgtcatgtttaaaatctgaaacaagctagggttaggatttcttttgctcacagtgaaagcatttagacaattcattgtctcttcttgaagacttgtttagtgtgctcagttaatgtattaatgtttttcttggtaaaaatgatcatttgaaaaatctctcttgttcagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtgagtgttctcctgttggagaagtatcatctgtgtctggcacgtcatgatgagggagtgttgcaggagatccttactaacacagctcctgccttgcccaggcacgtgggccgttcacttcttcaggccgccctcagctggaagctatccagagcagtgaatgagaagatgataaagtttgtttttttaagttaaggttttaaagtttttaaaattatctagaataggccagcatggtggcttatgcataaactcccaacactcttgaagcctgaggccaggagttggaggctgcagtgagctatgataacgtagctgtactccagtctgggtgacagagcaagactctgtctctaaaataaataaataaagtaaaaactaactagaatagttttagtttctagaattatcaaatacaggtaatgctgctgcattttctgtgttgggcagtcagttgaaggatggcctcttgac

SEQ ID NO: 124184 - DNA, 2865 bp, Homo sapiens
ggtttcaccatgttggccgggctggtctcgaactcctgacctcaagtgatctgcccaccttggcctcccaaagtgctgggattacaggtgtgaaccattgcgcccagccaagatttttttttaaacagctttattgagataattgatatacagtaaatctgcatagttttaaagcgtacaatttaatacattttgatgtgtacatatcacgaaaccatcgccacagtcaaaataatggacgttttgattaacttttctataattatgataatgaaactagagacttcggatcttctggttaggatttccctgtcacttaggagctccctggctgtggatctgtcccccgtgtgactgccttaggctcgaggcaggaagagcagcacagatactcctggcaccgagggcttgtccgtggagaggggtggggcggacagcgcatacctgcctagccttacagtgtgggtatgtgccaacggccctctctcactcaggtatattttcctggagtacgcgtcccctgcccacgctgtggatgctgtgaagaacgccgacggctacaagcttgacaagcagcacacattccgggtcaacctctttacggattttgacaagtgagttcagacttggccacaaggaagtggacgttgacgtgcaagtgactggctgtgtgcgggtggcttggtgcttctcggtgctggtgtctgtcagattgttcacatcctttctggtcaggctgccgcagagccatttcacagccctgccccacacttctggcctacagcacccctccctgttatgccagtcacagccctgggggcgggcaggcaggagcacagcagggccatgctggagcccccacgagttgctctttctagtcgtcagggcgtggggctcagcagtctcctttcttctccaggtatatgacgatcagtgacgagtgggatattccagagaaacagcctttcaaagacctggtgagtggcctgaaacctacatctcagtggtttaaagaaatgctgctgggtgtggtgggtcacacctgcaatcccagcacttagggaggctgaggtgggaggatcgcttaagcccaggaattcaagaccagcctgggcaacaaagtgagacccccgcctctacaaaaagtaaataaatacatacattagctgggcctggcatgcacctgtattcccagctacctgggaggctgaggggggaggatcacttgagcctgggaggttgagcctgggaggttgaggctgccgtgagctatgattgtgccactggactccagcctgggcaacagcgtgactctgtctcaaaaaaaaaagaaatgctagacggtgtcttgacttgaggttagggtgtgacttgggagttaagatgtggactgaacttgtcatatctttaagagcaatagttgtgaatgagttttttattaaaattaatgaaatgttatattccttgtctttgtttttaaggggaacttacgttactggcttgaagaggcagaatgcagagatcagtacagtgtgatttttgagagtggagaccgcacttccatattctggaatgacgtaaaagaccctgtctcaattgaagaaagagcggtgtgtatttgctgctgctgggggcggggactcacctctcctgtatttccttaacaaagtggaactttgtttctatcagaaaactggaagagcaggtgacgttatattttctttgagattactttctgaaaacaacttcttttattcctcttccagctttgaagtaaatcctgagaagtgaacaggctttgtgtatttcacttaagagtttgcagaataggccgggcgcggtggctcacgcctgtaatcccagcactttgggaggccaaggtgggtggatcacgaggtcaggagattgagaccatcctggctaacacggtgaaaccccgtctctactaaaaatacaaaaaaattagctgggcatggtggcaggcacctgtagtccccgctactcgggaggctgaggcaggagaatggcatgaacctgggaggtggagcttgcagtgagctgagattgcgccactgcactccagcctgggagacagcgagactccgtctcaaaaaaaaaaaaagtttgtagaacagattcattgtaggataaattcattgtaggaggggtctttgtgtttgccattttgttgtattaacgttggcactgcctttttctgcagagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtaagctgctagaaaaacacaggggagtctatgcatttcaccccatgccagccttctacaggtgatctttcattttgtagcatttcaaacttagtagaaaaatacgggagtatgcagaacgctaataagctttttactgagatcttctcacatttggttgcatttacgtcatcatctcctatacagatattttttcctgagccatttgggagtgagttgaaataacatgtccctttagccctgaatgtgtattcctagaaataggattttgttagtgtgaccatagtgtgggtactgacttcagggatttaccattcatttaatacttcaatgtattgccatattctgattttgttacttgacctaataatgttctgtataatacttactttccttcagttcaggatctagtctaaggtcacgtattttacagataataaattgtccttcctctatcacccaggcttggcgccacccagtggcacc

SEQ ID NO: 124185 - DNA, 1306 bp, Homo sapiens
gggccgggcagtgtggggtttggggagagagctggttccgcgagttctgacggcgtgttctggccgcacagacagactgtgatcctctcgtgagaggaggatagtgtacagtgttgcccttctcttctaggtacctggtgacctttagccccctgatggacacgcaggatgaccctcaggccataatcatctgggacatccttacggggcacaagaagaggggttttcactgtgagagctcagcccattggcctatttttaagtaagtggaccattgtaacgagctctgtagcctttgtcttttcatgggaataccctggcacttttgtttttcttaggtggagccatgatggcaaattctttgccagaatgaccctggatacgcttagcatctatgaaactcctgtaagtggcctcagtgatggcaaacgccccgtccggtccttgcttgtaaccggggtgtggtgcctttccttatttgtgctagaagaggaggaggaggtttcacagatgcataggaaaggcctgtctcctgtgcctttttaactgcccctgctctgggcagagctcttcagtcactcctgcccacctggcgcagccgtgggaagtcctggatgggagttaatgcagtgggcttcagaactgcagttctgggtggcgggtgggtggatgggttcactgtcacgctctgtgtgcactgccccctaggcaaactcacatcagactcttgtttccttttgtaaaaagttaggtgtgtttctgagacactgacatgatttgactcaactgcagccttccttttttttgggcagtctatgggtcttttggacaagaagagtttgaagatctctgggataaagtgagtattcttatcagtttggtgtcttagtgtgttcaggctgcttaacacaataccaaaaaaaaaaaaaaaaacacaataccataggctgggtggcttatgacagctgagatttctttctcccagttctggagcttgggagcttgaggtcagggtgcctgcagactgtctggtgacggcccacctccctcctagtggacagcccctcggtccagccttccctggaggaaggcctccgtggcctgttctgtaaagtctctcatctcattcccaagggcttccccctcaggacctcccaccccccaaaaggccccaccccatgccgtcaccccagggggttagaatttcaccctgtgaatctgggggacacagacgtggtccattgcagttggtttcctttatttgctgtctctcctttagcactcagctttttgttgttgttgttag

SEQ ID NO: 124186 - DNA, 1077 bp, Homo sapiens
aaaagagaaaagagattgagcctgtgttcttgtttggctttttgttttgccatggagaaaaggaggaaggaagggttaaaaataggtgagaaaatgggaaacatggccgcccttccaggcagggagaccggaggtcaggatcccactgtaggtgcacactgggtgcgagggaagcggcatccacagctgctgacaatgtcgggctcctgcggtcctgctgtgggtgtcctgctctcaggaagggagcagtttcacgtaggtcactccacacaagtggaagcagctgtctctgaaactccaggaatgtgcacctttcctgctgttgcttgctctcccgtccttttaatgaacttttacacgtcgggggatatttctctgtggttgaatagtgaacattttaactgatcaagagcactatgttctgaattgaccaaaaagggaggggtctgttttgtgcattttagaaaccatcatagcctttgcctgggaaccaaatggaagtaagtttgctgtgctgcacggagaggctccgcggatatctgtgtctttctaccacgtcaaaaacaacgggaagattgaactcatcagtaagtaacctggtccctttcctcttctgagtaggtcagcacagatgatgacccagtcgctgcccaacagtgagcatttgactggcctaggaccactgctgggcaggccgggactcgcctatgaatggggtgtggcctcggctgatggaagtgagcgatggcctggaggtgccgcctccttgcagggtgtctctctgagccccgttgagccctcacgtttaagcgagtatttccaaggcttccattctctgccatcatctcaagtgaagctttttctcttctggctgtagctgctgtccctgggcttggggtcacttcctgtggacatactcctgccagtccccagtctgggtcaggtgcctttgaccagggtgcgcagagctgttgcacacagctgtactctgcccccgtgcacccggttccaggggtgccacactgcacccacctggggctcgctcctcacagtggtgcgtgggccctcgcctgtctc

SEQ ID NO: 124187 - DNA, 1013 bp, Homo sapiens
gagagcggaactaggcggcgtgtagtgatgcagttagcttacatccagcacagggctccgcacagctcacacccggcccagggctcagcagtgagtagtgctatgcagttagcttacgtttggcacagggttcagtccagtttaaatccagcacggggttcagcggcgcagtagtgaggcagttagcttacatccagcatggggttcttattgccagccagaatgtgcaggcctgtgctgtgatgagcgctgctccagctgctccgtgccccgcactccgggtcggttgcataatggaggtgtcttgcattgactgcccacctaccctgctgtcagctcagcacaggcagagctttgtttgcttcacacgtgtccccgatacccaggaccttgttcagcaagtgacatagtcacggttgtggctctctgacccctctgtgtcctggtgtgtccctgccctggcctaggtggacaacgcgtactggctgtggactttccagggacgcctcctgcagaagaacaacaaggaccgcttctgccagctgctgtggcggccccggcctcccacactcctgagccaggaacagatcaaggtcagcatgcccccacccccgggtgcagggcacatggaggcaattgtggcgttgaaaaggtgtcagttttttctgttattgttagggtggtgactgggggataaaaacgtgacatttgcaaggattctttgaagagacgcaggaacagtgagaactgaatggaatagaacagctttaggatagtaacttgaggctttcagcttctttagggaagttttgcatgaacccgaggggtggataaaaagatgccagggccattaaaaagtcctgctgggattagaagcggcttgtctgggatttacattattgtggtaaaataggccgttggtcttaggtcagagcaaagaggagggttaaatcccagggagaaagtccgtctcaaagtgaaagatggaggaaggagcaggcacgagcgctcct

SEQ ID NO: 124188 - DNA, 2227 bp, Homo sapiens
tgctttgaatgttaaatcctgagtgatgggtcttttgtttcagcaaattaaaaaggatctgaagaaatactctaagatctttgaacagaaggatcgtttgagtcagtccaaagcctcaaaggtgagcctcattcccaaaatgagggctgtgctgtgacatccgccatcatggcaaaggcggggctgcggggagctgctgtgtatgtgctcagagttgcctctgctccgaagacactggttctgttcccccccaggagggatgcactggggaactggggttggcacggggacttggagttggtgacctcactgctgccttgtgggtggggggcagcgttgggggaaaagtgagaatgaatggactagccattcctgcttgagtgcctctgtatgctgtccttctggcaccgtccgcctgggtgtgggctcttcgcgatggggaggcacttgtcttaccagttctgtgctttccccaacctcatgcataggaattggtggagagaaggcgcaccatgatggaagatttccggaagtaccggaaaatggcccaggagctctatatggagcagaaaaacgagcgcctggagttgcgaggaggtaacttagagatccctcagtccccaggagctggcccttacgctgcccctgggccctggtgcccgcggactcctgcgttccttcccactggcctcggcggtgccactaggcatgtgcccccatgggtgatctgcgccctttgtcccctcaggggtggacactgacgagctggacagcaacgtggacgactgggaagaggagaccattgagttcttcgtcactgaagaaatcattcccctcgggaatcaggagtgacctggagcactgtggtgagcgtctgcagggggcgcgatgggggtcctgttggctgctcatgctgcttcagttatccccgtcactgaggaagcacctcctttaaggcaggggtgaagggtgaagccctagtgtcatgtgcccagggttagctgagcctcgtgtgaaatgtagagtcggtgccgacgtggcctcgactgcgccctctgaccacattgcagatggcgcctttcaggcagtgctgggtgagggaggagctgtggccaggtgttgggaagtgccaggaagaggagggtggccatgcctggccatttcctgatacctgtgctagtgacggccgcggtgtgtccactggaaagaaacactggcgtgcacggctgtgactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaccggtctttctcctctctttgaatgtagatagagaccttgaacttggtgcctgcctccctccccagtggcaagggcctgcttgccaagccagacctctgcagggcgctgtcccgtccggtcgtcacg

SEQ ID NO: 124189 - DNA, 1052 bp, Homo sapiens
gacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggcta

SEQ ID NO: 124190 - DNA, 1055 bp, Homo sapiens
agtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaatcctgggggtcctggtcttggctggaggtggggcctaagccccagggcagccagggtcaggagaggcacacaggtgaaggggaggcttggccttgggtgcaccgcatggagcaggtagataggaaacgcttagagacaactattttggaacgaaacctggcgtcactatagctgcctgctggtgactacaggtgcggcccacccagggtcagggtggtcgctggagcgtgagccctgtgcttccaggaggaacaggtctaggatgctgggggctctaggtcccagccaaaagcacaaccccaaggctctggcctggtctggccactggggagcccagcccctgcaggagggacagtgactcctgtgaccgggcctggggcctccttatccaacttcactcctgccacgagc

SEQ ID NO: 124191 - DNA, 1050 bp, Homo sapiens
caggcttgctggggacattaggagcacagccaacttgtctcgcagccagggtcgcggcactcacctcgcgtttgtctccagtccacaggcactgaggacccaggccttccaggtccttctccagcccctggcctgtgtcctgaaggccacggttcaggcccccggacccccaggtgtgctgcttagaaagggctgggagggcagaacctgggtccctgcggctgggggaagggagatggatgagagtagctggctcgccacccccgccccactttaatcacacccaggcctccctccaagagcaaaggggaccggggacatggccatctcccctggtgagctgctgctctgcacctaggtcctggcctgtgctgtgggtggtgaccgtggggtggctggtgaccgtggggaggctgaagtgctctctaagggagctcttcctggcttggcccccaggcttgctggacgggacggcagacgatgccacgacggtggacacactcctggcctccaagtcgtcctgcgccggcctcctgtgccgcaccctggctcacctggaggagctgcagccgctggtaggtgcggcccggtcctcatgcagcccagcagcatccacgctggcggtgggaccgcaacgtaggctgacgccccccaccccttgctgccccagcacccttgcatccacgccagcagtgggaccacaaccttggctgatgtcccccgccccacatgcctcgaagtcccagcacccctgcatccacgccggcagtgggaccgcaaccttggctgacggccctcttcctcgcagccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggtgagtgtgttctgtacggctttggcgtggggctatccctgtgcccccactctcc

SEQ ID NO: 124192 - DNA, 1125 bp, Homo sapiens
ctggaatgcagtggcatgatcatagctcactgtagcctcgacctcctgggctcaagagatcctcctgcctcagcccccttgagtagctgggaccacaggtgtgagccaccacacccagctaatttttagattttttatagagacagggtcttgttgtattgcccaggctggtcttgaattcctggcctcaagcgattctcctgccttagcctcccaaggtattggtattataggcatgagccaccatgcctggcctcattatgctatttctttataataaaagttaaaggagaaatgtcagtatataggtaaagtaactcttttttcatttttgccagaatgtttgactagagtcaccacgctcgtggattttgttttcctatttctgtctttctgaagttcatgtgttgagctcacatgttgctgtccggcacctctgaatccacgtgttggcttttccagagtcaccttatctctctaagccgagaaaagtggcctcctggaggtccctcaggacggcagggagcatgcctctgggcggccgagcgtccctgaccccgcagaagctgtggctgggaaccgcaaagccaggtatgtggttgtcgcactggagacccttcctgcttgagagaagagttcgagaaatttcagggagtggtttgagatggagtttttaatattccttgtttgaattacattgtctttagttttctcgaagacatcaaatatacacatcgtagttttatgtcatgcataaatgtggtttcgccaagtggcgctttagcctcccttggtcccgtgtggtctctacatgggagtggtgagttgtcttgccagagccaactgttatagtcttaggagtttggtgggctggtcagtgtcatgctggcaacctgatattagacatggtagaaatatgtataccgtggaaataggcaaacattgtaatcaggactgtattaattgatatttgggagctggttggttaaccatttaccagcacgacactgacggctggcgtctatcagtgattcagctttcttcaatccaggaaagttgattagaaacaaaacctcccattgtgtgtgcttgtatctgtcatattaaacccatgcacattcaaac

SEQ ID NO: 124193 - DNA, 1037 bp, Homo sapiens
gcgcgcggggacctgtgtgcggcgtatacgcattggcgtgtgcgtggctgtgcgcgcggggacgtgtgtgcggcgtgcgcgcattggcgtgtgcgtggctgtgcgcgcggggacgtgtgtgcggcgtgcccgcagtgtcgtgtgcgtggctgtgcgcgcggggacgtgtgtgcggcgtgcccgcagtgtcgtgtgcgtggctgtgcgcgcggggacgtgtgtgcggcgtgtgcgcattggcgtgtacttggctgtgcgcgcggggacgtgtgtgcggcgtgtgcgcattggcgtgtgcgtggctgtgtgcgcggggacgtgtgtgcggcgtgcgcgcagtggcgtgtgcgtggctgtgcgcgtggggacgtgtgtgcggcgtgcccgcattggcgtgtgcgtggctgtgtgcgcggggacgtgtgtgcggcgtgtgcgcagcttcgtgtggatggctgtgcatggcccttgttttcttcagtcattgcacgtgcagaagagcgacgtggacctgatgagaacgaagctccggcgcctggaggaggaaaacagcaggaaggaccggcagatagagcagctcctggatcccagccgcgtaagctcctggcgcttcacggacggggcaaggggagggtcctcggggcagcatctgccagccagccctgctgggggctacaccgaaggccgtcttcatgtctcaatctgcttaccacagggcacggattttgttcggactctggcagagaaaaggcccgatgccagttgggtgagtatggtgtgtgcaggacagagcctttccccagacgctagttactggggacagccacagagggacgcctttccctgcagcacccacgcgtgaagagcagcaggcaggggggaggctgcggacccccaaacccttctccactgacacctggggacaccacggggaggggggccagcaggctcaccacagaggccaagcaagacactgtaggaaaaacccatcacaacgggcgacttccccctcacacctgagaaaatacattaagctt

SEQ ID NO: 124194 - DNA, 1070 bp, Homo sapiens
ctcgaaacctgcttgttctgtggacccctgtatctttccaggatgaggttttaacgcctcagtcctgcgccgtccttgtgctgtttttggcgtggctactcgcatttctgtacctgactttcgagtgcgaagggagagtctttctgggctgtgttttggtttctttaagggaaactgaggccacacgtccattgccttatgtctcctgttcgtacaatagttcccccctcgtttcctgccgaattttgtcaacttaagtttgcagattttgtcttatttcagtgcagaacctccatgactttgctttcgtttctctatcgatgtgtctatctaaagtctactctcttttgagaccgaggggatggcctgacagtgccagggaaaagtgattctctcttccttacaaaaccatccattcaaagacggcttgtcctttctaagctccaaggcctttccgcaccattaatctagtcttttaaagacagcatcttacttggagaagaatatctctggaaaagctgtttactcactttggaaagtggctggtctacacaggagatgctttccagcgtgaggaattctcccatcaggctcgaaacgagtcacttgttcaaggaacaagtcaaatgaaggcccgttcaggcttttccctcccatcctgggtcttttccaaagcctctcctcttctgaacgttctgggaaactcttcctcttgctctgtcccctgggaacgctggcacatccctattaacgctgaacttgggttttcagcaaactccagaccgatatgaagactaccaacctggaagagatgcggatcgccatggagacatactacgaggaggtgcgccgtgctgggcggcggagcggagggcgggcaccgagctgggcggcggggcggagggcgggcaccgagctgggcggcggggcggagggcgggcaccgtgctgggcggcggggcgggcaccgagctgggcggcggggcggagggcgggcaccgtgctgggtggcggggcggagggcgggcaccgtgctgggcggcggggcgggcaccgagctgggcggcgggg

SEQ ID NO: 124195 - DNA, 1003 bp, Homo sapiens
taaaaggaccaatagaggttcaggagcgagtgggcggggcacgctgtggggcgggatcggcgggggatagaccaatggtgggtaagaggcgggacagagggcggggcgcgcgggggctgggctggcgggaggcgggccaatggaggctcgggggcggggccggcgggcggacgggcgggggtgcggagggggcggcggcggcggcggcgaacaaagaggcggcgggcgcgggcggccgagcggagccgagcgcagccgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggtgacatgggcctctcggggtcgcggggtcagggaccccaggtcacggccccctcctctcccagggtcacggcccccatccccgagggcctaaagacccctcatccccccctccagggtcacggccacctcctcctcgcaggtaccggcctccttccttctcgagggtcccttctgagtcctaggaccctttcttccagggtcatggcctcctcctcaaaggtctaaataccctccaacccccagtgagggtccacggcccccctcccgattctggccttcccttctggtgtcactaaggcccctgggtttcatggagctgcctctccccactccgtgagcccccttggccagtggagggcctctccaccatcactgttggcggcctggtgctgtgtcccagcagagacccctccccagatgacccccaggctctgagatcagagcgggtgcctgagcacattgggtgcag

SEQ ID NO: 124196 - DNA, 1037 bp, Homo sapiens
atctgccttccagggcagatagtgggccctgcctcagtttgcctagcatgggggacgtgttttccactagagcctggaatgcccagatgtttctgttgagaccttaatgataagactgaggtcaccatacagagaccttggggaagagcttctgggctgggggaacggcaggtgcaaaggccctgaggcagagagaagcttgagcctcggggagaggcctcagccccacgtgccagagggtcgctctggtctgactgcgcacggggaatgtgctgcctcaggaactggtgagccctctgttccaggcactgtgccagcccaggctggatggccactcagaggggatctgagctctgggagtagggccagtgttctcctagcagagttgggagcctggctcctaagagcacaacacctctgtctgtgccgccacaaggtgaggtcagccttgtgcccagttgcagcctggggggcagttccctggggcagggctggcctgttatcatcctccccactcatcagaaggaaatgagttctggttaaaacggcagtgttggtcgcctgtcgcctgtcttgtcatttacgaaagcagtacacgttcatggaacatttggggaaaagggaagagcgtgagacagaagcgtccctccagctgggttcagtccaagagcatagagctgtagggtgggtgtccctgagaactggaatcctattgcttttgacatgtctcgtactttggaccgtgttccagatgcttgtccagcgtcccacggtgccaggcaggattctgtacctacagatgacagaagcgggccagacacggaggcccccggggagctgggtggaagcttcaggagcaatccctgagtggacaggagctgatgaactaggctgggggtgtacagcgaatgggaccctgcattggggggtggaggtgggcaggaagcccctgatggctggtcccagtccactcaggatttccatcttggccggtgtctgcattcctggggagactccgattggctgagcttgccttt

SEQ ID NO: 124197 - DNA, 1029 bp, Homo sapiens
gtgtgaagctgtgggccctggacctgcttggggtgggtgtcaggccacccttggcccggccgctgcccgcatcaagggttcctatatctgggctcctggtttttgtggttctgagggtactctggccacctctgtccccaggagactctggggttctcaagccccttccttggagtgcagcagcctgggaccctctagaagtccccgaggtcttcacggctttttgtaggtgtggatgttggggtggttattcttgctcagggtgctggctccctgatctccccagttctagcatcaccaggggccactccagtctgtgtgtgcgggacccccgcctgccccccactcgcctgagactcgagggccagctctaggacccctcttctgggcatctccatggtgacccttcttcctcccctgacccctgggcaggccctgccagccaaccccgtctaagggatttgcagtgtcagccgctctgacccccggccgggggctcttggtcaggctctgggggagcggggagccctgcagcttggttccccaggccacggcggctctccccggatgcttgtgctgctcgtttctaaagcacttttcttggagagccacccagtggccctgggaggtggacactgtgtccccgacataagcagaaacgggggccggccagcatggggggccggaagactgggcacgggttccagctgcagcccagccacgtccgtcccagtggatacagcgtcagcacagttcgtgaacccaggggtgcaggtttagggggctcaggggcatctacacttcccccacctgccccaccgtcagttctgctgaggcctcggctagagaagaggaaccgaatctgcagccaggggcctggggtcaaggacatgggaagtgcctgacgtggccaccggggaattggcatgtgacagcgggtggatggtgggtgtgggagggtcacaggagggcctcctgtacccgggcctgccgctatgttctgcagggagcccacccaggccctgtgct

SEQ ID NO: 124198 - DNA, 1027 bp, Homo sapiens
tcctggggaaggagagtgggtgggcgggcagatgtggccccactgtggccctcccagcttgtaggcacggccctgcaccaggccctccctggcctcttacctgccattctctgtgccttctggacctgtggggtgccaccgctccagttcccaggggccccggccctgcctccttttctttttcttccttgagtcttttcctgagtgtccacacatggctgtttcagcccaggcctggtgtcccctttgacttcccgcgtaagacacaggcaggaggggacagggtgccgaagagaaggagttggtggcgaagctgggggaccggggagggggcggccgggctaccaggacagggcttgggaggccgaaggctgccttgctcagaaatccccatcccggggccactgtcatggtcccctgtagcacagagctgggcctggggggcctgggaggggccgggcctgtgaggttcaggccacacaggtgcaggcccagtcccgctcggctgccctcgtcctcgccatcacacggcccacagcccactcctggccccacaccctggcgttgaggccacactctctctctctctctctcttgcaccccacccaccccgggccctcctagcgctatctggctgccctggactctggcagccacgcgggctggcagtttaagcccatggacagtgcccgaacgctgtggtagctgttccctcagagcgacaggtactgacccaccggtcccccatcccgcacggccacccgcctgcgcctcccgcctccaccctgcactcactgccgccctcccgtcggcactgagctggggctccatctgtccggctcctgttggcagggccagctctgagtgccacggctcagccagagacttctaatgccggctctgggcccgccagcctcacagtggggttggcaagtccccttccaggctccccctgcccagttgcttggcctctggggactctgccacagctccaagtggccccagccccttctgtcacctcccagtg

SEQ ID NO: 124199 - DNA, 1098 bp, Homo sapiens
ccctgacacgtgccaggcctgtgggtcctttggcctcagcacatgcctcgcacatgtgggtttctctgtgagcacacacatgcattctcttgcacacacacgtgcactcaagaccttcacactcctgcctggacgagggcacccacgaggtgcaggccagctgcagagccaggcacaggacagcgccccctgcagccgcctctgttcctaagtccaagacccccaggagcccacagttgggtcccccacgggagggggggctgcattgctccagcctcctgtgtggcttaaggggccctccttccatggcgtgaaggggcagagtagcccgggggatgtcctcaggctggggcctccgtactcctgcatgctgtggcctggctgtaggtggacccggccctgagcccggaggaggccttggcccggccctggagggtggctggtttgtgtccttcaggtcctgggtgcgtaaggtgcaggtagggccttggagctgtggctcctgggggtggcagaactctgcctggcccaatgcccaaatgccgctggtgtgggcatgggaggctgtgtgtacgcccctcctcagaggagacatcccctgtcctgagcctggagagttcgggggctgcccctccctcagcctcagccagacctagagcgcaggggcccccagccagcggcccctccttagcccctccctataggctctgtcagggcaccctgtactgtcccattctgcccccagggctgttggctcagccaagtgaggaccacgcggaaggcgcccctggctgcgtgcgccatgcaggggccctgctgatgcctcccccttgtctccctccagtacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctc

SEQ ID NO: 124200 - DNA, 1090 bp, Homo sapiens
ggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaagcctctcttcctgagctgctttggctcctggctgggcgctggtagggagtccacggctccaggcaggggcattgggggaacagggggacactgagggtggggccgaccaggtcagctccgaggggtcggctgggcggggcctcttgtggttgcgggcggggcctctcggggttgtgggcgggtcttcaggggtgggcggggcctcggagtgactgggcggggcgccggggacaggctctccagggatggggtgggcggggcgccggggaaggctttccagggttggggtgggcagggcttctggaatgagtggacgaaggccttgcaaaatgggtggccgaggccg

SEQ ID NO: 124201 - DNA, 1053 bp, Homo sapiens
ttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattc

SEQ ID NO: 124202 - DNA, 1027 bp, Homo sapiens
gaaaatggatgtggttttgcgctgggcctgcccacgagtgttctgagcattcgtcctcagactggtgagcctccgttcgttttgaaatgaagtatttgattctttctgtttcacggccagttgataatgttataaatgaaatttgcttttggtttctggttcaacctgttgcaaaagtcagtctctttccttcttatctttttgccatctttttgtttctattttctctgttctttcttcctccccctaaatttctgcctcatcctgtattttacagaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaa

SEQ ID NO: 124203 - DNA, 1052 bp, Homo sapiens
gcaacaaagtattagtaaactagaagaaataatggaagaaagtatcaagaatgtagagctgagagacaaaaagggagaatataaaaggtcaggaggaaggaggatggggtcagaaggtgtaatgcacgtttaacactgagtcacaggaagaaaagtcggggcagcaccatgtttgaagtgacggtggctggtaaatcatatcaaacagtcaagaaacccagtgaatcccaagcaagattaaaaaaaaaaaaccaaaacactatagacataataaaactgcagaaaaccaaacacaaagaggaaaatcttaaaagcagctacagaaaaaggtagacgtgaactttcaaggagtgacagtttgacagctttcttcccaaaagctacagcaggcgccagaaagagtggaatgatatctcgaggtggtgtctacaagagagcttaactctcaatctaattgagttttgtaaaatagaaggcagaacagagacatttccaaacacagagagttgatgggtagcaaatcctcccaacaggaatcataggaactacacttgaaacaggaagaatgtgatttctgatggaaggtttgaaatgtgtaagaaataatatgaagactaacatctcttttttcttttgttttcacttttggtgtcaaagctaagaatttgttgccaaatccaaggttattaagatttacacctacattttctttttatgtttaagttattttctatttaggtttttggtaaattttgagttaatttttgtatatggtttgaggtaggggtccaaatccattcttctacatgtggacactcagttgttctagcacaatttgttaaatgtctcctctttccccatttaatggcattcttgttgaaaatcaattggccatagatatgtgggtttatttctagactccaaattctattctctcaatctatacatctatgcttatgccaggaacacatcactttgattactgtagctttgtagtaagttttcaaagtgggaactgtgagtctttgagctttgttttcttttcctcattg

SEQ ID NO: 124204 - DNA, 1097 bp, Homo sapiens
cggaagtggtcaaggaagtaaagcgaggatggagcgtgggaaggatgggcctggggtgcagttttggataagatggccaagggcaggccaccctgagaagcttccctgccccagtcctcactgagcattgaggaagtgagccgtgcggctatccggggcaaagggtttcagttgtcaggaaccagaagtgcaaaggcctgaggcagaagtgaggatgtgcctctttgaggacctgagtttttgccatgaatgagatgggagccttgtagggttttgaacaaagcgggtgataagagctgacctaggcttagcaggctaacttgaccactggttttgacagtagactgaaggggacaagtgtggacacaaagcagccaattagaagacttgccataatccaggtgagagatggtggtggccggacccaagtgagagccatgggagcagcaggaagtagggaaattgtagctgtctctggaaggtagaaccacggcattggctgacaggctgggccagacctcaggatggtgcatctcccctagctgcaggccgctgctgctctgtggggagtgaggtcctcctgtgcggcccaggtccctctccatcccatccaaattcaggcccacaggatggtccagggtaacccacagcacctgggcactctcctactacagccagtggccagcctgcagggacagacagcctccaaggccacagtcagctcggcccacacccttgctgatctgcagaaggtgcagaagcagcttttcaggcagcatggtagcagggcctgggtaggccagctctggcttaacccaagtgcaggccgtaagcactgaaggcgctgctctaggtgggtgtcgggtagcactactcatgatggtcactgcttacaggagggagttgggtatgcgtgagaaggaaacatgttcacagattcccgaaagagatattgaaacttgcagaggccaactctgtaattgcaaatgaagcataaattaagattttccgtttagttgtctaaacagttacccatgcagtccatagaagagaagatggatgcctgcagagcaggacttcattaagcagcagcctga

SEQ ID NO: 124205 - DNA, 1013 bp, Homo sapiens
gcggcatccagaggacagagaagcagagggtgggagctcttgcaagcagctagaaaggtgctggagggcagcacatccagccgctctggacggcaaggggaagaaaacatccctgacccccactttcttaagtagagaccaagtagacggcacctctctgtgaacgtcagcatctattttactgtctagtctgaagtccacagcaccaactttgtcacatggccctgttaaatcagaccacagcagcagagaaccagctgtagtgggtatttgctggtggaagtgtgccaggcatgggtaatcaatagctacttaagccaagccgaacagaaactaagcccgaggaacactgagacccgaagaatctgtgctaattctctcgtcaccgtggtggaacgttccagtgatggtgcatggcgtggactcctcgcagccctcgagtgcctgtttggggcagtcagtggaggttgcctggtctcaactgggaaaggccaggctagatgcggggtccacgggaggacctgctctgtcgttcagagctaggctttgtgctctgctgtgtgtatggtagtgagtggaggagacacagtcctggcctcgtggagctgattcctagttcacttctctggggacaggaaacacaacgggaggacagggcatgagccggaacatcactgggaaagtcacttggaggagaggggaggccttgcctagtggaagaggcctttcgactgtccataagatggatgaacacatccacctggactagtctaacgatgtcctggggccaaaatcagggatttgggctgcggagaaatttgtgacaaaacagtttgatgctcagtcaaggtgagatactggcagtcactgacaactccacgggatgcaaattacattcattttaaggtaaaattttgcacatctttgtagacaagatacacagtattccaggcaaaacccttgtgataagggagtcattacttaaagtctcacctgccttccggtttccatta

SEQ ID NO: 124206 - DNA, 1477 bp, Homo sapiens
atgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctt

SEQ ID NO: 124207 - DNA, 1621 bp, Homo sapiens
atacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaata

SEQ ID NO: 124208 - DNA, 1835 bp, Homo sapiens
ttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatat

SEQ ID NO: 124209 - DNA, 1067 bp, Homo sapiens
aggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttacctttt

SEQ ID NO: 124210 - DNA, 1032 bp, Homo sapiens
cattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttc

SEQ ID NO: 124211 - DNA, 1350 bp, Homo sapiens
aggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatat

SEQ ID NO: 124212 - DNA, 1885 bp, Homo sapiens
aacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctgggga

SEQ ID NO: 124213 - DNA, 1266 bp, Homo sapiens
tcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcggg

SEQ ID NO: 124214 - DNA, 1039 bp, Homo sapiens
ctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaac

SEQ ID NO: 124215 - DNA, 1033 bp, Homo sapiens
gtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctac

SEQ ID NO: 124216 - DNA, 3425 bp, Homo sapiens
aacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaa

SEQ ID NO: 124217 - DNA, 1113 bp, Homo sapiens
aacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttg

SEQ ID NO: 124218 - DNA, 1097 bp, Homo sapiens
gggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgata

SEQ ID NO: 124219 - DNA, 1018 bp, Homo sapiens
attaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaatt

SEQ ID NO: 124220 - DNA, 1012 bp, Homo sapiens
cagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaagg

SEQ ID NO: 124221 - DNA, 1051 bp, Homo sapiens
agtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatat

SEQ ID NO: 124222 - DNA, 1717 bp, Homo sapiens
tattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattc

SEQ ID NO: 124223 - DNA, 1560 bp, Homo sapiens
tgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatc

SEQ ID NO: 124224 - DNA, 1030 bp, Homo sapiens
cctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgt

SEQ ID NO: 124225 - DNA, 1250 bp, Homo sapiens
aaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtagg

SEQ ID NO: 124226 - DNA, 1008 bp, Homo sapiens
ttgtctattctttgaagtaccttgttcatttcataggaatttggtactgtatttgtagtacctttttatactcctctttatgtaaggtatgctttcagttgtcatactttttgtatggctcatcacttttaaatgttgctggtttcaaaagacttgaaatgcacaaatcgtttgctgtttatgtattagtttttaacattatctgatgttgacaggcagtcgatatagtgctggatgtagccactccccagtgccatgaagaacccagtttctgcctgcctttctgcttctccttccttaatgtgttaatttttgttctgtgcttttgccttatagttgaagcatcactttcctgtttcaagaaggaagtggggaggaggacaaagggacaaaggagatgtctgtagaatgtattggctctcttttttaaaatcagggaagaaaatgcttttctaagtccccaccccataaattgcttcgtcgcatattgttgggaagaccttggtcacatgaacctcctggtcgatcatgaatcaagggtagtgagatggctccacttggtttagaccagttgtgatccatgtccttggcctggggtaggggccttcccttcctctccagtactgtttgaactgattgggattccttgaatagaaaaggagagagaaataatgtgtaggtaagagaaggtatctctcgtgtttattgaggcttttcaatatgtaatttgcttttaattttaagaaacttgcctgcctcttggatagcaaagaaagtgatttttatttgtattggtcttgcttttgccaaacattttaaaattaagtgatttggggataagtatttattttgaagtctattttattgtttattaagatatatttcaaagtggtataataaatgacattattattttcataaactattgcttcctgaagtgtttcaagccaaataaacatttatctttttgatgggaaaatgctttctaaatttccctcagccaagtta

SEQ ID NO: 124227 - DNA, 1026 bp, Homo sapiens
tcagtggcccgtcactataacattaaataagatcttaattgtaaaacacacttaagtgatacactttttcccaggagagagctgataacggtctttaagagcttggaccctggagatgcgtagtgtggtcttgaattcctgctctggtgctgagcagctgtatgcctttaacttctctgtcactgctgcctcctcattgaaatgaggctagcagtgggacctgtctcgtgggatcgctggagggtcagataagttagcatatctgaggctcccaggatagtgtctggtgtggaagcatgtgtatgttttagctgctgttattatcattagtttcaattccctggcaatagcactgtttggagtctcactgtgtattatttaacagattctgaataaagccattttatcttctttttattctttatagatgataaataatgttcctacaactcgaggtatcacgctgtgtttttaactttttttttttttagcattactgaaagaagttgtatgtactttatcttattttgctccctaattataaaatacagggaaaatcatattcttttgcatgaacaaatgagctatttgaaacaggttgcttggtgaaagtgaaaatttaaaacaggattcaggtcaagtataatatattggtttacacttaacagagttcatagtgatttttatatgtctcctttctttttgatgaagaatgtctgtgttccgactactttacttctccgttcattttcatttgttacattctgaaagcataaaacgtgccattggttaatcaatttagtctagtggaggtacacaaattcaaggtaaatttggctaatttctcctgcaggctagaagataaaatcctttccccccaccacagttaggttagtagtgcttgacgtgatcagatgcctcttcagaggtcacctgatttaattgtggttgtgaagcagccaatccaaatccccatattttaatttctatccctccacattctcggcacagaataattaagagtat

SEQ ID NO: 124228 - DNA, 1003 bp, Homo sapiens
taaaataatttcaacttttattttagattaaaggtatacatgtgcaaatttgttatgtgggtctgttgcgtgatcctgaggtttagggtacagatgagcccatcacccaggtagtgagtgtggtgcccagcaggttttataacttttcagtctagtcccacccacccttagtagtccccagtgtctgttgttcacatctttatatccatgtgtactcagtatctagctctcatttatacgtaaggatatgtggtatttgtttttctgttcttgcattaatttgcctaggatagtggcctctagctgcagccatcttgctgcaaaagacaagattttattctcttttatggctgtgtaatattccatggtgtgttcctaccatgttctctttattcagtccaccattgataggcacctaggttgattccatgtctgtactgttgtgatggaaaatattcatatttcagaagtaaggaaagaagagagggacgacaagacaggttatcagtgtttcagagcaaatgtctttagactgcctgtctcatggagtttgtatgtttttactctaaatctccagtctgatttttgtgtataggagatttacaatggacatttctgcattttagaagtagactatgttgtacagtctcctgttatttcttgggtgtgtctttatgtgtgaatttgtgttttctgttgatgaaacaagaaaaaatatatacttaaaacacccaaatatatctgtagataatttacatatcagttgatgaactattactgtttttgatagaaaatccatgtggcttaagcaagggaaaggtttgtttctctcttaaatgtagagaggtagatagtccagggttggtttggcggtcccacagccattaggacttgggcgtctttgtcagtcactgctcgccattcacctcgtgtgtctcgtcactgtcctaggtcagtgctctagtctgactatgatgcatttcagcatgcacgaaggaggaga

SEQ ID NO: 124229 - DNA, 1013 bp, Homo sapiens
cctgtttgccaggttggtcatattttctatccccaagttaggggctgtggggagatggaggccaggggatctcacttggacctatcaaggagttggagcatggctataaatactttttccagttgctgcttagtttttagcaattccttcaaaactagatagagagagttggtgcttagtttttagcagttccttcacaactagatagataggtaggtagatagacagagcttaaaacaattattagcaagtttccatgggattttaatgggaaaaggagagaggaaatgttgggcctttgcctttattacctggagtacgcagaagagggtttcttgaggaagttttaggctagaacagctgagtttctgcccgccttgaaagtccactatcagagagatccctgctgcctggagctcagtggagatggatggacttgcctggctcattaagagcagggccgtatcacatctgtctttcaaaaccttgcatctgacataattcgtgatgtgtaataggtgctcaataaagggttgtagattgaatgactaaatgaggcagcgatcaccatggcagtcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcatctgatgggagctgttgccagctgcagccagtaggcataatgacatacctcctaattttttttagatttaagtaaaactctggatggtagtgtgaaatatctttacttttcatttcaaatttatgatattttgagtcacaaaaaaaacacatatgtggatcacatttgattgaaggccttctcattgtcctctctggtaaacccaaaagaagagggaggccgggtgtggtggctgacgc

SEQ ID NO: 124230 - DNA, 1041 bp, Homo sapiens
cagtagatcctattccaggaagttttattttactggaggaaagcccagttaaaatcccagtgttaatttcctgtcatgttaactaccaaagaacagatttccaaagtgtctcaaacatttgacacaatcatttccgttttctaaacttgatctgtgtttcttgggtgatacatgcattctgattcgaaattgaacaaagtatattcttaagtataactatatcctgtctaaggcagtggactcatggagtatgttttcatttttatgttaattgtcgagagtttataagtcattgtaaattagtctgagtgctttgtgtgagttagaaattgtctagtagagcaaaacccttttactaaactcctcctgtgtgcttccacttgctcagagccatgcaggcaacttcttacatgcagaggagggcgtaatctaagccatacgctggtcattgggtggacttccatgcctctatgcctttctcatgtgtgtttgcctctgcctgtaattttccatccattcccaacctcttttccttctcttccttcttatgaagtcctagttatgcttcagggatgatttaatatgtcagtccttctgtagagatccctaagaccttcttaccactgtacccatgaaactttatatataactatggatatggcacttatcaaataatatatttggtatttatttttctcttccacatgactgtgtatatcctaaagtccatgtcactaatttctgcatctaggcatgtatctgacataggggagcttttcagtaactgatggttgaattaggtggaattcctccaataagacatcaccccaatgcatgacttaggcaaataaggtattaaccctgtgtggtgttgaagaaccattaagcttaagagtattaaggagctaaatgccctcttatgttttgttatgtaatttaaacagaggaacaaaaaataaaattctttaagagaagaaggactagatatgtccgtaagccttgataaactaattataaaacttgtgggtgcagcacatcaac

SEQ ID NO: 124231 - DNA, 1051 bp, Homo sapiens
ataatacttataattaataattattattttgagacagagtccctctgtcacccaggctgaggtacagtggcgtgatctcagctcactgcaacctttccctcccaggttcaagcgattctcctgcctcagcctcctgagtagctgggactgcaggtgtgtgtcaccatccccggctaatttttgtgtttttagcagaggtgaggttttaccatgtgtccaggctagtctcgaagtccttacctcaaatgatccacctgcctcggcctcccaaagtgctgggattacaggcatgagccaccacttaagcttatttcacaaatgtttctattttggttattgggaacaaaaatttatatatatatatatatatatatgcatgcagcatattttaaaattctagtaaaaataccagttaccttagaagatgggataattgctatccttttttctttatttaattacaagttacttaggtatccacctttatattgattccaataataaaagatgcctcgagtttcgatgaaacaaaaatgaaggatcaatttttcattcttagtagactgttaggctttaaaaaggcaggtaagggccatttgcggtggcttgttcctgtaatctcggcactttaggatgctgattgcttgagtttaaagcaatctggagtttaaaaacagcctgggcaacatactgaaaccttatctctactgaaaattaaaaaaaaatagctgggtgtggtggcacgaacctgtatttctagctatttgctacttgggaggctgaggtaggaagatagcttgaggccagaagttggaggttgcagtgagctacgatggtgccactgtactccagcctgggtgacagagcaagaccctgtctccaaaaaaaaaaaaaaaaaaacaaaaaacaacaacaacggcggggcagggggtggcaggcaagatacattcttgtataaatattctagaagtttccagtgctgaccacagtatgaccaggcaaacttaggataaatgttgggggagaattggtaccagggatggggggagtt

SEQ ID NO: 124232 - DNA, 1029 bp, Homo sapiens
ttgcattttgttacatcttatgtaagtggtgatattagcattactacattgtaacacagtacacaacatctgaaaatggtcctgaggccttcaaagtttaaatgtcgtttaatacactttattgaagcaggtacagaactgctgtgtaattaatttcaagacacttattttctctcaaaagtgcttctaaaacaagtttccatgcttgaagcgttgagtgtcaagtatctgggagatttgcttttgtaggacggttcatttcccacttgtgccagaatgagtcattttgtgtgtaagtgtcaagcttggagaggttctaattaagtgcaaattacaatgaaattaataaatgacaccaatttttagattttaaaatgtgctttgagagaatgcaatgtgggcttagattgatggtaattctcatattttaagttgtgattcaatattatgtagcattaaaactcaattaagtaaaaaataaatgaagaatcaagtagagagaatactcatctctcagatgcctcagcttctccaatgatggcttaaaatctgttaaatgctaaggttgtaattgtccttattgttcactatattccaaaataattgcacatataattagcttatttagtgagagatactaaatcaccctgttcacaaatatactagatcgtcataaattgtacaaatgtaattgtaaatttaaggttttattttactttttgcagatgagctgcagactatatataaattcatgtatgtatccacttaccagaaattttattaaatcaaaatatatttgacccagcattttccgatccgtttacagtgggagaaggtaggctacgtaggttcttccctcctcaggtggcactagtcaagactgacagagccaccagcaactgatagcccaaagatatcctctcagcctaccgaaccagacacccctcaccttctacctggtgatgcagggaagcccagggaagtgcgttctgtcccacaggaggcaatagcagggatagagaaggatcc

SEQ ID NO: 124233 - DNA, 1028 bp, Homo sapiens
ctcaatagaatttataaagacaagattgatctccttgataagtcttaagcgaggaacgtgcctgaacggctaagtgcttgttgcagacattatgagcctgtctgccgcacatgaatccagctgtgtgtgtgcacatgcaggtgtgtgtatgtgtgcggcccttcattatttgaggcccctaaaaaatcacgtcgttgccaaaatgagttccagaaattcatccagtaaccagggcacatggggaccaacagaagactttgagcttaaatagtcctggaccccagatcgtgcaggcctttgacctctgttcgaagaaatcaaaactgtgccatgaagacagaaccagaaacctagagtcgtcctctggacctcgctccctcgctccctccctccctccctccctcccattgtctagcagagggatcatcactcttcctccacggtggttcttgaatacagtccttcctccattcctcttgccctagttctagtctcatcattttggcctaaatgacttggtatcttaatttttctgtctccagcgttttctccttcactcaaacgtccacatggcctcaatattcctacttttaaaacatcaatacgatgaagtcaccaaacttaaaaataatctttagttgtttctcattgccagaggatgaaagtccaaagtccaacccccttaggaagatatttaaaactttacacaatgtcattctaagtgattggttttttgtttgtttgtttgttttttgtttgtttgtttttttgtttttttttttttttgagacagggtctcgctgtgtcacgcaggctggagggcagttgcagaatcatagctcgctgcagcctcgacctcctgggctcaagcgatcctcccacctcagcctccgaaagcatggggattacaggcgtgagccactgcacccggccgcctttctttccttgtagctttttgatggctgtgcattatttcatgtcccactagactgaggctcagtgagggcctcttgcgtttgaaagccttg

SEQ ID NO: 124234 - DNA, 1030 bp, Homo sapiens
cctgttgtgtaatgagaagccaccctcacccccaattctcttctgctcttccacctcactccgtcttctgcagtttcatatcgtccaggttaaaaacatttaaattctgtttcctaggcacaattacatctggcattttagactatggattaattctaaagttgaaataaatatacactgtttatatttactatgtaaagattatctactgcacagctagacagtatagagagattatatttctttcttctacagatttttttcaccgggatttctaattgcctttccttttaaaaagaagtatttgcttgtgtgtgtgtgtgtgtgtgtgtgtgtgtgtgtgtgtgtatttttttgtaaacatggggtttcactatgtatatcttttaaaaatacatatatatctatatgtgtatctatatctgttgcttaaaaatatctgtatctatatatctttttaaaatatacacatatatatttatatatatttaaattacacaggtaaataacagaagaagtaaaaatcctgtttgaaagtatcatgaagtggtgtgagctaaaagctcatctgttgtagcagaaagtcaatagataatgtctaaaattggctaaaaacaagacatagcaatagatgcctataatttaaagacatggagctcaaaactaagataaaacactaacagatttaggggagattgccttagggagagggggtatggttttgtttcattttaagcctctctgtaatgttctttttaatttatgtgcacatatgaatttgattgaaatttaaaacaattttttaaaggaagaaaatataccaggatcatgtactacaatgagcactatccttgctattgaaatatctggattcaggtcacgtaatattctactgaaatgtttttgtgcagtctcaacagaaaatgcatagctttgccatcagaagacctatataaccttgaccttgttgtggtggtttccataagtcagattcaccttgcaggtgaccttgtgtgtgtatcaccattgc

SEQ ID NO: 124235 - DNA, 1022 bp, Homo sapiens
ccaggatgacttcatattccccaaagcatcttcctgtattgagcacaccagagggaccaggctcctaaggccttatggattgattaattgttaaatcatttaaagacccaattagcatttcatctctcctcctgaaatcagagtctaattctcatgggcctggagtacagagaaaacccaatttacagagctgacttggagaccctgaggcattgggagaggtttctttctataaaaccagttctgacagagccctcgtaaggagtgaagaatttaatactgtttcccccagagttatcaagccctgtcatcttcatcctcagagtgaagtcaaagaagatgggtttgaccaagtcatcatttgtgcattaaagggccaatgctttttatgtagaaaaaaagtacttatctgatcctcttctgccagagcaattccccctacagccacaatttcaccaattgctttctttcgagtctttttcaaaactgtttttctcacacacaccttgcttcatctctctcccgtactgttgggtttccgttactgttgttgttaatttctgatattcctgaggtgtcctgtgcctgacggtggttttccccctattctctttcaattacaaagtgactcagcactgggcttcgcttccattgttctctgggacctcttccatttatcagcctctgtgcttatcactgtctgtgagtcactctactgatcatttatctcctttcaaagctggcagagtaatgcttcgacgcaatctatccccattagataagattttctgaaatggattcagaatatattaaagcctcatttatctgttattgatgggttagtcaaggatctcacaaagcttcattttccaaataaccaaaacttatcatttaaagaaatagtggctggccgcagaggctcacgcctgtaatcgcagcactttgggaggccgaggcaggtagatcacgaggtcaagatttcaagaccagcctggccaagatggcgaaaccctgtctctact

SEQ ID NO: 124236 - DNA, 1095 bp, Homo sapiens
aaaattatttctgaagctcctctggccattagtctcagttaggcagccattgggagcaggtaggatgccaagcgggaggtacccccgctcctggctccgggcgcctctctcctctctcctctgggagctggaagcagaggatgcatcccctggccagcactgcctgagccctccacgcacctcccccaaaagctgttgttcataaattaggggacgtctttcccacctcacgcccaccactctgtctgtgctcacaggcatcacacgtcttgggcctgcaccatttctgctggcgtttctctgcagatcagcctctctagctatccgtttggtttttgtttgtatccacaaccatttgagcacactatattatcaatgttgatcctaataaattctatcaacactgctcttcctgaagatgctggaattgccgtgtttcagctctaggtcgacatgacaaacatgacgctgtgtttcagtaaattctgatgaaaaacagcttttaaacaaataaaattttctggcagacaagttgtaatattaaacaaagtctgctcttcccataggttcagagtagaccccgaggatcaaattatttagcgattgaccaggtgtgacccaccaaggtcagggatgtctcagttcccttgcacacatcaggaggaggtgctggaggaggaggcgctttgagagcagggtctcgtgcaccatgagaaacaaactcacccgtccaaacccaaagaatggactcagagacccggagaacagcgaaagtgagacttttaatgccggtcttgcaagatcgagtgtgtggtgggcaggcacactcagcacggccacaacaagcgatttatcccctagtgctcaggcccctctcccagttcctcataggctgagcactatggggtggggcgggggaggtcacagtcttcccggacatcgcctattggttgttgggcagggggccgtaggtgtttttttagggttgtcctgttgcattttgttgcagcccacaatgcactgcaatcctagtcagctcagggggtcttcaggtatttgacttacgacctaagtagctgggcaggctgataagaa

SEQ ID NO: 124237 - DNA, 1023 bp, Homo sapiens
agagcagcttagggttgggtgccctggaggagagcaccttggggtagggtgccctggaatagagcagcttggagtggggtcccctggaatagagcagcttggggtggggtgccctggaggagagcagcttggggtggggtcccctggaggagagcagcttggggtggggtcccctggaggagagcagcttggggtggggtcccctggaggagagcagcttggggtggggtgccctggaggagagcacagaggacagcagcttggggtgggatcccctggactagagcagcttggggtggagtcccctggaatagagcagcttggggtggggtgccctggaagagagcagcttggggtggggtcccctggaggagagcagcttagggttgggtgccctggaggagagcaccttggggtagggtgccctggaatagagcagctcggggtggggtcccctggaatagagcagcttggggtggggtgccctggaggagagcaacttggggttgggtgccctggaatagagcagctcggggtggggtcccctggaatagagcagcttggggtggggtgccctggaggacagcagcttggggttgggtgccctggaatagagcagcttggggtggggtgccctggaggacagcagcttggggtggggtacctacagcatgcacagctgcagatggcccaaggaggccagagctcccggtctgtgtgaggacagcaggtcttctggggcaggaaaccagcttccatggctggaaaacccagggggctgctggctcctgtggcaggaagcagagtgttgtctgtgttcataatcgagtctttgttttagtggctgtggttggcatggctgcagttgggccctcagatcttgcagattatgaccaggcagcaggctcgccaagccgtgggcactaactcaagctcccctggagcgcagtcactttacaaccaccttcctccccaaatgccagcatggacaaattagatccagaagccctgcacacagccatc

SEQ ID NO: 124238 - DNA, 1019 bp, Homo sapiens
agctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgt

SEQ ID NO: 124239 - DNA, 1050 bp, Homo sapiens
cagaacttgaagtttcatcagctgaaagtttttcattttcttctatctcagagatctcagcccacttgcaagctttttatccttctgacggctccccccagctccaagtctttgttgacgttcagatcctgtcagcctagatgatattatctgcttccttcatccttgttctatctcaggcatagcctaaaaatcaagtctcttctgacggtcctggcattttctaaggttgtgattttatatattacactgctttcaggttgaatttttctttcactacttcaaagtccctctttaatcatttttcaggttttctccatcaggtttttgcgtgggaattttggagggttgctgccgtggttgtactaaggtgcagggtgatgcaagcccccaatttgggctccatttctcagttgacctccccctgacaccctgtgctccagccagactgaatgaccagaagattctgaacgttgcacacacgtttttcctttgcttatagtccccacacctctgtagctgcctggtgaactgctattcattctcagttcaagacatccttcccaggaggggtttctggctcccaggaggagcagaccataccccttcaccttggagtcgccactgccctgggctcatacatttctaacacttatctcagtgtttttcacttatttgcatatctgtctcttgaatcaactatgagctctttagacaatggaaacttcttttatcaaactttttcacctttgcaccccttgttgagcacatgatagacgtgtattcgtcagcaagtgctgcaattatgctgcgtaacaagtcatctccaaacccactggcagacaatgacaggcatgtttctggggttcacctctgctggttggctggagtgtgactgatcgagcctgggtttggttgagcctgtctccaggcctgggttccattcacctcttccctctgtgcctgttattcttctggggtcagctagatacctcaggcgtgttcttctcatggtggtggcctaagtgtgagagcacaagcccaactgga

SEQ ID NO: 124240 - DNA, 1393 bp, Homo sapiens
cgttaagttggaaaaatgtaccatatactgttattcaaacaatccacatgtctgaattgtggatggcattttaagagctttgtccacaccagccatgactgatgcatgttgcatttgcctgtattttctccaatgtcagtgtagcgcatccactagctttggttttttgtttgtttgtttgttttttgagacaggatctcgctctgccatcccggctggagtgtggtggcgcgatctcagctcactgcaaccttcgcctcccaggttcaagcgattcttctgcttcagcctcccaagtagctggggctacaggtgcccaccaccacacctggctattttttgtatttttagtagagatggggtttcaccatgttgcccaggctggtctcaaactcctgacctcaggtaatcctgccagcctcggcttcccaaagtgctgggattacaggcgtgagccactgtgcccggccaagacccagtgttttctttctcccagatgtgctcctagaccaggatctgtctttctgtttcactttttctgtaaagaatggtaatggcagccaggcacagtagctcatgcctgtaatcccagcactttgggaggccgaggtggaaggattggttaagcccaagagtgtgagaccccatctcaactaaaaatacaaaaaaatcaacccagcatggtggcccacgcccatagtcccagctagtcaggaggctgaggcaggagaatcccttgaacccgggaggcggaacttgcagtgagccgagatcgtgccactgcactccatcctgggcgacagaatgagactccgtcaaaaaaaaaaaaaaggtaaaatggtaattatgcggtgtcaaattttgataggaatgacctgccctgtgcctcggtgctgctcccgtgaggcccagccagcacagcaccaagggctctgcacagagggacggcctcccctcaccctggtcccgcatctgctgcagatttgaggtgggtgggactcattttctgatttgctggtgatgggtgaatatctctgcttccctgcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggtaaagttctctgagcgcccgtcctccagctgttaggaaagctgagctgccctggagtttagagatacgtggcgcagtcagccctccggatctgtgggctcaggctcagtgtacgggcatgcaactgatcacaggtcaaaaatattccaaa

SEQ ID NO: 124241 - DNA, 1014 bp, Homo sapiens
actccgtaggttgttgcgttcactgcagcacctcacatgataccgtcccctctcatggaacggagcctcccccatgcagcccccactcaaatggagttttaaaggctgggttcaggttacgggggcgtttctcaccgtctgaatgcggaggacagagacgagctccagggagcgtgggcgggtgacggcgctgagatgcgtgatgtctcggaaacgtcctcgcatccctcagcgcgggcgctgactgccgcggcccttgcctgtcttccaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggtaaggagcgggcggccctcttgcggggcggggcggggcgggactcgtgggggtgcgggaggggtcaccgtccgctctccgccctccgtgcaggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggtaatgcagccgcggctggcagccttcgcaggaccctttgtggtggtcccggccggcaagtccccaaggcagcgccattggcctgggcctggggcttgaggaggatgattctctgcttctgcctctcgctgccttgtccctttaaatcagcatgagctgggcaggtggctcatgcttataatcccagtgctttgggag

SEQ ID NO: 124242 - DNA, 2132 bp, Homo sapiens
gctactcaggaggctgaggcaggagaatcgcttgaacccgggaggcggaggttgcagtgagccgagatggcacccctgcactccagcctgggcgacagagcaacaaaattctgtctcaaaaaataaataagtaagtaaaatattgttctaaaaccctagtaattttcttcccaaacctatttcacccatgggattttcctctagcaaacctattttttcccagtgccgacctcactttccccacttgtccgacctgctgcccaggcgtcgaggaaatcgattgtctcgttggccgagtgtggtgctgacttggttcctgtcccgcaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacggtgaggccctggccctgttctccatgccacatcccaagctctgtggctcccagtagtcagtgcggcatgagaatgttctcccagtatctcccgatcctccactcagttcaatttattgagcacctgctatactccaggcactggggtaatgcaaagaaaaagagggtggaaggggccacctatcatcccagcaccttgggaggccaaggcaggcagatcgcttgagctcaggagttcgagaccagcccgggcaacatagcaagaccccatctctacataagattcaaaaacttagccaggtgtggtgttgcacgctcatggtcccagctgcttgggagagtgaggctgtagtcagctgtgattgctccgctacctgccagcctgggtgactgagcgagaccctgtccctttaaaaaaaaagtggggggaaagaaaacagggtggaaggaaaacccagatctgcccactctctggagctcacactccatggggtgaggcaagaggtcaaaggaaggaggagagttggggtgctggggtgcaagggtgctgggcgggggtgcagggtaccagggcaccgggcgcattgtcagtggggtggctcagggcagtgcatctgtgtaaaggagtgaggcaagccgtcgatgtccagcaggatctagacagcaatgagaggggcctccacccaacaggctggagccagcagagacagggcagatgaggtggggaggggacggcagggcccgcagggagcagagcaagggtagccgtcctgcctggcaggggtgcactgacctccggttccggcttggtggcttagcccctgtataggggacttgaaaaaagcagctgggtcctaaccagaccccagagtaaccctcttcttcctccactccagccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaa

SEQ ID NO: 124243 - DNA, 1085 bp, Homo sapiens
tgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctggg

SEQ ID NO: 124244 - DNA, 1015 bp, Homo sapiens
ctcccggccctggtggacgctggcacagccctggagatgctgcacgcgctgctggacctgccctgcttgacggcggtgctggacctgcagctcaggtgggcccctcaccctctgccagcgctgcgtctcccagccagctggttccacacactgggccccctcctcgctgctcctgacccctacaccggggaccctccttcttccccccccaacacctgaccagtcctcccctgcaaagccacctctaggacagggtgtgtctgtcacccttggccacttgccaagggcagcccctgcaccctggagtgcctcacccgtcttcacgcccaggcctggagcctcccatgccaagcccttcctggcacccgaggtgctgtgatattagggacacctgccgtgtgtctccctgacgggggtgcccttgagtgcaggggccgcatcccagcctggccttgggcgtctgtccacgcaggtcagcaccggctgcatccgagaggccactctgggacacctctctcagggcccccagctgcctggaggccttccgggacccgcagttccagggtcttttccaatacctgctgcgccccaaggccagtggcgccactgagaggtacggggccctagggccagggggccaccagtggctcagagagcccggccacagccactggggtggggctcactgctcagccctaggctgaggccagggtgctttgtgtcccacacaaggctgcgtccccgtcatcaccattatagaggccctgcttctgcaccacgggtctgccgggggcggggcctggtctcagctctctctgctgcccacatcaaccctcataagcttggaggttggccctgtgggtgctccattttgcagatggacaaaccgagcctgagcccaggaagcaggaggcctgggaccggccacaggcctcctgccctcagcccacgccagcctttgtcccgatggctttactgtcccgggtgtgctgacgccaggggtctccccaaaccc

SEQ ID NO: 124245 - DNA, 1330 bp, Homo sapiens
acccaggtctgtgcagccgcggactctggccttggaccctgccttgtggagtgacttcccccatcacctgcagggctcaggagcactggccactcccagccagggccactgtggggcgtggggagacccaggtgggggcaggcccccggcacatgtgtctgggagtgggagagggtcccagctaggggctgcactgtggagtcagcggcagtcacagcccaccctgccctgctacgttcacctcccaccgtacccccgctccagagaggggttcaaggctggtcagttgccttgaaaaccgagggaaggtgtcctgcctgtcatcgagctgtgatgtcctcagtggcccagagccgggaagggcaggctctggggacaggcccatgtctgtgtccccccaggagggcagcccaggcatcaccctcccttcttccctccacaggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccaggtaggggtgcgcatgggaggcggcgagtgtggggaggggcggggccacatgctgtgggtccctggctcacaaaccaagcctgggggccgggacggggcttcttggctggaaacctcaaagctaccgtaggtaatcagaaaagttgcttccattccatggctgtgtccacctgcggtagacaggataatggcccaaagatgtctgagacccgtgaccgtcttaccctgtgaccgtattaccccacatggcaaagaagcctctgtacgtgtgactacgattaaggaccttgagattcggagatgacctgggtatccgggtggcccagtccactcagacaagtccagaaggtcagagagaaacagaagaagaggggatgtggctctgaggctggaggaggggccaggagcacaggagtgcagtggcctctagaagctggagtgaccccagctgacagccagtctggaaacgggaccccagtcctacaaccacaggaactgaattctgacagcaaccggaagagcagggagacagatcctcccccgggggcttcatcttgctgtcagctctgtgagacccggctgagctgtggagccgcggagctgtgagagtgcactgtgtggccgtgaccgccaggcgtgtgggcatttgtcacaacggcaatgggaaaccgacatgcccctccctgcttccctcgctgctcaccacccccctccca

SEQ ID NO: 124246 - DNA, 1035 bp, Homo sapiens
gccccacagaggggcctgggtcctgtcaccgagataagacagcagccacttagatgcactggggaggggcgatgacagggccatgtggtttttgtcaggggctggggaacggtgaggggaggcttggtttgcctttgcaggaggggtaagtgttaaacccgcgcagagcccggggagggctggccttccttgctttctcccttcctcccgttacattttaggttggggcatctttgctgagggaggcgtccgtggttgcagggcgatgagcagtgtccctggctcctgtgcccccacccccaagttgtaacaaccaaagatgtctgcagacatggccagatgttccctggaggcagacctgccctctattgagagctgcagtattggacctggctgcctggactcggccacacgagcccctgcccactgggaccatatggctgagtacctgccccaggccctcaggcctgatccacagtggcgacatttgtttctcctgggccactctcggaggggctgggtgcctggcaaacccagggtctcagggatggtgacgtgcagagtcttggcattcatgcgttcctggagacagggacatcaccgtggctttggatgcgcactttgtaaagaggcaccctagagagtttgtaaagccgccgaggtttagccaggaaggttcaggctaaacaaagcctgggaacaccaccccagcactcactgggcttttgactgaaaaacagcccatccaatgtctggtatacagtaggtgcttattaaatacctgtggaagggttggtgccctgaggagaggaggcccctctgtgggtcttagctcctatgcgtctgcaagactcccgagtggggtccgttttctttgtgtgtgtgtgggagggtggtgtggggatggtgtggccgtccaggagtgtggatgtggcttgagcgacagaggaacctgcagccctggccacctggcggcgtggtgggctgccctcctgcccccagtgctgcgatggagctggcaggcgggtggcaggt

SEQ ID NO: 124247 - DNA, 1617 bp, Homo sapiens
ccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaa

SEQ ID NO: 124248 - DNA, 1057 bp, Homo sapiens
tagttataatgatcatagcttactgcaactttgagttcctgggctcaagcggtcctcctgcctcagcctcccgagaaaccgggactacaggcgtaggccccacacctggctaattttttttttagtttttgtaggcacagggtcttgctatgtcgaccaggctggtgttgaactcctggcctcatgcgatcttcctgcctcagcctccagagcattgggattacaggtgtgagccgttgtgcccggcctgaagatggtttctaagatccttcacccttaaagttttaagtaattctgcctgctatgcaaaggatatgtttgaggagggcagggggtgacttaggaggatatcatccaacagcagtgaccagtgggaaggagactgtctcgccatcaggacttgtgtgacccacaggacgtgcatcatgcagccaagggagaacttaggtgacgcccagtttctggcttgggttctgggtgaatgtgataacatcgtggtgaaaaagccgagaaggagagaactctgcttggggatactgatgagttggaaaggccacagggatatggaggtggaggatgtgagggggagcggggatgggggtgggctgtccatagccctgaaagagagggcaccagggcctcccaggtctgggctggcagccacagttgaggttgcttttggtttacagtgtcgggctctatccgcctaagcacgcaatcaagtatggcttctccgcaaagatgatgaagaaggagagtctttacggactgacgattagggaagggggagaaaaggaaaataagcaaaaaatctgactcacatcttcatttttgagtggcagtcactgtctctttgatgttcaatgttcaagtttaaattcattgacggagactttcagttaaaaatgatggatcaaacataagcatttattttggttccatccccagaccctaataaaatgttaatcagtaaaatgtcaaaaatatacattttctaattttaaacatttcttaattttttatttttgtagagatggggtttcactttgttgcccca

SEQ ID NO: 124249 - DNA, 1057 bp, Homo sapiens
cttttgaagtgatcaccagtccagttaattaacatatctatcacctcaaatagttacctttttgtgacaagcacacttaagatctgctgtctcagcaaatttcaagcacacaataccttattatcaactacagttactatcctgtatgttagatctccagaaaaagttttttggtttcttttcttgagacagtatctcgctccgtctcccaggctggagtgcagtagcaggatcaatcttagctcactgcagcctcaacctcctgtcctgggctcaagcaatcctcccatctcaccctcctgagtagctccctgggactacaagggcaccaccatgcctagctaattgttttatttttaatgttatttttgtagagatggagtgtcagtattttgcccaggctaatcttgaactcctgggctcaagcagtcctcctgccttggcctcccaaagtgttgggattacaggcatgagccaccacatccagcctcagaaaagttttataggatttaagtaataatattgtctgtattttattgaccttgtggcatcttcctgtgccaagcacttgatacaaacagtgtgaaatgatttgctctgtgctgatttgtggagggcacgcggggaacttgctgggaactcgctgggaacgtgggagctggtttctacattgtcactgtctgcacgtatcagctcttatttctgaatttggcttttttgcaggtccctagctgttggtagtaagtccggttataaatttttctccctttcttctgtggataagctggaacagatctatgaatgcagtaagtgtttgctttatttttccccttcttaaaaaaaaaaaaaaaagttgtacttgaattggaatgcgatctaaaattcagacgctgtggttgaagtccagacaccctcttaccagtcctctgcttccaccttcatctccccaagaggtggcaactggtgacacctgtggccgtctgccctgatctgtgcatttgcctacataggagggcaggtaccgagggagctctgttcatgagggtcttcagtacat

SEQ ID NO: 124250 - DNA, 1038 bp, Homo sapiens
gattgttgatggaaagcagctgtatccttggcgcttctaacattggtctgcatggtgttctagaaggaactaagattgtgaagccaacgcaggggtggatcacctgaggtcaggagtccaagaccagcctggccaacatggtgaaaccccatctctactaaaaatacaaaaattagccaggcctggtggcagtcacctgtaattccagctacttgggaggctgaggcaggaaaatcacttgaacccggaaggcagaggttgcagtgagccgagatcacaccactgcactccagcccgggtgacacagcgagacactgactccaaaaaaataaaatacaataacaatagaaggaatgagagcgtcatagtccaggagtcagtcaactggagattggggcaggtattgcactggccgttgcttcacgtttggtttcgttttgtctctcgcctagaggctgatagtatgcctggaggagtccctgtacatccacaacattcgggacatgaaggtgctgcatacgatcagggagacgcctccaaaccctgcaggtgagctaacttgtgaggagagaatcccatttttctgattttgcccttgaaagatagctataggtgagagagattttttctttttataggttccgcagatgagacagattttaaaagtattgatcccaaaccaagctgccttcctactgatgctggtcatgtgaccacataagctcattggtttgatcaactttcaagtttgaggttactgatcagttcaaaccaaaggcctttaatctcttgacaatactggtatcacctaaggtggggatttggggttgcagaactttcctaacacagcaaacaagattgtatccaagctattatttgttcctaatgctctgttaaatgaatgctgaattatgtctgacatccaagaaggaactctcaggtggaagtttgcatctcgtcctccgtgtgtcatttgcaggcctgtgtgcgctgtcaatcaacaacgacaactgctacttggcgtacccagggagcgcg

SEQ ID NO: 124251 - DNA, 1080 bp, Homo sapiens
ttgagacagggtctggctctgtcgcccatgctggagtgcagtggtgcagtcctagctcactgcagcctcaacctcctgggctcaattgatcctcctgcctcagcctcccgaggagttacagtcatgcaacaccacacccagctaattttttatttttgtagagatggagtcttgctgggttgcccaggctggcctcaaactcctggccttaagccatcctcccgcctcggccccctaaagtgctgggactacaggcgggtgccccgcgcccagccccactgctctcttctcagtagcagagtaggtctggctcattctgcttctggatctgctgcggcgttcagagcagtgctgagctcctcgccacgggaatgtttgaaggaacatagaaaaccttagggataaattgctttgctttttctaaagttggagcagcatttccttggatgcccagccccagtaaatcaagtgggtttggcatttgtttggaccgtaatggtgttttaggaacagctaattggcacttgcggaccaagtgtcagccctggggcgtgggcggtcactgtgcggtggccactctttattggtgtccctttttcagagagctgcaaacatgattccggctcacgacagtcctttagcggcactggcctttgacgcaagtggaactaaacttgccacggcttcggagaaggtgagtctgcttttccccgggggagcactggtgccaaggcgtccacagactttttcagttctgttcacacagccaccttagaggcaaggtcctatacttaccagctccgggagaagcaaagacagccacccacttgtcaggccacaggcgtgtactgcccgagagtgagcggagcttgcagtgtgccactgggacgggagagctggtccacatttgtagtagaaaatacagaaatgtccagaggagacagaagtgccgtgtgtaaccacaccgctcacccagtgtgtttctaaatgatgaaactaccacataacagtaaagaacccagacagtgatgaaatgtgaaaaagcaaagacagaattctatccagccagtctgaacacat

SEQ ID NO: 124252 - DNA, 1023 bp, Homo sapiens
tgcagtggtgcagtctcggctcactgcaacctccacctcctgggttcaagcgattcttctgcctcagcctcccgagtagttgggattacaggcatgcgccaccacacccagctaattttgtatttttagtagagacacagtttctccatgttggtcaggctggtctcaaactcctgacctctgatgatctgcccgcctcggcctcccaaagttctgggattacaggcgtgagccaccacgcccggcccaggcttttatttttaatagtttaaacttcagatgactcagaacaatagaatgatatgccacttttgccctgaagactgttagtgttgagagtaagtagtcatttaaaataggtttaaagagaagattgaacattaagtcaacaatagaacaggggagtgtttttctatgctcgtggcaaaaagtgtggagatgatgttcaaggggggccctgggggaccccagactccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagaggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagctagcgtgagagttgtgaagagctcacgcaaccaggtgggccctccagtgcccggcagctcccagcctgctgtaagggacggggcggcgacgtcatgggtagcacaccctcccctttaaaggccacgctctgag

SEQ ID NO: 124253 - DNA, 1261 bp, Homo sapiens
tccagttcatgagcccaccctgagagtctcctagtgtcattttttttcctggtgttatttttgagctcttaaccagcttgagagagtttgtggcccgtccatgagggagcctctgtttactgtgcaggcatcattttgacatttatgaatgtcagagaacaaatgacttcatctcgagctgcctaaggctgcaaagagttcattagaaagcaatcagaattcagaacgtcttagtacaggcttcagtttataaatatacaccagtgtttccaaaacacagtcctcagtgtgtgtcatggggtctgtggtgtgtccccagcctttgaagggtgacttcgtcgtctctttgcagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaact

SEQ ID NO: 124254 - DNA, 1389 bp, Homo sapiens
gaggtggaggttgcagtgagctgagtcatgccactgcactctcacctgggcaacagagtgagactgtctcaaaaaagaaaaagaaaaagaaacggacatgtgacaccatggccagcaagcaggaaatccaaatgcgttattttacaagcgtacttaagagagaggcgggaccgttcggcttcagctctgtggtgttggagatgtaaaaagaacgtgcagggaaaccgtgggacttctgtttgggtcgcctccctgctttacatagaattctcttttttatgacttatttcttactgaaaatatatcatgataatcattggccaagcagatagggtttttctgacgtatcttttagttctgacccaggtcataacccttcacctatgtcataccttttcaatctgtgggtttttctgaagcacaaaaacaaaacaaaaccaatctcagggttttgagatgtgaccagttcttacccttccctaataaccagctaggaaagtctctaatttagaaaaatgaggccgggcgcggtggctcatgcctattgtaatcccagcactttgggaggccaaggcgggtggatcacaaggtcaggcgtttgagaccagcttgaccaacatggtgaaaccccgtctctactaaaaatacatgggcatggtggcatgtgcctgtaatcccagcaactcaggaggctgaggcaggagaatcgcttgaacccgggaggcagagtttgcagtgaacagagatcatgccactgcactccagcctgggtgacagagcacagctctgtctcaaaaaaaaaaaaaagaaaaaagaaaaatgaaatctttctaaagttcagaatgtgaagagactgtcttgattcctcacctctacatcgtttctttctatagttagttataatgtaaatagattcctcttaacacttcattttaggtgaagctgtttttggtgctgccagtgtgcgtgcatgtgtgtgtgtgtgtgtgtctgtgagtgtgtgtgtgtgtgcctgcctgagcttcaggtgaacatactgattacattcccccaccaaatctgactgaaagcccattgctatcagcattttataacacgctaaagaattggacgtggtggctcacacctataatcccagcttcttgggaggccaaggcaggaggatcgcttgagaccagcaatttgaggcaaggccagtctggaccacatagcaagaccccctctcttaaaattaaaacctgtgttctatttttttgttgcctactcacaggctgaacatctcatttgtttttgtttgtttggtttgtttttgagacagtctcactctgtcacccaggctggagtgcagtggtgcgatctcagctcactgcaacctctgcctcccaagtt

SEQ ID NO: 124255 - DNA, 1074 bp, Homo sapiens
ggtgggcttcttccagcctttaccacggctctccttcatactggggaaactgaggcactacattcagcactcagtgctgtgctgtcctctctgttagcctcaaactccctacgacgagcacagatcctttctgcattcagataaatgaatacacgttattagaaaaaaatcataggctggatgtggtggctcaggcctgtaatcctagcactttgggaggccgaggcgggcagatcacaaggtcaagaggtcgagaccatcctggccaacatggtgaaacgccatctctactaaaaatacaaaaattagccgggtgtggcggcgggcacctgtagtcccagctactcgggaggctgaggcagaagaatcgctggaacccaggagacggaggttgcagcgagccaagattgctccactgcactccagcctgggcgacagagcaagactccatctcaaaaaaaaaaaagaaaaaagaaaaaaatcattttaggggaaaaagctagcctgcctcaggcacacacagggctgcccacacagtgcaagcgtctccatcacagatgacttagctccttcctttcctcccgaaggtcagggctggcagatccaaattgaagcaagaagcactgaggcaagaccacaggaagaacttcccgccataagggtggttggccccaggaccaagggccatcgtggctcaaagtgccacacagacctgggttgagatctgggttctcccactttctgcctgtgagaccaaggggtttctcactttcctcagctgaaaaatgagtgataaaggcagcttcctcccagaggacactgcagcgcggtgcaggcacgcgtgaggctcactcatgtcacctgttacttccaactgctccccaagtcctggcatcgtaccgccaaagtattcctccactccatctatttctcaccgtgcccactgccaccatgcaggccaccttggttgctccccgggacagcagtctctgagccattctcctcccctctgaccccttctccctagatagcagtgaggatgagcaccttgagacacaccaggtgagggctggg

SEQ ID NO: 124256 - DNA, 1155 bp, Homo sapiens
acacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgcaagcagagtttgtgcgtggacgggggctgggactgccatctcgggataccggtggaactcgggctgccccgcataagccggtcctcagtcttcccatctgtgaggtgggccgggtggatcagggagcaggagggtgtcctcacactgggtaggcttggtttgtgggcagcgctgggtagtggggtgagagctgggagcacttagggtttgtcgctcaccttgaccgcccgccccccccaccccttcgtgaggatcagggaggatggccacatgcagcccatttgaaggggaaacaaagtgggcggggcttggcccctgcccctcagggactgcactgcatcctaggagtcagagcctcctggcttcga

SEQ ID NO: 124257 - DNA, 2399 bp, Homo sapiens
aggcggtgtagggcagacctgagggcgaggcgttctgggtgctggagcatcagcagccctgcccagtgggtcagccctgtcctggggcctggggtcgggtgcagcagcccccgggctcacccaagcccctcctctctcccccacacagcactgggaccagaagtccagccgcagcctcccggcggccctgcgggtctccagccagaggaaggacttcatggaggtaggtggtggtggtggtggtggtgggcgggttggggatggctgcttccttccgggcagctcagacagggcccggctcagcatctgctgctctgtcccccatggtctccctcagcctctgacctcctgtccctgccactctcagtgcctggctcctgttctctgtctctctggtctgtgcgtctgtctctgggtcttctctgctctcccagtgtctgtctctgagtctctggccattcttgccctctgactctctctgggtctctcccaacctctatctttcagtctctgtgtctctctgggtctctctcgatctcggtctctgtctctctgcgtctttggatctcttggtctgtctatccttgtctctcatttgctctccatctctcggtctctgtctctcttttgttggtctgtctcttactcagcctctgtctctgacttggtctctgtctcagtccctggggctccctctgcttctgtctctgtccctgtggctccctggggctccctcggcctctgtgccccccacctgccatcctgatatccccgcgtgcccgcagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgact

SEQ ID NO: 124258 - DNA, 1031 bp, Homo sapiens
cgagctgtcgctgacacctatgatcctccttccagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggtgagtgtggggcacagggtctctccccttctctgagggaggggtgggagggggcgggtgcaggacaagagctcagggctggctcctgcctgccgtttcctggggggcctgggcctgcctcccgcattcgtcggaagaaggaatgataatggcctctgcctcgtggggcccctctgccatgcctgtttggggcagatgcccaatgcgggtggctctggggtgctctttgcagccagccagcacccctgtcccttggcttccccactggaggccccaggaggttcaggacttgggaggtggtgctgggctggggctgcccgaggacaaaccgcttgggggctcccagcactgactcaggcctgggcttctcctcctaggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttggtaagtggaccttctatgtggccaccatgggccagactggccatgcccagcgagatggtctctgatgccaagggcttcctgctgaggggtggcggccggcagatctggggctggggaggcggaccggggttcagagagaacatctgttgccagtgttgtaaagccttggggtccttgttgcaatgagctcctgcccaaaaactccataaagagaagcgagacaggcagccctgggtgggggctgggattccccttacctggcgcca

SEQ ID NO: 124259 - DNA, 1058 bp, Homo sapiens
aggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcg

SEQ ID NO: 124260 - DNA, 1048 bp, Homo sapiens
gtgaggctgaggtggagggaaggccaagccaccagcctcggaagcccagcgggaggtagcctcggagccctgcctctgcgcaccttctgcgctcgctgggagctgcctgacttctgcacgccgaggctgaggtcggggaggaaacagcaggaggacagctgccgcccccttgaaccccgtgctcacccgggagggaaaggtgggggccggtgctggttctggctgtccccctcccccacttcgagtagccgcaaggagacctcggaccccaggccaacgcccagagccaagcccgtgctaatcccattagccacgaggtgggagcagctcccattcactctctgcttggggctgggccggattacacattcctcaagccagcacatcctccccctcccgcgttttctttgtggggtgcaggtgctacattttcccttctgacgcacctccctctcttccttggctgtcggcaccttaggtcttgccagcgttatcagtcccatctttatttgtttatttttgtaccgggaagtcctgagcggttgagccacttgcttggggtcacccagctagggagaggcacattaaggttgggctctgcggacgtggatgagcgctgtcagggcttataaagcccctcctaggccgagggaggttccctggagagagctcagagctggaggggccctcggagaaagatccccggggaggaatcccatccaagctagtattgacagccatctgctgtggaaggtcctctggaagagctggtttctgccttttgggtcaagatggaggggtttggcctctttctctgcagaagaggaggtgaatttaagaatgaatggggtttgggatcagggaagggtggtttttaagtttcctattaccttgagccttgctacattgtgaacaaaatattcacagcctgatctgggagatgggcatgtaactgacaaacacctggggcttggctctgtgctctgggcttgggaggcctggactcagttgtcctcacaggctgcaattaaagagctattagtaggat

SEQ ID NO: 124261 - DNA, 1023 bp, Homo sapiens
cagggagatccactcggccgggtcctcctgtgcactcgcggccggggctcggcgactctccttcggtcggccacgggggtgcgggcagactcggctcccagggctgggaaactcctggtcccggagccaaggcggtggagagtgtcgcgcggctcggctaccttttccgtagcgtgcttggccctcgtgagccgaaagccggtgtggtagcccgagccaccgggggcgattccaatccccggggccccggcggcacgagcctgggctggagttttcaaaatctgggcgagaaaagaacaaaccggcccccgcaccccgcgagacacccgctccccgagctcgaatctttttcttggcaaacgctacttttggcgctcgtgggccctcctgggttctgttcccagctccaccactcgcgccgagccgggtccctggcagttaccgagcgccgggggatgcgggagtacgccgggggatgcgggagtacggtgaccccagccttgggaccctggcctcggggcgggcgggatgcccctttcttccccgggagaacggcggccctgggaacctgcaccccggtaggagggcggcgaccccggccctcggggaccccttgttttccagcgcgaaagagggtgcggaggtgcggcagggacaccgaaaccggaccatcgcggtcccgaacctagggggaaagaagagagcgggtcgggcagggcccaggcggcggaggggaaaaccctgggtctcacatcgagctgctggaggaggtggccgagaaggtcccgcggcctccaccatttcccgagacgggctgcccaggcgcggtggggacggtacccgggcgggcgctgcgccggggcgggagactctccctccagtcagtccgcggccgctgcagccagaggggtgggaaggagactcggggacctccagacctgcccggcggccgccccaggacacctggtccctccttcccgggctgtccctggcttttgtgcttggcgtcccaagtctcgactt

SEQ ID NO: 124262 - DNA, 1026 bp, Homo sapiens
gctgcggactcagcgttttcgcattgcccgttctgttttttttaaatcaatttttaaggcaactttttgggaggggggaaaaatgagcgagttagtgcccattcgttctattttcttttctccacttttagaaaaaagtggggggaggcttcgagaacgaacgggggggtgtctaatttaattccaggataaatttgaggaaaaaagttcagcctcttgagggcagtttcaagttgcccttcctggagcttcctgcgttagtttctaggctgccctcttttggaagctgtagctccgctggggaggagggaggagtgagaaggaaagaaaggaacaaaaatagccggagccgaggggaacaagccacggtgtccgcgtttggagctgggcgtgcgggtctcagtggcggcctcggcattcggggcggcgggaggcgcccggtgcatccccgggacggccaggagcaaagacggagaggagaggggggttagagaaaggaggtattgtgtctgtgtgccttaggggaggaggggactgcaggaatcgaataaacgcagtcgagctgcgcggggctgctggaagcccaggcgggggaagggggccgtgtgtgggggcgcagagcgcccttgagccttacgcagaggtcttgtgtgttcctagttaagccctcccacgcccgaggccccatcgcttcctctccaccctctttacccaccaatattccaagcccagatcctaattccccaccgcattaccccgccctggatttggggaatgtttttctttattttaatatagctcaaggaaaaaatacgtatatcttgagagatttggggtggggaaaacaaaagccttgcggagtagaaaaaacaaaggcttatttttataaatgtttaatgttttcaccccctggatgctccgagacgccgtaattgtgacggcggggtacgtgtgccataaatcatttagttgctaataaaaattctgcctgtttgccctggatttgccaatggcgtttgcattttt

SEQ ID NO: 124263 - DNA, 1050 bp, Homo sapiens
cgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttcccgctgctcacgccggggtgctccgggccggtctcgtgtcccgggccacgccgcgcaccctgctcaccccatcacggcctggggacccggagactgcgcagggaaccacgccaggagcttctccgttcaccaaagagagggaacggcctcgttcctcggtgtcaacaccatccatctctgagggcgctggaccctgaggtggcccgagcttcacaggatcaccgccttggggtaggggcgcccgggcctggcatttcctcctaggaaggctcggtgagactgggatgggcatgcggctctccgctcgagcccaactccggtgccacctgcaccacggaggggtgaccccagggtcagggtcagagcggcttctcagaattcagcttgccacctctccgcggaccctgccttcatctcgtgcctcctcagagccctctgcgggcgcatgaagggcctttttttttttttttttttttttttttggcacaggtggaccaacggggggtgtgactgtgggcaccgtgcgcggaggcggaggctcatctggttcccaccctccgtgccgctggatgccccaggattttctccaaccggggtcccggcttggagccctccttggtgcga

SEQ ID NO: 124264 - DNA, 1483 bp, Homo sapiens
tctgcagcagagggggcgggctctatccttgccatctgctgcccccagaggccctgccaggacatgggcctgagcggtttcttctccaagaggccctcctgggacctgtctgtgcacagggcgggaagacacttgctgcttcgacccaggacggcagccaggacgggctgagctcctcttgcgctgcaaacacacaagggttgcctgccagctcagcagcgccctccctcaaccacaccctgggtccggacccagagccacaggccgttggacccaggggaccggggctgggctcaggcgtgggcctggagggcttgtggaggggccagacctagagccgtagggctccaacagctgagggctgggcccctgccggccaatgaagctccagaccagtgctccggccttggcggtgccagcagtgctcctgcagggatggagggtgctggaggcctggatgcggggaccttgatcccccagcaggcagcgctgtggcagcctcccacctcctcttcccctgttatctgctccttttaggatctgaaaattacagagccttttttttttttttgagagggagtcttgctttgtcccccaggctggagtgcagtggcacgatctcagctcactcactacaacctccacctcacaggttcaagcgattctcccacatcagcctcctgagtagctgggattacaggcacctgccatcatgaccggctaatttttgtatttttgcagagatggggttgcaccatgttggtcaggctggccttgaactcctgacctcaagtgattctcctgcctcggcctcccaaagtgctaggataacaggtgtgagccaccgtgcctggcgcattacagagctcttgtaagaaaacgtgtgaaattcatggacaaagtgaggtgatgaagtgtggggccactaaaccaaaggcagaggagacgtcggccacttcctgtggacgtgggcagagcgctgctgccagttcctggtagccttgaccacgacgctggggggtctttgtgatggtcatgggtctcatttgcacttgggggtgtgggattcaagttagaagtttctagatctggccgggcgcagtggctcacgcctgtaatcccagcactttaggaggctgaggcaggcggatcatgaggtcaggagatcgagaccgtcctggctaacacagtgaaaccccgtctctactaaaaatacaaaaaagtagtcgggtgtggtggcgggcgcctgtggtcccagccactcaggaggctgaggcaggagaatggcatgaacctgggaggcggagcttgcagtgagctgagatcgcaccactgcattccagcctgggcgacagagtgagactccgtctcaaaaaaaaaaaaaacaaaagaagtttctagatctactgggcatgatgaacacaaaccccacagacactgaggaacccagtggtggcagtgactcgggctcctctgctctcta

SEQ ID NO: 124265 - DNA, 1055 bp, Homo sapiens
tccgctgaccgcctgtctctggttcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatg

SEQ ID NO: 124266 - DNA, 1114 bp, Homo sapiens
tcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaa

SEQ ID NO: 124267 - DNA, 1094 bp, Homo sapiens
cttcgagcatccctagccgggcaggtgggaggcacggggttgcggatcccgcggccgcggttcggacccgccggcgacatggccagctccggagaggtactgtccgcgactgtctccgctctgcttctgcctcggcggcctcggtctccctgggttcttccatcccgacccgggttcccttgcatcctttctatcccgacccctaccccgccccgtccttcccatcctgaccctggccttgcccctgctcccgtccttcccgcatcctgtccccaagactcctaccctgtctcggaaggcacaagctgtctcccccttcgctcgtgcattcctgatcgccagagttgtccccgtctctccgtcccctgagggtccaggctcctccgagacccctttctcagtgccccggttccttggctgggcccctgcagccctgggacattccccctccgtgcccacgtcccactccatcttctatctctggatgctcagtttcagccccagcccacttctccctggagcctgcttgctgaatgacgtggggggtgggtgatggaggaaaagccatttcacctgagggacttacgacgtaccctggaattctttcccaacactccccaaatctgggtccgatggagaagcccgccgcgtccctgtaatgtggtgcaaagtattgtctctgcagaaaggggtgcagcggggactctagactctgactagtggcttcccgttgatgcttcctgcctatctgtatgggcacctgggttggtatctgtcacctttcaggtctcagatcgttgggtgcacttcgcagatttaggagcttgcctgggttctagggagcaagagtgagaggctcaagtgtcttcctcagagtgatggggcagggtctctggagatggctgggggtcgctgtgctcaccgcccttctacatttgaagtgaatgcggcctagaaatgaccccagtggcttcttgattgacaaggaacggtgtgtggctcaactgcagattgataagattgaaatgaagattccagttagctgtgtgtgcttggggtcagggaagaaggggggtcctggtaccttggtctta

SEQ ID NO: 124268 - DNA, 3443 bp, Homo sapiens
gcgctggtcctttgggcgctaactgcgtgcgcgctgggaattggcgctaattgcgcgtgcgcgctgggactcaaggcgctaactgcgcgtgcgttctggggcccggggtgccgcggcctgggctggggcgaaggcgggctcggccggaaggggtggggtcgccgcggctcccgggcgcttgcgcgcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggtctctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagt

SEQ ID NO: 124269 - DNA, 1024 bp, Homo sapiens
atctgcaccgtggtctctgaagtctccatcgtgacctcaaacctcgctcgtccttgctcctagcgaggcttggggtcggggtgtccgaggtgggggacatccgggggggttaggtggctggcgcggggagccggggttgtgaggggtgatgtcctcaggcggcggcgctgcggggtgcggcgaggacaccggtggggtgagagcaccggcggggcagcagcgggggccgcagcgccgggtccctcggcccggggcccctcccgcgcggagccaggggcgggacaggggggcgtggcctggtggcgctgacgtcacctcgcctataaaatgtccggggcgccgctagctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccagga

SEQ ID NO: 124270 - DNA, 1062 bp, Homo sapiens
cagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtgagtggggacgctgcccccgcctctcctggtccgtgcacaaagcgcaccccacccgcgcccctccagcctcccgccctttctcgctcgcggcgccgctgcggtccggagcactgcccattgcgcccccgctaggcacgcgggctaccccgcctggagggggcgaggagtggggctttgcccatcctcgggtgccgctgcccacctcccaccccgggctgggatcatgggctcccctaggccccgcggagtcgcaaccgtacgtgcaccctcctaacccccccccccgcccaatcttggctctccccacgcgcgctgatccctcggatcagctgtcccagctcttgcggagtgggagcccctcacccatttcctcgtgcccctccccccgccggctgtcctggagctcgggggtccgaggcaagggtcgccacccgcaagggcgcgcctccacccccaccggcagcctttcgcgggcgagatgggggaggttagccaggcctttgatcccggcggggcgcgcctccacctccccgtctgcccggccttcctccacctcctcccgctgccgggcggggtcggcctccgctggtgggggggggcgcggggtgtcagcccttccccccagcccctcctcccgcgtctgccccgcgctcgaggccgcggcctttgtgagcaggggggcgggtcgcctcgactgggtcctccctcgccccctttgtcctgctccatctctgcagatgggaaaaccagatgcggcggggcgggggaggggatcg

SEQ ID NO: 124271 - DNA, 1754 bp, Homo sapiens
agcctcagcctcctgcctcagcgatcctcctgcctcagcctcccaagtagctgggaccacaggtttgcaccaccactcccagctaattaaaaaaagtaatttgtagagacgggggtggggtgggggtcttgctatgttgcccaggctggtctcaaactcctagactcaaacaatcctcctgccttggcctcccaaagtgttgcgatcacaggcatgagcccctgtccctggcccctattatttctctaactggggaaagtcatgtgggaacagatgtagcttgccttggcctctgaccggccctgcctgcgttcctgggtgctctctgctgcttctcatgtgtgccactgtggggactcggccgcccaccccaccccgtggtgttaccttgcgtgtgtagttctgtgagctcagggctatggtctgccagaactagggggcgtggggccccagtaccagcccaaggcctcctctctgcaggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagtgagtgcctcgctcccacctgtcaccgcccccaccaccttgcctgggctaccccgcctgaccctgtcccgccatcccccaggaatgccagctgctactttgacatcgagtggcgtgaccggcgcatcacactgagggcgtccaatggcaagtttgtgacctccaagaagaatgggcagctggccgcctcggtggagacagcaggtaacactaaagccccagttccctggagccgtcctggagtcctggagggtctggccatgccgtggtcacttggtagccccagccaaggcctgctctgtgctgggcatccccccggactggccccgcactgtcctaccctggggactgctgtgtgaccccagctcctggccctccctctctggtcaccccagcctccaccccactccctgccaggaggctcactgactcccctctttctgggacaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaaggcaggttctcctgtgggcagctgctgggcagggaacccctcggtcggggctggggtcagtgctgcggggagcgccctctgcatccacactggaccctggcttggctcagggccattccaggccctaaagggacaggtgtctgatggccaccaggggctctgggatgcaagcagcccctttccctcttgtctgtgtggttggggggacttaccttgcccacctgacagagaggtgtgtggaggggagagcagggaggggaaggagagcagggaaggggagggaggagagcaggggaggggagagccgggaaggagaggagagcaggggtggggaggttctggaaagggtgtgcaggggaggacgcgcctcggttatgggactggagccccttcccaggaggacccccaacaatccagaggtgcctgttaggattcagaacatggtttttttgtttgtttttttgagactcactccctcaccctggctggactgcagtggcg

SEQ ID NO: 124272 - DNA, 2339 bp, Homo sapiens
actatgtgtgggagccaccatgcctggctaatttttttgtatttttcatagagacgggtttcaccatgttgtccaggctggtcttgaattcgtggcctcaagtgatccgcccacctcagcctcccacagtgctgggtttataggtgtgagccaccacacccggctaattgttttgtatttttagtagagacggagcttcactatgttggcaaggctggctcgaactcctgacctcaagtgatccgcccacctcagcctcccaaagtgctgggattacaggcgtgagccactgcggccgagcagaacacgttctaggacccttgttcatgtgtccatcatggacaggaggacgtgcgggccatagggaccctggctcattccggagccgggactggagggtggggcgtcacccttgggaacacccgtgcccaccctccgctgcccagggtaggggtggggagccaggctttgggccccacttgataaagtcccctccccagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccaggccggcctgtgtgtgtcttggggctgaggtgggtgggggggctgaggtgggtgggagggctggcgggacaggtaggcgccctggctccccagctcagtgctgggagtgtgcagtgggagggaggccgtggctccagtgggtgctccggagctcgtgggcccagcacacctccttaagcgggggatggagcgctgggagggggtggactgtggcccatgcgacccccagagccattaggaggagttctgtggtgagaagtggctgtggctcctcgtaggctacgtccaccatgcgggggacctcgggggtgtctggcggtggcacgctggatgttgagaaggcgcagcccagggaacactcaaaccaggagaccccacattatcctctagttgacatgtgcccttcgactaggggacttggtggtaggggcagctccgcccccatactgcgagga

SEQ ID NO: 124273 - DNA, 1116 bp, Homo sapiens
tatttctcatcactgtcataaatatcattgtgtgttaaaaaaaaaaaaaaaaaagtgaagttagtggggtgggtgtgatcattgatctgtcatcaaaactgacctcggtttcttcatcttcctcttaatagccacacagccaacaccatgtgagcgtgctatgcagtgtgatttttactgcatgggactgggaggcagtgctttcctattttgcagatgagggagatgatgtgtaggtcactagcccaggatccctagcttggtgagaccaggatgtgagcccaggtcttccaaccagtgtctggctcctgccacaaatacatggtcgttaggtgcccatagggtccctgagccccatgaaccaggtagcccttgcagaggggtggggacctcgccagactctttccccatggatgaatgaagctgcaaatagtagaaaggggccctggcagttttgctaccccagcagtgtcccagacagggtttcgatgtcactgagggctttcccaagcagggcagcacagtccagtacacacggcctgttggtgcttgttgctacatgtcttcagcagatcccaccaggcccctgggtgagcacttgaccctgacgggacgcaaaacatggccacattctgcccccatctccaggtccttgtgggggaagtgctccagatagtggtatttgggtgctgggcttgtctgacctgaggaggtggctgcagaagccagggccagccctgagcccgtgaagtctctgctcctccccagcacactgtcctgcctccctgcccttcccagccacagctgcgcagcatgtgccactccaagctctgctgctccctcccccaacttcctgttgctggggacagcaaggggtgggggctaagggtctgccgttgctcaggcgatctgtggctaatctgggaataatttgaaactaaatcttaagctctttggaagcctctcatgaaatcattgcaagtttattaacaacagctgtggccacacatgacctggatcccagccccaacccacccccagaatctcagaggggaagcaccagtcgacttgcaattcccagtcagctttctaaggggaggaaaagtgcaatgaaga

SEQ ID NO: 124274 - DNA, 1510 bp, Homo sapiens
gttggtcaggctggtctcaaactcctgagctcaaatgatcttcctgctttggcctctcaaagttctgggattacaggcgtgcaccaccatgctcagcctgttctctccattttaagcctacagggattcctataacaaatagagcagtccttttctaaatgctgagtactgggcactatgccagggtactttatattttgtctgtaattctcaaaacaccatgagaaagttgtgttttcacagtttaaaaatgaggaaactgagtctccaggcaggtgagtaatttactgaaggtcatacaattaaaactttgaagcagttctcagactccaaaacctaggctcttttcactgtttaatgtcacaaaaaagccataagtgatcattttatgtgaaaataaataaatgcttaatggccatatttttttcctcctcatcttccctcccagctccaaattatgttttcttatttcagtgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgtaagtagacacatggctgcctattgctttatagggagaaaatagaaatatatttttatgacaaatattttgaatatacgtaacaaaatttgacttaggagaagaatataggaaattacatagactgataaccaaagaaaaaatttgagaaactaattatcagctactcctcatgctgctcaaagcagcatgccctaacagttttataggcaaattcttttaattcttcaggaaataaaactctgtgccctctgaaatattccagagcaaagtaaggaaacttacacatgtatctgttcaaagccagcataacgctgattccaaagcctgacggagatagccctaacaaagaaaactacagattttcttatgagactcacttataatctagattttaaattatgtaaataaaatattagcaaatagaaagcatgaccaagtgagtttgttctagaaatgcaatgatggtttaatattaacaattctattaacgtaaatcattatatggtatctgtagatggtgagaagacatttaagaaatcaaatcaaatatttcttcttgatttaagctttaaaaatacagtattttagaggaggagcaaggctggcaaggaaattaaacacatagggtctgtttggggatcggaaagaaagcaggtgaggtttgcaggtggagagagccacagggaggtgacagcgattggcccaggggccggcctcagatctggagtgtgatgagagccatttcagggcattgtaggggctatgtttcccaggtcacactagctactacgctggggagagagaggacag

SEQ ID NO: 124275 - DNA, 1017 bp, Homo sapiens
cgtagatcccagtaggagaagcactttattggttgcatggaggttctgattactcatggcacttactgtagtcaatcccatgaagatgtcagctccgcaaagaatccttgtctgactcacctctttctcctctgcatgcacatgcatgctcccctgccgtgtgtgcgtgcacattacactgaacccccattatgctgtgcttgatttgccccgatatgtaactctctcagtagagtgcactccttgagggcaaggaccaagccttcttcggctgttatgtgcattcttgacctaggaaaaatagaggttcttggattcccttagtaaaaggaaagaaagttcactgaatctacctgagctttgactttgctgaactttattgattctcaggggttgcagcataaactcctgagatttaaggggttccatcttaaaatcagtgtctttctggccttctgtatgtcatttgggcgtatgggtggggaggaccagcatctttgacaactagaagacacagatggcctggaagcccacggtcctgtggtccctggctgagcatttgcgaatagtcaagtgtgtgggccttttacctcaagagtgctggagatttatagtctcaccattttattttattattttttttttttagacagaatttcactcttgttgcccaggctggagtgcaatggcaagatttcggctcaccgcaaccactacctcctgggttcaagctattctcctgcctcagcctcctgagtagctgggattataggcatgcgccaccacgcccagctaattttgtatttttagtagagatggggtttctccctgttggtcaggctggtctcgaactcccaacctcaggtgatccacctgcctccacctcccaaagtgctgggattacaggtgtgagccactgcacccggcccagtctcaccattttttgaggtgacagaacagagagctgaaatttctgaagctacttctggattggcaacagcgtaatgccctgtggca

SEQ ID NO: 124276 - DNA, 1066 bp, Homo sapiens
cccagtgagctatgatggcaccactgactgcaccccagcctgggtgacagaatgagaccctgtctcaaaaaaaaaaaaaaaaaagtcattgctgtagtaacttcggttccacaacctgtattgtatggagcatctatggggagcaaatcctttggaaggggcttagtcacagcctcccctcctgccctttccaggctgtgagaagctcggcaggaaggcgggagaggccccaccttcagaggcgcagctcagaaggcttgagagctccccgtgaaagggatccctgcaggtggggttctttgggaatcaacctcatgcacagccattgcagaggctcttcttcagcatctgtttactctgggctcaggccccaggcagcctgcaaacccaaccctcctctccaccttacagctctgcccaccctgctcctccctgttcctggtgcctggaattctttcccccagatagcaccagactctctccctcgcctttcttaagtcttcacttacatgcaccttcgcagagaggccttccctgaccaccagtttataatcgtgaactatttccccctctccaccccagtgcattcttcctttatttttttctcctcagcacttacaatcatgtcttaactgtatattacacttaatgtgtgtccccactgcagagcaggacccatagtccttagtaggagctcacatactggtttcggattttttttttttttttttttgagacggagtctcactctgtcgcccaggctggagtgcagtggcgtgatctccactcactgcaagctctgcctcccaggttcacgccattctcctgcctcagcctcccgagtagctgggactacaggcgcccgccaccacgcccggctaatttttttgtatttttagtagaaacggggtttcaccgtgttagccaggatcgtctcgatctcctgacctcgggatccgcctgtctcggcctcccaaagtgctgggattacagatgtgagctaccgcgcccggccttggtcttggaatttttatataaatgtccacatgatgccattgcctaggcg

SEQ ID NO: 124277 - DNA, 1023 bp, Homo sapiens
caacaacaacaaaaaaagaagtgttgagtaaccagtgagctgacaagcccaccacgtggaggactcgggtaggagacttgggcttgggggagtggatcgcattctatgatgacagagctagctgggggcagggcgggggacaaaggaaccacttccctgttggaccttgaaggctgcattagagcatgaagagacttccggaagaggacacagagtgttaaagtagaggggagcgtgtgtttccagggcgagctctgaggaggctggaagcttcagggccagctcgtgggggagatgtcccttgtgtgaagaacgtggacttcttcctgattgcagcaggaagtctatccatggtcattaaacagggtagtgaaatgatcagatttagcttgtcacatgattattctggtagcagaggactgaggatgtaatgatcccagcaagagactcccaggaccctaagggactcgctgtgcatacagggtccctattgtgtttcttaaagccgactgtggagccgcctggctcacctgcccagggactctggccgcttagcagaaaggcgggtgagggacctggaggagcatgatagtctctcctgctgagggtctaaagatgctcattcccacagggccagttgttagaaatgcaggcactcacacagatacgctcttctctcagtggtgcctgcctttctttttttgtttaattgttccttgcagtagcacattccatgggagattccatgacagggctattctctcgatttcagtggttttgattttgtgtctgttgtcatagcgcctggagctaagccttatcaaataattgcacatctggtgatcacttaggcttccagaaatgtgaggcagggaggaccctcaagggactctggtcagcactcctactgctgagaggcttcaccgcattcccccagactcaccaacagcctcgttacacttgttacggtgtgtgtgcaccagtgcgctcagcgcctgcatcctcacaacccagccccttgtg

SEQ ID NO: 124278 - DNA, 1826 bp, Homo sapiens
attgtcaaaacggctgtttttccctcctggaaaacagaaaaaagaatatggcaagatgttaactgtggcatgacagtccgggattctggacacgacctacataatcttccttgtatctctttgtgacttggtttcctcatctgtaaaatggtgagatcatgatctctgcctcacccactgggttgtctgaagattaaaggaggggatgtttgcaaaactcttagcacctttaaacttaggtccttggaaatgctagtggattcacttatcttctccttccttagatgcttggaaagtaagacactggcatttctgtcattcttgatttcctggtcatttgggggcacttaatttctctgtgttggtttcctcctctgtaatgagatctgttaatctcaggatttcacaaggggcaggcagagaggcttgtcacagccttttagaactagaagaaacttaagatgtcatttaggtccacaagtgccaatatgagagtctttctacagtatctttgtccaaaagtagatgtgagtggactctttggtttctgaaaatcccacatcatgtccccttaatttcttttctttcttttcttttctttttcttttttttttttttttttttgaggtggagtttcactcttgttgcccaggatggagcagtgacgcagtctcagctcactgcaacctccgcctcccaggttcaagtgattctccctcctcagcctcccaagtagctgagattacaggcgcccgccaccatgcccagtttatttttgtatttttagtagagatggggtttcaccatgttggccaggctggcctcaaactcctgacctcaggtgatctgcccacctcaacctcccagagtgctgggattacaggcatgagccaccgtacctggtcttcctttaatttctagattttgattttgaacctggtgtttctataacattcacttgactgtggtgatgaatccaattagaataatcagggctctgcttttatcttttaagatagggatccccagtccccatccccaggccacacaggaggtgagcactgggccagtgagtgagcattacgacctgagctctgcctcctgtcagatcagcagcagcattagagtctcaggagcgtgaaccctgttgtgaactgctcatgcaagggatctgagttgcacactccttatgagagtctaatgcctgaagccatctctccacgccctgtccgtggaaaaatagtcttccacgaaactggttcctaggaccaaaaatgttggggaccgctgttttaagatcttctgtaggtaatatgtcattgccgcaaatagcgctacctttgaaagcttgtttgacaaatcttccaaacccagctcacatgtatttaaagaaatagttgacaagtgcagttctaagtgagcctcacaatttagaacatcagtttaggaacactggcgtgcattgtacagatttggcttccctgcctcagctttcctaaaggcactgatggttaagcagcacttaaccagagaacagataacattcagactcttaagccaccactgtgtgactgtccgcacatcatttactctgactttcctcatcagagaaatggggatcctgttttctgtcccagcccccttcagggtggttgtgagaagcaaatgaggccgcaacaggtaagggctctttgacagaggtgtcagaagcccccacagaaaccacgtggcagcagtggtgttcttgagagtttggagaagcacgctccattttttttttttttttttttttttaataacagagtcatactctgtcaacccaggct

SEQ ID NO: 124279 - DNA, 1043 bp, Homo sapiens
atccagccaggagcaatccagccagaacaggaacactgacattactaattactgcttataactgagaagtaaggagcagtgagtaaagtgggtcacaagacagtgtcctagcagtcaaatgctgccgtcggcccgagtggcgaggtgtcaggtggcttgtctccccttcaccatgggtagacctggcagagcaccctgttggcatgagcagaagtgctgtcacgttgatcacccaggctcaccgtctacacacacggttagagaaatgggtgtgcttctgtcggaacttaaaaacatggcagatcaacccgtgagaacagagttctttgcacggctgtgtgagctgggaagagacgacaggcagaaaaggtgctgcagggggtgtgtggaggtggagcttcagcctctcctggctgtgtgctggataagccctgaaccacagggtccaagttgactcatctgtaggttgtcttcagcccccaaatcgcaattccatgatgaatgtgtacattttacacatgtgcgtatgtgttattaagtgtcaggctggtgtggcagagctgtcctggcagaacatgcgtgtgtacatccctgcaggctgtcggggcatgagctctagtgtgggctgtattgcaggagcatcagcagagaagggcgagatcttcactctacctctcactagccctgggcacttcccactgcctttgtggacttctgtttgctcttctgtagaatgggataacagtgccagtcctgcttactatttagggttatgtgatgcttgcagatgtacagggaaagcactgctgatgggagctgctgaagtttctaggggaggtgaaggtggcgcctcctcccctggtctaagtggtagatggtgcagggagaggagaatttcattctgtggcagcagctgatagattccaggtctttaatactacctgggaaaccttaacaaagcagtcagtcaccaaaactgacctagcttctgagcattgctaaccatgcttttagagaaacaggaagtaaaaaggatctttaaa

SEQ ID NO: 124280 - DNA, 1046 bp, Homo sapiens
ttgtatacccattgtcattaacttagtcatgtctgaacatgagcaaaagaatttttgttttgtttgtattaagagaacttgaaaaatagaaatgtgattattaaaatatgcttgtgtattttcaaactccaagctatttcttctggtgtgttggaaggcttattttaccacctaaaaaggagtgccttgcctcgggctggaggcgagggatggcgttttgtggtgtgtggaaggagctggaactgagcagctctgcctttctcctcgctcgccttctgcacgggctctgcttgcagcacaagctctggcactgtcggacaggatacagccagtgagaaaccttggaccagaagtcagggccccgcgggaattagtatggcttttagtagttagaattcaagactgtttccaactgctgccttttcccacagagtatgtctgactaacaaggatgggttctgattcacccggcgttgctatgaccgctttttaaaaatgtctgctttgggttgtgaaatcagcaaataaagttgttactttcctagtatgtgtaacagttagcttttggtatgtgaggaacaagtaaaaggcttagtggcaaatccttgtctgcttagaaggcagtgtacatataaacaactaaaaaattcccatttggctgccagcctcgattcatagttccctcttccagctcccaagcaaatatttttcaaatagccgtgctaagccttttccaggcatgatttgcgggcttacttgctgtcattctatttttcagcaaaactctgggtaggaatgtcggaaattataccttttgaaatccctccttgaaaacatggagatttgtaggtatgcagaggcaattgtaacaatataaagtattgtatctcttccactagagtaggagggcctgactgtcggcccctggggtctgtctttcattacttgtcttgacttccgctgtaaaagcattaagtgggaaggtagcagttctgctgaacaagcagacattgccttctgtaagagaagttatttaaaacatcgaa

SEQ ID NO: 124281 - DNA, 1892 bp, Homo sapiens
gtgtgtgcagatgtgcggcctcaggagatgaacggagatcctagaaagggggaactgcctccagttttgtgaacctgctgccacaagagcatggagttcccctaaagtgggcaggtggaaaatcccatcagggaacagaagatgactcatcactcaccactcaactcatttctaccagctccccagtgttctgccatgtaaaggggtagatttttcaacctgatttttttgctaactgatacattctataagaaatgacagctctcctttagtccacgttattcaagttcagagaagggccctgtgcaacctggggagagccacgtgctgggggaggctgtcgtgtgtgtgctcccactctcagggtctgcactctctgtccacagcactgctgtgctccttctctcaggtttcatgttgatttcttactcctactcagaaggtttagaatctcagggatgacattcagaagaaatgagtacaggaggggcctagaaacaaagacggcgatacgctatactagagaactccaaattagttgcagtggagagatggaaatccagggtttgtcttcttggtgcattgggcatgagtttttgtcctactgggagggcactggtcatcctgcccacccatggcagcgggcaggcttggatgccagggctgctcaccttggactgtccttgtggaaggacacacctacttgtctctttgttgttgttatttttggtctctactaaaacacactgtctgtagtactcacagaaaaagattctctgtggatttttaacgagtttctatgggtacttaattaaaatttagtggctctttttgtggttttgtgtactagttagctattgcttctcaggcttgtcacagcctgtggggatcagaagcttggagtggccctctttctagaaaccacacaccacctattaagttcctttgtatattttactaaaataatttaatgacatttttctgtgtctgtggcctcatcaagggagagatgcatgttagaaatttcacaataaaaatccctcaagaattgatacctacaaaatacctttttataagaaatgttttacctcctttttgtcattgcactgattttgtgttgttaggtgtcagcatcctgatttgttgtcatgatctcattgtgatgtccttgagaaggggctgtgtgtgagtgcacgtgtgcggcttgtggtgtgtgctgaggtggaaagtgatagtgttccctctttgcattctcagcacagagcactgcagggtttccagccttccaggtagaagagaaattgttgctatggtaataccgcaagcatgaaaacaccccctgtccccgtgggtgtctgtgtcagggcggggaatgtggagaaggggaacagtagcaaagaggagtgtttagggcatcgagcaagatgagagcaaagcctaagctgaagctgctgttgggtggaatttcttgtgtttatccttgaattcaaggtcagattccagttgcaatgtggtagctgagaacgtaaaaggccttttattcctcagtgtcttccctgactttgagacaaagataaagaatacagagggtctctgtcacatctccagttcccagaggccacatggccttcccacagaccacagttagaaaatgtgcgtctgtatctgtggccagtacatcactgcaagtggaatcaaccacccagccccagaaagcctgctgcccttcatgtccagtgtaacaggctaaggcagcagtccctgccatctcttctgaaactaaataacagttcgtgctctgtttctgtacaattcccctgggaagatggactgtgaatatccttggtaatgcagagccgtgatgagaaacgaaatccaatctgctgaggtag

SEQ ID NO: 124282 - DNA, 1029 bp, Homo sapiens
ttttgggctcagtaccaaagcaaatcgctacgtgcatttagactttatctaagaagtccatgttattagcgcatacgcttttacctttctcagttgtgcaaattctccttatgccattctttgtagcaagatggctaaagcagtcgctaatccttgaggattcctgatatttaagacatgagccacaagctaattttgacccgtgtgagactaagggcacctgctttctcattgcagtgtctttgccagtaatataaattccagttggcttttcaggaacttgtcgctctgaaatgaggcgtttatattaatacggcattaatataaacgtattaatataagacggcctctggaggaggacttgaatggctggaatcagtcctctggaatccctgaagaataagacactgtatctttgatgaaatggagagagtctttgtttcattgatatgatggaatgcttttgtcaaggctctcagctcccttgtgtgttctcagataaagaattcattagtttgttttcagtgtgctgcttttaggaatgaattgggtgtgtttggtgtgagactgaagagtgttacataaaaggagatttgaaggtgatgcttctggaatatgtattcttagggtcagaagtttcactgttgagtcttttctgccttgccacagccataactttgctttataaactcagagctgtgtaagtcaagttttccagaaacttagggccacaaggtggaggtttaggcacactcatgaagcaagcgctaacgacgagagaccatcaggtggtgagagtttaatcagagtaactgaagaacatctggtgtagtcttttcgtggaaactgcaaatgtgtgtgtggttgtgtaaccacccatcttttcccaatgtcacttgtatttatttatcttttctcacctgccagctttcttccctgcttgtttttctgccctttctaggttcccatcctattctttgtagcatttgctgtttttaactttacagccgtgaagtacaaccaaaattc

SEQ ID NO: 124283 - DNA, 1041 bp, Homo sapiens
aagattaggagttcgagactagcctggccaacatggtgaaaccccatctctgctaaaaatacaaaaattagccaggtgtggtggtgggtgcctgtaatccagctactcgggaggcttagtgagctgagatcgcaccactgcactccagccttggtgacagggcgagactctgtctcagaaaaataaataaataaagtttatgttttttcaaagagcgtgacctttggagtcaagcagaatgcattgggccatgcccccatcagccatactagccctgtgatcttgagcaatttaaattccttaagccactgtttcttcctctgtaaaatggaaataatcatagcattgttttgaaagctaaatgaggtgatgagtttaatgaacttattgtttgacacatggtaaatgcctcataaattttagctagttatttttaaaatgtcgtctttttccatttgttttctttggtgtttgtctttcatgtgggaagcattcctcatgtctgacactttttgttcatgttaaagagctgtttgaaagctgtgtgagtagtggggcttatagaccagtgagtttgactctaggtgcataggagccagttagcttttatattatgaacctgaatggctctgaagtctcttacctggggtgattcagtctgcctcctgcctggtgggtgtgagcccattttccaacattctgaaactgagggggaggaaaggtctggagagttctctgttcattatgcagactccatttcagactctgacttcaggccacccctcagctctgctctcctctatgagtggtttccagtccagagccgtgtggtccagctgttcaggagatcttcctcatttctctcagagtcagccaattccttctgaagcgggtaggaactagaggctccacccatgtccctgttttcagtttattactttgagtccctgcccctccccaccactcagctctgctttccagaggttctccagctttctaatatctgtagaggggaacaacttctccccagcatctcctttt

SEQ ID NO: 124284 - DNA, 1088 bp, Homo sapiens
ttcaatagtcccttaaaataaagcgcagacctcgatagacccattcacactccttatgacaagaacaaaattcaacttttgaaagttttttgggtaacatctctcatactccttatccttgctgtttataatcacattagcatctgagtacagatgttctagttccctttgcaccatgggattgaatatgataactttatataaagaattactctaaagaataccagaaaaaaaacacgaaaacctcgctgttttaggtatggattaatactgtgttagtatcttgagctagatttatatagcacgaaacagcatatcattgttttatggcccctaaaatgggttgctttacctcagaatttgtgtggggggtggcagagagatgaggatgggagacaaggctccccctctccttaagtgcaggacatttcatgtgtgtttcttgactgcctgcaggatggccagctgattgagtgtcgctgctgctatggggaatttccattcgaggagctgacgcagtgcgcagatgctcacttgttctgcaaagagtgtctcatcagatatgcccaagaggcagtctttggatctggaaaggtaagaactgtgtaatatgtcccatgtatataggacacattcctggagtctaaggagaccatgttgatagataagtgtaagtgcctctttgagggtgaggtggagttctgctggtatgcttatgtgtacattacctgatgtatgtgattatgtgggttctctgagcacagcagatttcttttcagggcacagtagaattcttccacactcccacgcctagccgcagaggagcacctccttcgttcatcatcttatttgtattcagagggaaggttacctcagaaagagagaaccttgcagcctattggattaaatatatattaaaataacataacttactttacacaagatcatatttctctctccaaagtgagtttctctggacaccagcataacaaacacagtatgggaattttacattgttttacaccaccgagtttgtggtattttgttccagcagcaatagaaaactaacacagtgattaagaagatga

SEQ ID NO: 124285 - DNA, 1122 bp, Homo sapiens
gggctagactcttggaagtggcattgatgactctgtgccagtgccccaccagtgtggttgtcttgttttgcattctcaccagtaatgtgtgggggtgcccactaccacacagcctcgccagcgaagtctgttgttaaacttagtttttgtatgtttgtttgttttttgagatggagtttcactcttgttgcccgggctagagtgcaatggtgcgatttcggctcactgcaacctctgcctcccaggttcaagtaatcttcctgcttcagcctcccaagtagctgggattacaggtgcacgccaccatgcccagctaattttgtatttttagtagagatggggtttttccatgttggtcaggctggtctcgaactcctgatctcaggtgatctgcccacctcggccttccaaagtgctgggattacaggcatgagccatcccacccggccaaacttagtttttatttgttcagtttgtttttgttgatgctattctttgctgttcaaagtgttttatgtgtcagccttttcccttatttattctacattttgagtcatacttaagaaatattgtcctgtattttctagctctctgatccacttaaaatttattcacaggtaacctttttgaactgctaaactgtgtaattgaagagatcgcaatactggagttatgtttatggaaataaatactaaatggttagtgtcatttttactaaatttgtgtctgaatgtgtgccttttttgttcttcagcatgaagactttttgcttgccctacagatgaatgaagaacagtatcaaaaggtagtttgaaatctcaccttgtttattctgggcattttcatgggctgttttctcttaccatgttttgtcagcatttttgatggcaaatttgtttttggataacctcctgtttggtgagtttgcagttcagccaagttatagtcagatacgtgatctagtatagtcactcttataccacactgaatcagaattgaagggaagataatagatgttcctgttaaaaatcattacctgacattcatcagatacactcataaaggaaagtttacaacttagatatcactttagagttaacgaggtatgtctaacctcagggc

SEQ ID NO: 124286 - DNA, 1123 bp, Homo sapiens
ttttttactgtaaatgtgaacacacagttttccacttcttacttgttcatagttttctcgacaaagagtagctgcttttcttaaaattttccagttttgtagtttaaccaataatagtttcagtgacttcattacattaacacccaattgatacataaacttcagaggagtttgccttaatcagtatgttcattgctttttaaatttttttgtctttcacaaagatagaaattcagtgcagttgtttgtttattggtttagtttttctgggctacaaacatcttaatttcttgataggccagttgtaatgtgtgactaaggactatattcttcaaccattgcatttgaagcaatgggcaggtgtgggatttggaagcagtatgaaagtaacatcatttgtttctgcagactttgtaattttcttctggaaaacccagattatccaaagagagaagacagaatcattataaatcccagtagcagtctgctggccagccaagatgagacaaaggcaagtgtcatgttcatgttttgcagtcactgcctggaaatgctgtgctttgttgttgttgttgttgttgttatctctgtgggaagaaagtgctttgttgggacaagtttttaaagactagccgagggacataggatttcagaatatatctatacttcagtgcgatctcccagtctgagccactttgaattctgtctgtctttaacttctatctttccttgtaattcttatcttccttttcccacaaagaattgaacgaattctccatatctttaatcctacaaagcaaattcctaaagcaaaacaagaattggccaaaactcttaacattttattatgaaaattttcaaacctacagaaaaattgaaatattttacgttgatcatttatatacctaccactggtactagttaacagtttactgtatcctctttatcatacatatgtcctctgtctgtccatcagcacaactttgttatgtttcatttcatgataatgcatttcaaagtaaattgcaaaaacatgagtacacttccctctaagtacttcagcatgcaggtcattacccagagtggaatatcttttttcttttgatgtgagatttgtatacag

SEQ ID NO: 124287 - DNA, 1033 bp, Homo sapiens
gtgtctcaaaaataaaaataaattataattcaaactatatctcaagctttaatctatgaatgactactttgattcttacagatagtatatagtgtaatcaaatttcagtgttaagataaatgtaaagaataggtattgttaagggagatggtgtttttgtttctttcctgtcctatctcggaagctcaatataagtacataaggagggataggcataggaaagaaattgaattattaaaatttcattttttcttagacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaa

SEQ ID NO: 124288 - DNA, 1040 bp, Homo sapiens
tattttttaagtcctagttttcccgctagtcagcagtagagtgtgggcatctttctgtgtcccaccgactgcgagctggagacagcagtggtacctctctcgggggggttctgaggatcgaatgaggtcatgtctgtgaagcacctggcccatgagtgctacgtaatgtttgttaaataaacatacgaccttctgaggtctttctggggtaggcaaccgtttaccaccctacagggtgtgcctcggtcagcttttcacggtgagataggtcttcgcccttttttcatctgaaatgtaaccggttttctatcttctgtttctcttctatttgaggagcagaagggggcctgagcattcattgtttgttttcccagaccagtgaagttttcgtttgaatactgttgttcagcgtcgcacagtaaaatgaatcttactggtattttttgtcatgacttgccagcctctgtccacccaacgttggatttttgccgaagactggacagcatcgttgggccccagctcacagtgctggcctctgacatctgtgaacagtttaacatcaacaagaggatgtccgggtttgtactttgctttcggttcactttcaggcattgaacggcttttgaaatacacgtagttttcacttacaaatacgggtggtattaacagtcctgtgttctcgtggactgtagaggatggtgctacgtgccattcaggcctctgtctgaaagggtcccggggacagtcaccctgagtgtttctgccccacgctggcagctggggctgggccttctggtaaataccttccctcagctccccccgaatggaacgtcccatttcaccagcccagattgttacgttcacttggacagtagtcatcggcgtggtcttggtgtgcacagactgaaagcattttgcctctcgttgtgtgaaaatgtgtaggggaaactggctgggatgtggggcactgggcctgggtactcagtctggcagcctgaagtgtctacactgagtgggagaggcgggattcactcctccgg

SEQ ID NO: 124289 - DNA, 1166 bp, Homo sapiens
acagtaagactccatctcaaaaaaattttaaaagaagaatctagttgtatccggcccgagtgctactgtcttcgtgacatgttttcacaggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccaggtgattccagccacttctccaatcaggcgtcccctttctaagacgagaaaagacacagaaaatcccttcaagccctttccatggggttcaagcgtgaaccaccttcatgggcgccgcttccaaacagacccgggagccctgaagtcaccggttccctcgcgcggcactccctgagccttttaaatgccacgtgcgcccgttccatttcctgttcttggtttggaacgcttattctcacagtctggccgtatgagtaacgaacgattgcattttgaccctcgtcttgcagagtggatgaagatgaggagatcattgtgaaggccatgagtgattactgggttgttggaaagaagtctgatcggcgggagctctatgttattttgaatcaaaaaaatgcaaacctgattgaagtaaatggtaagtaggatttggtatttcaggagaatttgagaagttgtcttttcattgcattaagaaacatggttaaaaaataggtaaatagaacaaatcatgactgttgagattctaagcaggtgcctctgctccacatttgatccattttctgttccttggaaaactatgacaagaccttcctgtagcacaggaaacttggcaatggcagaaagaaaattattttctacaattctaaaaaaaaaaaaaaaatgactttatattaagaaatgtccccctttttttggagacaggttctcactttgtcacacaggctggagtgcagtggtgcaatcatagctcaccacagcccccaactcctaggatcaagcagtcctcccacctcagcctctagagtagctgagaccacaggcatgtatcaccaaggcatgtgtcaccagacccagctaatttctttttttttttttgaaacagagtcttgctctgtcgcacaggctgggctcaaa

SEQ ID NO: 124290 - DNA, 1203 bp, Homo sapiens
ggtaggttttgtaggtggattttttcccctcttctacttgttaacatttcttggctgggcacagtggttcatgcctgtaatcccagcactttgggagaccaaggtgggcggatcacttgaggttaggagttcgagaccagcctggccaacatggcgaaaccctgtctctaccaaaaaatacaaacattagcagggcgtggtggtgtgcacctgtagtcccagctacttgggaggcagaggctgcagtgagccaagatcacaccactacactccagcctgggtgacagagcaagactctgtctcaaacaaaaaaaaaaaaaaaaaattcttgcctagtcttctgggatttaaggtcaaaatcaatgcaaatctctcttcctaattttacccaagaagaatttaattatatatcatgtaaccttttaagtgactgcctcttccttcctcactgttgtgtccttgttgcagaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctc

SEQ ID NO: 124291 - DNA, 1649 bp, Homo sapiens
tgcctcccgggctaaagggattctcgtgcctcagcctcccaagtagctgggatgacagatatgccaccacacccggctaatttttgtatttttagtagaaacagggttttaccatgttgtccagaccagtcctgaactcctagcctcatgtgatccccctgccttggcctcctaaagtgctgggataacaggcgtaagccaccacacctggcccatattatagttttattttgaacattgaactgtgttcatctgtgtaattagcatgtggatctcctcttttgtgaagtatctgttcacataagcacgtcctctcaccatttcaggatagtccctgaccctcttctccgtccacgtttgcttaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataaggtaaagttttaattttttactttttctctttttatctaaaatttttatttttattttttatttttttgagacagagtcttgctctgttgcgcaggctggaatgcagtggcatgatcttggctcactgcagcctccacctcccgggttcaagcgtttctcctgcctcagcctcctgagtagctgggattacaggtgcacgccaccatgcctggctaatttttatatttttggtggaaacagggtttcaccatgttggctgggctggtctcgaactcctgacttcaggtgatccagccaccttggcctcccaaagtgctgggattacaggtgtgagccaccacacccggccaggtaaagttttttcttaagagtattttgaggctaggtgtggtggctcacacctgtaatcccagtactttggg

SEQ ID NO: 124292 - DNA, 1023 bp, Homo sapiens
aaagctgatttcataacttatgaatcttaacctggacactgtaatgtttttaatagcacttgtgataaatacaagtgaatgaaataatagatggggaaatttctattgttaaaagtgaatttggctgggcgcggtggctcacgcctgtaatcccagaactttgggaggccaaggcgggtggatcacttgaggttgtgagttcgagaccagcctggccaacacggtgaaaccccatctctactaaaaatacaaaaattagccagtgtggtggcacttgcctgtaatcctagctacttcggaggctgaggcagggagaatcacttgaacccaggaggcggaggttgcagtgagctgagatcgcgccactgcactccagcctaggcgacagagtgagacgctgtctgaaaataataattaataaataaaataaaagtgaatttaaacataataaatatgttttcttttttgccttagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaagaaaaatacagtgtacaaacagcttctaaagcttttagctaatgtgtttccttattttttccaagtaaacttttttttgacatgaaaacaaagtctcttatattattttatcatttttaattcttttttgagacagggacttgctctgtcacccaggctggactgcagtggtgccattgtagctcactgcagcatcacactcctgggctcaggccatcttcctgcctcagcctcccaagtagctgcctccaagtacctctagttttttgtaaactgtaaacggatgaagtcatataagatatatgattagaagaagtctgcagtgactgcatttttaactcccttgtcatgtctgtttttttgagatggagtttcgctcttgtcaccca

SEQ ID NO: 124293 - DNA, 1001 bp, Homo sapiens
aatcaaacacaatgtacgtttcagttttttaattttcatttttagagatagggcctcactctgtcaccgaggctggagtgcagtggtgcaatcatggctcactgcagccttgaactcctaggctcaagcgatcctcccacctcagcctcctcagtagctgtgactacaggcacatgccatgacgcccggctaattttttttttaaattttttgtagagacagggtcttgctgtgttgcccaggctggtcttgaactcctggtctcaagtgatcctcctgccctcagcctcctgagtagctgggattacaggctgtactttttagttgttttaccaggatgcatggcacattgggaagtgagaggactgtgaccaggagccaaaagctctgcgttcctttctgtagaatataggaagacacctctttacagatcattctgtcaacagtgcttcccttgatttgtgcgatgatgtgagaaccttgcgttggatgttgtaacttgagctgtgtaattcctataatattaaagtaatgtagaatattgtgtttgtgttttttaaacaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcaggtagtgatggccggttacttcaacgcctcttattgctctagtgattatagcgggtttccattgtcccttccagtagaatggagaataaaatcttagaattgattttttttttttttttgagagggagtctcgcactgctgcccaggctggagtgcagtggtgttgtcttggctcactgcaacctccgcctcccagattcaagcaattctcctgcctcagcctcccgagtagtgggattacaagcatgctccactacgccaggctaattt

SEQ ID NO: 124294 - DNA, 1058 bp, Homo sapiens
agtggatcttattgaagtttcagacaatggatgtggggtagaagaagaaaacttcgaaggcttaagtaagttgactttttctaatcctattataaaataattgggtcacatgtctcagaattttgagtaacactgtcttgggaaatgcaaaaacagttttttaaagccagttactagatatcatgtatattttgttgttatagcacttgagatatcttagtccttactttacactctctttcagctctgaaacatcacacatctaagattcaagagtttgccgacctaactcaggttgaaacttttggctttcggggggaagctctgagctcactttgtgcactgaggtgatacaatatttttatccactcacttgaccccttagagaaacctctctgaaaattaattggaatcattattattttcagttttctatctcaacatctcaacttctagcttctgaattctgttttgtctcgctgccaatctaagtcatagtacttctgaaatgtgagcaataaatgaatgaaatgaagcaaatagtattgttaaaaagatggttacccttattaaaacagtaattctcaattttaacctaacatgtagataataaatgatagttaccattggttttcattatcaatttttagggaaacatttcaccaaagcactatttaattatagcacagatatgaaatttttataaataattatatatatatatatatatctttttttttttttagacagagtctctctttgtcacccaggctggagtgcagtggcacagtctcggctcactgcaatctctgccttccaggttcaagtgattctcgtgcctgagcctcctgaggagctggtactataggcatgcaccaccactcctggctaatttttgtatttttagtagagatgggatttcaccatgttgcctaggctggtctcaaactcctggcctcaagtgatctgcctgccttggcctcccaaagtgctgggataacaggcatgagccaccacgctctgccctacatatacattttaattataatatttgttag

SEQ ID NO: 124295 - DNA, 1020 bp, Homo sapiens
aggagttcgagaccagcctggccaacatggtgaaaccctatctcttctaaaaacacaaaaattagctgggtgtgatggtgggcgcctgtaatcccagctacttgggaggctgagataggagaatcgcttgaacctgggaggcggaggttgcagtgagctgagctcatgccattgccctctagcataggcaacggggtgagactctgtctcaaataataacaataataacaataataataataataataataataatgtaggggacttgatgaagggaaaggattagagagattctgaaaagaaggtagttttggccccaatgatgactaaattttaactttcatatagtaggaagtggggcactagtaaatttttaagcagaaaaattatttgaccagatttgtgatttcaaaaatagctctggtgatagagtggaggatgtattggagcagggaataaggggagataaaacctttataaaactcttaaagctagtacagcaagagctttgagggtctttgctaagacagcagctggcagcttcagtttggagtggggtatcaaaggcaactgtgtataaggaatagttatataactggtacccaatttctgagatgattttgacttaaacattgtgtatttcccagcatactgttggtttttctaattatgttgggaaattatgttactttcatttttttttttgctcgttgcccaggctggagtgcaatgccgcaatctcagctcactgcaacctccgcctcctggatttaagcgattctcctgcctcagcctcctgagtagctaggattacaggtgcccaccaccatgcctggctaattttttgtatttttagtaaagacggggtttcaccgtgttggccaggctggtgtcgaactcctgacctcaagttatccacccatctctgcttcccaaagtgctgggattacaggcatgagccaccacagccagccatgctttcacttttcaagaaagaagacaccattgttgccaaagatt

SEQ ID NO: 124296 - DNA, 1077 bp, Homo sapiens
aaaaaaaaacacccagacacatcagactatacgctgtatgcttacctatatgaagactattgtttaggggccgggcacggtggctcacacctgtaatcccaacactttgggaggtcgaggcgggtggatctcttgaggtcaggagttcgagatcagcctggccaacatggtgaaaccccgtctctaccaaaaatagaaaaattagccgggtccagtggacagcgcctgtaatctcagctactcaggaggctgaggcagagaattgcttcaacctgggaggcagaggttgcagtgagctaaaatcacaccactgcactccagcctgggtgatagagtgagactccatctgaaaaaaacaaaaaaaaaaacaaaaaaccagactatattgtttagggataaatagttgacaaaataatagagacaagcaagacataattaccataaaaatcaggacctggggttgggggtggagagggaaggtttaagtggaaagaatggagtggtgacaatgtgtgtcaacctgggccatggtgaccctggggttcgctttgtaattcctcaaaatgagcatttatgtgctattcacttttcagagggtagaatctctgaaccaaaatgtttaagcaaccatatattaaaaaaagaaaaaatatggacagatttgtattttaattaaaacatttaaaaaatagagacaagggtctcgctatgttgctgagagtggtctcaaactcttgggattcaattgatcctcccgcctcagtctcccaaagcgctgagactccaggcgtgaaccaccgcgcccgacctggaaagatacatacatatatatatatatatattttttttttttttttttttttttttgagatagagtttagctcttgttgcccaggctcgagtgcaatggctcgatctcagctcactgcaaactccgcctccagggttcaaacgattctcctgcctcagcctcccgagtagctgggattacaggcgcctcaccacacccggccaatttctgtatttttagtagagacgaggttttaccatgttggccaggctagtctcgaactcctg

SEQ ID NO: 124297 - DNA, 1005 bp, Homo sapiens
ggctgcaagataagacagtagggtacaagggagggtgacttcctttttgaatttaattgtaaaagtaataatcattgtataaaaatttagaaaatgaaaatgtatatattaaaaagggaaaaactattttttgtttgtttgtttgagatggagtcttgctctgtcatccaggctagagagtgcagtggtacgatcttggctcactgcaacctctgcctcctgggttcaagcaattctcctgcctcagccgtccgagtagctgagattacaggctcctgccaccaagcccggctaatttttgtatttttagtagagacggggttttgccctgctggccaggctggtctcgaactcctgacctcaggtgatccacccacctcagccttccaaagtgctgggattacaggcatgagctactgcgtctggccaaaaaagggaaaaactaatttgaccacatggagatcatcactgtgggtatgtttgagagatgacatgaatggtcttccagtcacacagggtctggtgttttctcatgttggtttgtgtgtgacatgtgtaggggaggctttgcaggctttggggagcactgcagtgtgtgtggagtgagctggagtcgtgtctcattctcataagggccgtgagcttagtgggttcaccagctttagatcatgcttctttctaagcagcctgacttttttccagaagtgactgagcagaaaagagggtacctgggtcagaagtaatctgttgctggcggagttgggcagaatggtgatgggctggttgacagggtgatttctcaggagtacctcgatcgtagtgcagtcttctctcatgatggcttcatagagtttcgagtgaagtgctgcagatgggccatcttccagggacttggcactgtcaaccaccaggtctctgcttcctttcctggttatattccccatgagaaaaacttaagacttcaggggaaaatgttgttatggaattggtcagtttcagtctctt

SEQ ID NO: 124298 - DNA, 1074 bp, Homo sapiens
acttgtttatgggaaaacatgttggttatgtaaagtcaataccctgacagcaaaactgtttgagaaactagttaacgcctccttttcaaggtaaccacagaatcctaggttctcgttttggtggcctctcaaaacgtttcgaagagttgtacattttaaacctaattctttttactttgtcactcattcaaattgcctaggggatatgaatgatcagtttcacttatttgttttaaattagggtcagtttcactttctcttctgtatctttgaatcaagtctacagtaagtatttggtttataaagtttaaggccagtcgtttggtttacttaagtataattaagacgaaggttttgtctttttaaagcgtgtgtgttttctcttataacggaaatgctatgagaacgtggattacattgtttacgaagaagcagagcgtaacagtttctctttaaacgtgctaatattattacctcaatgtatgcagagtgccacagtgtctaaatagtgaaactccacaaatgaagaaagaataatgcattctagcatttgataacaagggagacataccatataagagactgggaattttaaagctttgagtaagactagtatttaaagcaaaggaaacacttgtgaagtctcattcctccacacagatccaacctcgattcatgttcatgttgtttttttgaggcaagatctccctctgctgcctaggctggagtgcagtggcgcagttgtagctcactgtagcctcaatctcctgagctccagcagtcctcccacctcagcctcctaagtaggtaggactacaggcacatgccaccacacccagctaattttttttttttttcttaaagagacagggtctcactgttgcccaggctggtctgcaactcctgggctcaagccatcctgctgccttggcctcccaaagtgttgggattacaggcttggtccaccatgccccacctgtaggttgttgttttaatgctcttgtaacttttatatatcatcagaagctgttgcttacaagttctgatatttgtaacagtaatatttagaagctt

SEQ ID NO: 124299 - DNA, 1019 bp, Homo sapiens
acactcagctaatttttctgtttttcttttttgtagcaatgaggccttgctacattgcccaggctgttctcaaactcctgatctcaagcgatccctctgcttcaacctcccaaaatgctgggattacaggcatgagccactgctcctggcttggttttatcttttcacagctgtgatattccccccccagtgtgcttgcctgattttatatacaaataccctaggatctgcagagtggacccctctgaacctggtatctgatgaaaagtgagcaaagaattttgtgttctcctaagttgtggtggctttgactatgaagctctagctgtattgataatagtattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatgaaattgcagaggtgatgacagagatcgacaatctaacttccgtagaggagaggtaacaatttgtggctacacctttaagctatttactcttttctttctacctccatcctgtagtcaaacttgcagaaagtggggtgagagtggttgggatgtggggagcctgtggagttgttaattcctctcctctccccctactctgcgtggaggggtccaggggtgtttccctggatgttacctcccattgcctcctctgtaagtcatcatctgcctttataggttcaggcataagcacaggcacttcagggttgacccgcacagaaattacctgcctgcgtcataaggaactgtgctttattaaaatcactggtttgcatcattagctttttctgaagtgtctcaagttatcaaatgtgaacagcaatggtggctgcaccacccctgccgccactgcggagactgggggcccctccgtgagggcctgtgcttcgcttccttgagcccgttgttgcgggggaaagtacactggagggcc

SEQ ID NO: 124300 - DNA, 1085 bp, Homo sapiens
ccaggctggtctcaaactcctgacctcaagtgatccacccacctcagcctcctaaagtgctgggattacaggcatgagccaccgtgcctggcctgaaaaaatatttttgttggatgggattctattttatgaatgtaccgcaatttattcgtgttcttactgatgaatatttaggctgttttctggttataaagagcgctcctatgagtgtctcagatacagtctcaatgggagcatttctttaggataaatacctgcgtatggaattgctgggtggcagcatgtacccacctcaaccttgctggatgttgccaatgtgttctccaaagtagttaattatttttttcttctttcagtgcctgaagacctctcattagaagagagagaagaacttctagacattcgtcgaagaaaaaaggaacttattgatgacattgaggtaaaaaaaaaaaaaaaaaaccaaaaatccaaaactctgttttttgcttttgagtaaaatagtaaaagagtagcctcacaaaaatgtaaaaaaaaaaaaaaacccaaaaacaaaaaataacaaaaaaaaaagatgtttagtgtgtgcatataagaactacacaaagagacagagtgaaaagttatcaagttgggaaagcaaagactccacacaggcagtgagaccccgggtagaaatcaagacatcgtagaactgaggtcagcagtagccagctcgcaaacccagggccacaggcagcgtatcatctaaagcagcagcaagccacgagcgcattgctctgtcaaattgtgcactgagaccctctttcgttaactaatatgtttttttgtttgtttttttctttttgcttttttgagacagagtctcgctctgttgcccaggctggagtgcagtggcacaatctgggctcactgcatcctttgcctcctgggttcacgccattctcctgcctcagtctcctgagtatctgagattacaggcacccaccaccacacccagctaattttttgtatttttagtagagacagggtttcactgtgttaggcagattggtcttgatctcctgacctcgtgatccgctcacctc

SEQ ID NO: 124301 - DNA, 1018 bp, Homo sapiens
tcccctcccttgaatcaccagatccccatggaagtgattgagaaaaagagagatgaaaagctgaatcagaatagatagtgggatcagggtgaagaaataccagggcctgactcatcactctgtttccttagaactcagtgcagggttgtgaggaacatatggagatgtggtgttggctgtgctaatttgggagagcagagagcgagggaggcctgatgaccctgagtggccacgggcagccggggtgggcttgtgcagcagcgatattgatgagcagctgaactgggaggccagaggacacacgcggcttcaacacgctcaaaactgctagagcttctcctgggcgccacagtcctccttcctggtgcattgggtggcatcccacccatctggagtggaagccaggtctagacagggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaataaaaacccaccaacgtttagcagcattctgaggaggaggtccagctattcttttttttttttttggctgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaagcaacaggccaagctgaaaactagggcagagagagttataaaatgaggctgggcactaagcttatgcctgtattcccagcgctttgggaggctgagatggggggatcactggagcccaggagtttaagaccagga

SEQ ID NO: 124302 - DNA, 1017 bp, Homo sapiens
tttaattcctatgggactttgttgcctttcagtttttcgagaacagttcttgagctaattggagggtagctggctagtttggctcattgggattgtcttcgtgtcctgtttgggcatttgtctgattgatggtcctgaatggaccatccctggcagatgaggtgaattaactataattggcattcttctctctgaccccttcactccctgatcaatgtaggtgtctgtgcttcaggtgaagagatgctgagccttgttcataataaaatacatgcaaattaagactagattgagctcccacctttcaccttcagacaggtgataacccccaagtatacaaagtctgtttcaagtttgaaatatttgaacggcaaggtcgtttcaaacatttacgggtaagagtgtaaagtagccacaggcagggtcagcccatgtcctgttggctcagatccgtttcttgccctttccctgcagggactcacccctgcaggcaacatttcccaggcccttggtcagctggcttccggctgggattggccactgggagccactggcaggaggaatggcaggaagaaggacaaaaacaggttatttcccttaggcctgcctcagggagtgtctctggcaggtaccttgtctccttttggctccagctcctgccccttggtcctagcctttgagtcttggaaatacctcctcccttttaccctctatttgagaagtggtaacagcagcttgctcttgataatctttgtattatcatttcctgtttggcttttcagtttttccatcacccctgtcactaattccttatattaaattccctctatatcagattcttaaagggatggtttctctggatgtctctgtttctctgggtggaccctgatagatacaggtgctttaggcagtagctttaaaaattacaggcgtgtaaatcctttgacccagcaatccagttctaggaatttaacctgcagatatatttgtacacgtgtgagataacataggtacaag

SEQ ID NO: 124303 - DNA, 1034 bp, Homo sapiens
gcgagaccctgtctcaaaaaaaaagtgtccctcgtgggtttggttgcatgagaatgcttggtgttcaattcttgaggttattagaagattgaactttgaaatcatcccgcaaccttgaaccaaaaggtgaaattgtccactttgatagatgacaacggaaggatcctttggttcaatggacagcttgtaaatataaaacagttgctggaaaattatattagagatgagctatctcctccattacaatgtttgcttttctttaatgcgattgagttccaacagaaaggcttgggaggggccacaagcaatgcttcaggagttactggaagagagatatggggagtgagagaggagatccatcgatgtggagcaggggccaggggaggccttctgcccaggaggcctgtgctgaggaccctggctgtgcccaagggaaactgaattcagagctcctcctgcatcataaatccaggacagctggcagctctccaaggaagactggcgctaaactccaagggcatcagccgccagattggccaacccctacaatgccctttgagagctgagccccaggtgtgttgaatcgggattccgttccaacctcatgaccacattcatttacaagccctgcattttgttaatttaaaaatgcactcaccaggagggaaggaggagaggctccattaaatataagacagctgaaaggctggaattcttctgacatgcatgtcttaggaaggagaaggcctgaccttgttctttttttttttgagacagggtctcactctgtcacccagactggagtgcagtggtgcaataataactcactgcagcctctacctactgggctcaagtgacgtgacctcccacctcagcctccccagtagctggaactacaggcacatgccaccatgcctgggtcgctatgttatcggggctggtctccaacttttgttctccagcgatcctcccacctcagcctctcaaagtattggaatacaggtgtgagccaccgagcctggccaggcctgact

SEQ ID NO: 124304 - DNA, 1014 bp, Homo sapiens
ggtctcccaatctcatgccaccctcctcagcctcccaaagtgctgggattacaggcgtgagccaccatgccggcctaattttagtatttttagtagagaggggtttctccatgttggccagggtggtttcgaactcctgacctcaggtgaaccgtccgccttggcctcccaaagtgctgggattacaggcgtgagtcactgcgcctggctggaaataacttcttaaattgtcttttaaccattaagttttgcctcgaatgtggctacttgccactgtcacttttttttttaattttttttttagagctaaggtctcttgaataaagctgaaaattcttatgttgaaaggtacttccttctgttattttatcaccttcctggttttgtctaatctcagcgagattacagtcatatttcttgttctttttaaggtgcatttaacaatttcaagcacagagtctttgttctgtggtcttgatgttttgtgtactcccggacatattttgggactctttaaacagaagaatgtttgctttaaatattcttaatgtctttaaacctactttgtcatattcagcttctaaaattttcatgtgtgctgatgagatattttatttagagtgttttgttttaattaagcccatcttaagagacattcaatttttgccaagaatctgctttctctcttacaaaccagttatatttgtaacattcataaactaagttattagcaaaggcgaaattttagctgcaccccggctatgtcttgcagattcatggcggaattaaagagagtaagggcaggctaaaacaaaacacgatgacaaatcaggatgctataaacatgcatgacctttattttcaatattttcttaaatgcggtttttcctttttttttttttttttggagacggggctcactccgttgcccaggttggagtgcagtggtgcgatcttagctctctgcaacccctgcctcctgggctcaagccattcttctgcctcagcctcccg

SEQ ID NO: 124305 - DNA, 1544 bp, Homo sapiens
ttcccaaactttgcaacccccccccttatttttaattgtaaagacgggtctcggccgggcgcggtggcttactcctgtaatgcactttgggaggctgaggcgggcggattacctgaggtcaggagttcgagaccagcctgaccaacacggagaaaccccgtctctactaaaaatacagaattagccgggcgtggtggcgcgtgcctgtaatcccagctactcgggaggctgaggcggcagaatcgctggaacctgggaggcgcaggttgcggtgagccgagatcgctccattgcgctccagcctgggcagcaagagggaaactccatctcaataataataataataataataataataataataataataataaaggggtctcgttatgttgcccaggctggtctcgaactcctggcctcaagagatcctcccatcttggcctcccagtgctgggattataggcatgagccaccacatctggcctgcatagacgttttatgttatccttgaagctaaaaatggattggaagttaacagcgttttgataaatgtaccgtattttggccagaggtggaactgagttgtgagggtgaagaccagggaaaataaagtggaagacgtggaagcacaaaacgtctcagaggcctggaaccattcagctgatcttagagtatgctcacaccccagcaccctggagaccgcctttgctgtaaaaaattggtatctcttttttttttttccctgagacagagtcttactcttgcccaagctggagtgcggtggcgccatctcagctcactgcaacctctgcctcccgagttcaagcgattctcctgactcagcctcctgagtagctgggactacaggtgcccgccaccacgccaggctaatttttgtatttttaagtagagttgggttttcaccatgttggccaggctggtctcaaaatcctgacttcaagtgatctgcccgcctcgacctcccaaagtgctgggattataggcgtcagccacagcgcccagccaagagactgatatttctacatcccttgaattccagttgcctttttctttcttttatattttcctttttggtagagacagggtcttcccatgttgccaaggctggtcttgaacttctggcctcaagtgatcctcctgccttgccctcccaaagcactaggattacagtcagaacccagtgagcccagcctcagatgactttttctagtggaaggaaaggttgtcaactcgagaattctttctcaaagaaagctggccaagtcctgagcccctcttgcattccatttgcatacctctgtgctgaaggagggaccctcctttggggagtttacagttggacggtccttgggttgctccctggcgtgcagaatgaaccagtctgagcagtagaaccaccacactgcaggtgccgtccctttctaacgtcggtttggccatatcaaagtatgattgtcccagtagcaggtcttcaggtggctggtgcctgacacaggtgatggtaattaacatgaaacctaaca

SEQ ID NO: 124306 - DNA, 1066 bp, Homo sapiens
ttattttttttgcatgaacctctcgatccccttttgagaattgggttgggaacgcggcggtcaagtcgatcatatttgatgcatgcttgattgtacgggccgctttggtgcccccaaacttttctttaaaaaaatttttttttcatagacggggtctcgctgtgttgcccaggccggtctcgaactcctgggttcaagcaatcctcccatcccagcctccaaaatgctgggattacaggcgtgtgccaccacgcctggctaatctttaaaagttttttgtagaaatggggtctcactgtgttgtccaggctggtctcgaattcctgcgctcaagtgattctcctgcctctcagcctccaaaagcgctggggtgacaccgcgcccggcctctcaacttattttcgacaggttttttgacttacacttctgccactgttaggattcttaaaattgttttcgccctttccgtggagaaagttttgaagatgctggctgggaggagccggctgtaatgggggactgttttttcttttctttctttcttttttttttttaaacaacgtggtgtggtcattgacaaaaaaactgttctttgcttaacgcgttaggtatgggatgtagcagaactggccccctgtgactccaggcattgcttttcatgattgtccgtgatggttacaggccctagaggaagacaaaacttgtcttatgcagtttttttctcccatagaaacaagaatctcagtgtaacccgagcaaaatcgcgcgtctcagcgttgcttgtataggttagtgttagcgaggaagaattactaccagtttaatcaaactcaatgcaactggtacatgttgcagtaaagtccaaggaaagttctggcatcacggttaactggattgatattcttcaaacttatcattaggacagattttggttcttgcaattcagatgcaagaaggataattagacagctgatttttgtaagatgcccatctgtcggatttgtcttggaagtgtgaaggagtattagagtatgtaggctattcaggctttttttttttttttttt

SEQ ID NO: 124307 - DNA, 1049 bp, Homo sapiens
agcctctcaaaaagtactgggattacaggcatgagccactacgcctggcaattttttgtatttttaatagagacagggtttcaccatgttgaccaggttggtttcgaactcctgaccttaggcgatctgcccgccttggcctcccaaagtgctgggattatgggcgtgagccatcgtccctggcctaaacaacagttttattattttattttttatttttttattgcttattactattttttgagatggagtctcgctctgtcacccaggccggggtgcagtggcatgatatgggctcatggcaacctctgcctcctgggttcaagcagttctcctgctttggcctcccaaagtgatggaattacaggcccgagccactgcgcccggccacaactattttaatagtgttgttttggtgttggttgattaaaggaatgggaacgaatgacttgaagccctctctgtttcactctttatacaaagtggagtccagattgggctagtggcctgtctagcccaatgtctgacttggacatacattactgtccaggagtttcttagctgaatgtgaaaaatgccttccgtgacatcatccttacaggaacattctttacatttattctttacttctgttgaacggtggtggcgtgaaccatgaatttgtttaagcttttcagctgttttgtgtgttttcctctcaaggcatggggtttcatatttttgacctgtggtaaaggtatttgaattctgcactggcctccaaatgtaggtgtagtatatggctctgatctttgttgatgattttatacataatgtggttttttttcttgataagccaaaaaaattatacataatgtgtgtgtgtgtgtgtgttttaatttcaaatgatagttacagtaaaagtttggagttgggctaagtgggaggagcatcaggaagccatttttagaaaccttaaattcaccctttataactttctgtctttttgcattagtcatctgataccttagtactgcctactttttcacatctccatcactacgtagctc

SEQ ID NO: 124308 - DNA, 1035 bp, Homo sapiens
ctcacgcctgtaaccccagcactttgggaggccgatggggtggatctcctgaggtcaggaattcgagaccagtctggccaacatggcaaaaccctgtctctactgaaaatacaacaacaaaaaaaaattagctggatgtggtggtgcttacgtgtagtcccagctacttgggaggctgaggcaggagaattgttcgaacccagcaggcagaggttgtggtaagccaggattgcaccattgggctccagcctggaagacagagccaagactccgtcttaaagttctcttaatggaaaaatgaagaacataatagcaacataagttatttgctttcattgtggttatttctacaggacagggcaggggaagcacagataggttaaaaaaaattgtagcatcatgagctagggggaaatccaatgtagaaatggcatgaactttcttccagccgactcatgttcgtttcctagagtgatgacattgctcgatgattgaaaagaggttgaactgagcagttaattatataaagttagaaattccaaagaagtagtaactaccagaaattctccagcagtatcagtcaagacttgtggccaaatacggcttccattcttcatgagggaaaggccatggaaaggctgtcacattgcccagtgcagatgttgacttggtttgtggaagcgcagcgtggacaaggaatgaatatacactaataggagtggaataacctttttcttttacctatttgaataaattaagtaaaagttttaatcagaagacttaaagaggagtcgattttatcttttgattgcactaagcttaaatataaggttgcactttaagaattctgtagtttaataatcatattcttataagacatagatttgtaacaaatagtgattggtaataaaatttcagtcagtatcagattatgccagtaccttgaatttcttcccggttgagcctttctcagctaaagatgtcattcaggaaaggaagtttagaggattttagacacagctggttgcctttata

SEQ ID NO: 124309 - DNA, 1491 bp, Homo sapiens
aacaactgcacttacttcatgaggtcttgttcattgatacatctttagcacctagtgtgcttctggtgtagcacacggttgatataaattgaaattgaattaatgctcacagtagtttggggatggagctggtagttctgcattaattttgcaggtgaaaaaaaaaggcatgaggaagttgaaacttgccaaaaaatacagccagtacgtgctagaattggccctgggtctcaaatctgggcttctgactccaaagcttaggctcctgctcatacaggtttattttcacattctaagcttttaacgaaatgtatgtccaatgagtcatttctgtttagaaagcctttaggagttggaagctacttcctggtgatgtaatgtttgactctctaaagtctttggaatggggagttccaacttttgttaagccctcaataatgtcatgagtgaatgaatattggcaagactggctgggcctgtaatctgccttgagtgtgagggaaaatggaaaagcgcttaactttatggtgaattctaatttatagtagttgagattgaacgacaaaaatcttaaaattatgatgctgatgtgtcattgtgaccttggtaaactgacagcacagcagagagaagggctcattaaggagagcacttggctaactgaaccctcaggatgccagagacttgaattctcatgtaagcccttaagcttgccttgtcaatgctgtaaaaattggagacctttatgttttgctaatgatgtggtgaccttagttattaggtgatagcctcttgaaaaacattccaggtggttgggagactttcagccaccactcttctgcctggcggcacactggtaatattaggattagtctctacccattgccagttgtgcaggtggtgctcctttctctgaagtatttctacacacttctctgtttggcaagtttaactcccatcgtctctgagctgttaattaaatgtctgggatgtattgtgatagtccctgcttatagacttatggtgctgtgtgaggattggggctgggggaggtggcatttaaatacagctgaatcaatgtgatggcagttacgtgtggtagtttattgactaagcactttctctcaagagaacagtcattgctgattgccataggggaggctgtagggatgtggtgggattttgagctgtcccacttaaggcagcagaataagttacttaaagaggaaggctgtgtttgtatattagtgttaattaaaatacctttaggctgggtgtggtggctccagcctgtaatcccagcactttgggaggtccaggtgggcggatcacttgaggtcaggagttcgagaccagcctggccaacatggcgaaaacccatctctactaaaaatacaaaaaaattatccaggcgtggtggtggacagctgtaatcccagctacttgggaggctgaggcaggagaatcgcttgaacctgggaggcagaggtt

SEQ ID NO: 124310 - DNA, 1046 bp, Homo sapiens
cagagggtagctctagtggccagctagctctcttgctgaaaatgagcaacataagtacatgaaaaacccaacaagtaggatttgaaagcggggctaattgtacccttatttcttctggggataaaagtcttaaactttgtttaaagtaaaatgtttttatttctgacggtgatttgtttcacttaaatagcttgttgtttgtttctttcatttctcttaagttttgggttgggtttggtttgtttcccgcaagttttgcccgtgccgccttcctccttgtgcctgcagggacatttgctggtgtggcagcctccaggcccgtccccagcctttttcttggcacaccttctctaggatggctgggacagtgacttagcttctacacctgtgactaaccattttcattccattctacagctttgacaattattctgccaatgttatggtagatggaaaaccggtgaatctgggcttatgggatacagctggacaagaagattatgacagattacgccccctatcctatccgcaaacagtaaggattgcagctgacttttaatgtgtcttttagagtatataattctcgagcgcttaattagtgcatgttacctatggacttgcttatattgccatcatttgggtattgagtaaatagcaaacagggtgggattggttccatgtaaacatccccctagatgcaagcccaggggttttgtgttttgagcgttaccagctgttccattgttgggcattttacagtcttccatttagctttagaataaccgtatgaaagagctactttttgtttttgcaaaccagtttttaacaccaattagtttgaaggcaggtttgctgtgtgacatttttgtaccacagaatcaaattaggcagttaagattcaggtttctttaaaccaagttagtaactaatctcacaggtttaatacattttttcccacaaaatacataatttgtatggattttgtgaaccatacaatagaacctaaatttattcaatgtagattgaagttttggttttgtaaaatg

SEQ ID NO: 124311 - DNA, 1025 bp, Homo sapiens
agcacacctgggttggccggagggattggggttggggttgggttgaggtcaggaagacatcctagagaaaggctggctttgagccctgattgatgatgaggcagcctgtgattgattcaaccagtacttcgttgtagggggtaatatgggtgaaataacttagtggttaagtctgctgtattaaaaatcagtctataatccccagacaattcaaattcttcagtatcttaggaaactcttctatacccagtggatgtttaataattcagattgtaaatggatttaaaaacatactggctggtagagtaggagacttcagcccactggacacatgtggaagggtgtggtgtcattctgagaaacaagagccaccctgctgtgactcagggggtaccgggcagggtgaggcctctctaaggaaggcctcacagtaagtcaagggtgacttggcaggagtcccactttgtgttctgaggaacacacagataaggaaagagaactctcctcagcttgaacaaagctgtagagtgtgacgcctggtatcaaagtaggtgttgtcctcatagggctagaacttaaacttcatgtttcctctgtgtgagactgtggactgctttcctataaaatatttgaggagcaaggagggagtgggacatggttcttgccctcaggtagttcacagaaaagtcccataaactgtgtaagacaccctgtgctagcaagggggtgagccgggcgcttaaggagcaagaggggcgagcacccacccagcagtggaagcattcctgtctggactccttcagagataaggaaattatcttgacaactcaggggcaggccacagatgctcagataccagtgtctggaaggtctcatccctttgagccacactgtcctaagaagaactggatctggtagtaacatgctggcacctgggtctcttgttgataaaggggaaacctctaaattttgtactacatggaatgtggtccctgattgctggctctgtggtctgcagacctgtt

SEQ ID NO: 124312 - DNA, 1048 bp, Homo sapiens
gaagagcagccctggctacacttaccaccgaggagggagtggtgtgtgatgcaggagtaacaaaggcgttgaaggcaccacgtgtgtaacaggcacgcgggagtctgggttagtcagaaaggggaaagcagtgctcaggttgactggaaacataggccggtgaccggagacagcctgaggctccagaacacacaagtgacctgtgaggaaggaaactgagagaccctggagagacaccggtggtgccctctcaggtcctcttgagtgttacgaggacggggaagaaatagagcctcccagccagggtcagccagcacagcctctgtatgtgaagcgtcaggacagcgacggccgggaggaggggatgctaggaagtgagtaccagaagcactagacagggttttgggaagctatatttagctggggacgaagaaggaacaaggaaggaacaggcagatggcatagcacgaacgccgggtggaaagtggaactgctcgctcctgtcgtgtgtgtctcttctccatcaaaaaagaggctcttaaaaatcgaaagcatgccacagatacgatcagaggctctttggaagctgcatttttgtaactggttctcgatgatcctctcccatggtaaagatttggcaccatatgaagtccttgggaggacaaatcttcaacagtagcccatagatgaaacccagatagctgtggaaactaatgtgctctttgaatgttaagtcaggaaagcttgagtggcctggcacggtggctcacgcctgtaatcccagcactttgggaggccgaggtgggcggatcacgaggtcaggagatcgagaccatcctggctaacacgttgaaacctcgtctctactaaaaatacaaaaaattagccgggcgtggtggcgggcacctgtggtcccagctactcgggaggctgaggcagggagaatggtgtgaacctgggaggcggagcttgcagtgagccaagatcgtgccactgcactccagcctgggcgacagagcgagactccctctcaaaaacaaaaaaaaaa

SEQ ID NO: 124313 - DNA, 2999 bp, Homo sapiens
gggctaggtagtttattctcatttctgaacagatgatgaattttctcagatgaccctaagaaattgttttaccaaaaacaaagtgatctatttgctttgggaggaactcccttccttttgtttctcttcccttccccccttcccctgcggttgtagagcccgttctgtccggtcgtggttctgtccagccatgatccgggagtcctagcttgctaatggaacacctgagatgttccttatggctcaaggcttgaattgaaggtgggaaccacctgaagcctccgtggggaggccttgcctgaggttaggtgtctggcatgagtgccgccggctgggtgtgatttaggtgaaggacatctgtaaaggagcgtgtcacaacctctgttccttcttcacatctagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtatggaatcctgtgtttttcctcctccttgtacctcttttattgtagtgacagagactggagtccagtctgggaaaggagggtgtgtgtctcccactcagggcctggtgtactcttggggaaccagctggcaaggccctgtgggtcttaacgtcagcgttggaaggtggaagcagggctgggagccggcagaaggcgcccgggccccaggagctgcctcccgctggtggtgtgatcagaagagagtggggtcgagtgtacattgccgtgtggtcgtgtttcctgtaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaatactggtgtttttgagacttgatgaacaagttcctggtgtgtgtttgtttgccttgctttaaagtcctgggttgttggagacagtcattttcaatgcgtgtctccacacaggagggacagggagtgccacctccaggggagaactgggtgagcccaaatacggcaggagtggaggtgacattcatgtttggacctgtcgaacagtggcgaagctctgagggagaagcgcctatcggggtgtgtgtgcacatcctggcccagagctaggggctgaagatggagatgttgggaccctagactggccctggaagagtagaggttggtgaaccacatgcccttaagatcctttccagaggctgagtgcgtggcttacgcctctaagcccgacgctttgggaggctgacacaggaggagcgcttaagcccaggagttctagaccagcctggacaagaaagagacctacccaaaaaaaaaatgcaagagcctg

SEQ ID NO: 124314 - DNA, 1031 bp, Homo sapiens
ggagaaaaccccagcccgcaccctcaccacagttccatttgtacatccaggaagcccagtttgaaaaacaaaccacgcctgtaaactgagttggatgaaaagagctgccttgggggtgggaggctaaggaactgttcacggtcttctgggtgggccctggattcccgcacttctggagcagtcctcagacagccaagggatccatccacgggccagggcttcccgaggctgtctccacggtcgctgggtctcaggagtcgtcctatcacctgagcgtgctcactacttctgctaccattatggccacaatgacttcccataaacttaagtcattgagaccatggaattctgttcccatccgattcctgttgatggacattcgctgttttggcgtcatgggaactcctcggatggtaagtcagtttaaggacaaaagcgtgagtccatcgttcctgggacagtttccagtggccctggtcaggccacgtccacactggagaccccttgtgctggacaggagacgcaggccgctctgtcggagaccacgctgtccaaggcccgcatcaggatgtctggcatgtggtcggtgagcatcttcggacctatgagtattttgctgaattccgcttcgtgtgaccacttggcgctatagtgagcagcagagcagcagccaaacctgaagcagaaaaggagagacagctcccacgcggccccagggctgaccccgcgctgctcctgcctgcccaccacacccaccacgccgcactcaccgccccgaggcgccctcctcctgcaggtggatgatcctgccgggagggtagagaggggggtacttgggagaagagtccagtggggagtcgctggagaagctgtaggccggggaccagcgcgtcagtaggctctgctcccccagaagaggctgtgtcaggacttcctggtcgcccccgtccagctccgtgggcaagttgttggggtttcctccaaacagttcgtaccacaaaccgtgcagcaagatcttgtactgagggcga

SEQ ID NO: 124315 - DNA, 1037 bp, Homo sapiens
ctctgtgataccttcatgagaagagccctgaggcaccgaaggggaagggcgtatgtcatggtcccagggccatatggagaagaagtgcccgctgcatccgggcgcaggctgcaactctgcccagcggacacctccctgttccttctgtggcctttactgttagggcagggcctgggttaaccactgattcataaggaacttttttttttttttctttgagacggagtctccctctgtcgcccggctggagtgcagtggcgcctcctcggctcactgcaatctccgactctctggttcaagcgattctcctgcctcagcctcctcagaagctgggactacaggcacgtgccaccacacccagctaatttttgtgtttttagtagagacggggtttcactatgttggccaggctggtctcgatctcctgacctcgtgatctgccggcctcggcctcccaaagtgctgggattacaggtgtgagccaccatgcccagcctcataaggaactttctagaagaaagttgcttgcctcaggcaggttccaggagagctgcatcttcctcggtaacagaaccctccgtggtagagactcagaaactgaacctggaggagggaccccggacatctgcgtctgggctggggcccgcagtcaccgagccttttcctctctctgtcttgcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagtaagccgaggggatctggtttggtctgtttcttctgtttcagtaaatgcttctgatggagccggtccctctgttcccataaaaccgcgtttgagaa

SEQ ID NO: 124316 - DNA, 1882 bp, Homo sapiens
atgccaccacacctggttctttttaaaattttttttttatagagatggggtcgctctcactttttttgcccaggctggtcttgaactcctagcttcaagggatcctcccaccctggcctgccaaagtactgggattacaggcatgagccactgcatccggcctttatgttatagtacccagaatttcataggcctccctacataagctatattttactatatattgattagggtgaaagtcataataacaaaaagccactatgaatttagtggcactttcaatcaaatttgtatttttaaaatacaattgcttatttcctataccttactatgtagaatcttgtgtgtgggagacttctaggaatgggaagaaggaagctaagtttgtcaatatcagtaaccttttgttttcttttcttctctttgaaattctagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattt

SEQ ID NO: 124317 - DNA, 1005 bp, Homo sapiens
tcctactgattctgcattatgacgagttgtataattatttcattgtatattatagtaataacagaagtaaagtgcacaatgattgcaatgtgcttgaatcatcccgaaaccatccatccaccctgctggtctgtggaaaaattgtcttctatgaaaccgatcactggtgtcaaaaaggctgggaccactgggttatgcagttgccaagctgttgttctattttgggccgacatgccccactccccactcatcttaggctgctttgtggtaaagaaagcaagagtgtttcctctgagctcctggtgggcagtgggtcgtgatggaagcttgccatttctcttccagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctcacatttttcatgtcactagaaatctacataattttcagtagccacagagtgtttcattatgtgcatgtaccataa

SEQ ID NO: 124318 - DNA, 1110 bp, Homo sapiens
cttttctcatcagtgttacaaccaaaggatgttattggcagacctgctatacacacaataagtttggttgcctctcagatgcattaggctaactgaaattggacccagaaggcaacatactatgtgactccatttatgtggctttctagaaaaggcaaaactatggacagagaacataagtgtgattgcactgcaggaggtgaaggaagcctgggggagtttgactgcgaagcggcagcatggcagaattttggggatgatggaactattctgtgtcctaattttggtggtggttatgcctcagaactgaacacctccaaaaaagagaattttactatatttaagttttaaaattccaaaaacaaagctaaggaaaaaaatcttgcctttccaaatacatgggtgattaaaaaagctggggggtgctggaacagtggcaaggtattgacacctggtgttttttcttttatttgtaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgaggttagtttaaaaggttacttagggccaggcatggtggctcatgcctgtaatcccagcattttgggaggccgaggcggagttcagcctccactttgggtggatcatgaggtcaggagttcgagaccagcctggccaacatggtgcaacaccgtctctactaaaaatacaaaaaattagctgggtgtggtggcacgcacctgtaatctcagttactcagaaggctgaggcaggagaatcacttgaacccaggaggcggaggctgcagtgagccgagatcacgccattgtactccagcctgggtgacagagcaagactgtctcgagggaaaagaaaaaagaggttatggctgggcgtagtggctcacgcctgtaattccagcactttgggaggccaaggtgggcacatcacgaggtcaggagatcgagactatactggctaacatggtgaaaccccgtctgtactaaaaaataaaaaa

SEQ ID NO: 124319 - DNA, 1053 bp, Homo sapiens
aggtcaaggctacagtgagcttgatcgtgcctctgcactccagcctgggcagcagagggagaccctgtctcaggggaaaacaaaaaagaaaaatctgaatgtaagagacaagttataacactaaatgacagcagaattattgagaaatttgttcctacttaaggtgatatatttgagaagtaaaaggttcgtttgaatgatacacatcctggcataataaagcccctttcctgtggtcgccctttatagtgagacagaaaagcctgttagagcctcccaaaaggagcatgtttgggaatgggaagggatagaaaaactacaactgctcttgttcattcagagccatccctagacctgggccttgaccccacgcacccctccttccctgtctgcactccctgcacagtgtgatccacaggaatcccaaagctcttcaggcccttctaatacttcccttctgtttctctaggtatttctgggaaaagccagcttctgtttgcactggtcttcacaactcgttacctggatctttttacttcatttatttcattgtataacacatctatgaaggtatggtatgccatccacaggaatgtatttcatctacagtgcacaggtctatggacacttaatttatgtcagctgtgtatttttaattaaaatgctccaaaaataatgtcttaatatgctgttcttgactttaaaactttcagaccaccttgtatatataactgggactaaacgagctatcagtaagcatacatttttggtttcaaaacagtagttaattaaaatactttgaagttagaacttttttattttaggttccttaagtatgataaatctaaagctcttgataactctgtaagtaagagcggtaactattatattttcaagccgtgggaaattacagagtccccagagaaatccagcaagttggtacataacaaggaacgaaagcaggactcctagttgcagtgtctcatttcgctgctgtgtgaggaactgtctataggcttctatcttttttctttgccactgagtcagttttac

SEQ ID NO: 124320 - DNA, 1045 bp, Homo sapiens
cctctgcctcccgggttcaagcgattctcctcagcctcctgattagctgggactacaggcgcttgccaccacgctcggctaatttttgtatttttagtagagacagagtttcaccatgttggccaggctggtctcggtctcctgacctcatgatccgcccgcttcggcctcacaaagtgctgggattacaggcgtaagccactgcgcctggccgtttgttttttactattcactgttttcatttgagagattcaggagcatataaggaaaatatgaaatacttcagctaaaatgctaacgaaggaagtgaaatagatgagttaacttcgtgtgtgtgtgtttgccaagtattcccgggacattattaaattgttcttgttctcagacttaggatgatttctgtcctggtttgtgtgttttcctgattttaagtaaatcacccagatcatttattcagaattaaatgctaactttgacaagctgctttatttttccatactaaattataaaagttgtttagagtcttttgaaagagtaagaatttgatatgagtttctcaaatgactggaataggagaaacgtgcatccagattgtgtttctcattttgaaaatactcataccaaggttcatttttaggattttagcactgattttgaaaatgctgttttagtctcggaaccatggtgctttttaccccataaggatcagggatgaggctgactcgtgtggaagctggagattctgtgttcctcataggcagattccagaacagctgcctttaaggaccgttttaaagtgggggcagtgagttgatcatgtttgaggctgcattctcttgtggctgtatctgctgttgtcattacagaagggtgtcaacatggaatgtgagtttctcctattctgaattatcattgcagctcgatccacggtatgctcaagttgtcactttatttttgtcctaaacactgacctacataacctcggaagaacaagcggtggttttagatgaagggcttcctattcaaattttcctgtaggccaatg

SEQ ID NO: 124321 - DNA, 1138 bp, Homo sapiens
ttaaaaaatttttgtagagacggggggtggaggaactctcattaggttgcccaggctggtctcgaactcctaggctcaaaggatcctcctgtttcggcctctcaaactgctagaatttcaggcatgagccaccgcacccggccttctcttacactttttcatacaataggcctgtagagctcttttgatatgtgggaggaaagaaaagatccccagggagtgttatttcaaaaaagtaaaggaaactgctggcacccgaggagaagccggaaacccggcagggaaaatttggcagagtccggggtcttcttgcaagggagtccctgcgagctgacctgctgagcctgcgctggggcgcgccccctttaaggggcggggcctggccccgctctcccagggtgccccgcgcgcgcgcgcgccggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtgagcggcgggggaaggcccggagaggctcgggcgtgggggccgggtctcgccgaggacccgccgacctcggccaccccacggctcgcggggcctgcgccggcccgacacaccccctcggccggcctaacgggtgcccggacccggggggcagcggcctgcgggccctcggggtgggctccgggccgggtgtcgcagcgcgggaccccgctctgcagtcggtccccgcgtgaacttgagctgtcggagcgcacccggctgcgcggggccctgctgtgtctgaaaagttggcgtgggacggggggtccgacaggcgtggcccctctctgggcttgaatgggggcgcttctccggccgggatctcccgtgggggtcccggggttgcaggaaacccgcgaatcaatgggacgggcgggaggaggatgggcaggatcgtggccggctgcgcctgacgtggcagcccagccagctcgggaggtggggcgggcgcc

SEQ ID NO: 124322 - DNA, 1087 bp, Homo sapiens
acctgggccaatgcccagtgatctgggtgtggatgctggaacctgggattgaacccaggctggggaaggagcggccttcacattgacattccccgacccatcccctctgctcacctctctttccctgaagacactgacaggtgccttcgtcagaatcagactagaaatggagttggcgtgaaaggaaagaccagtagaaagaattcccctctttattctctgctaaatcacttcttcacccatatagggaaacaaaacttactatcacccagattgccagctgtatgtggagtgtctgatttgtttgggagtggaggaagtgagaaatgaaattgagtctttctctttccttttgtttcagatattttcctgtataattccagaatgtcttcagagagccgtgcatggattgcttcattaccttttccatacgaggtatttctctttcagagtttaaatattctcctcttttctgctttgattattaattgttgagatcctctagcttcaggaagctccttgtggtttccagcatggtgagggaaagaaggccggaaagaatcacgagtcctgagttgggagcctctactcgtagttaatctgccttttgagatggaggttttaacttgcctacttttaaaaagcgatatttacagattgtgaatttctgttaaatacatgcaaaatgtttcacatagttttctatgtaattcttactattatctcaagcccaaaggaagtggttggccgttggttactttctttagtatcatacaatttcttcaagaagaaacccccatgaacaagccatgcctgttttctttcagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggtaagttgaggctcttagcatacagcatggtgacagctccactgtcttactaatagtgctgcaaacaaggagaggcccccc

SEQ ID NO: 124323 - DNA, 1050 bp, Homo sapiens
gtgacgtgatcatagctcactgcagcgttgacctcctgtgctcaagtgatcctcccgcctagcctctgagtagctgggaccatgggtgcatgccgccaccacctcagatttgtcttgtagtcagattgcaagtgctcaatacccacatttggctggttgctcctgtactggacaccacagttccaaaagcttagtttggaactaagcagctgccattttcctctgatgacacatccagtggacagattatgaaaatctcagcaggtgtgcggtgtccttgtctcgtcaagcaccatcccagcacgtgcccccttgtttctgtgcaggtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcaggtaattatgctgtaggtttctgacttcaagtttcagaatcgcaaaaaagacatttatttttccagtaaaagcatgaagttaggtggggtgtggtggctcacgcctataatcccagcacttttggaggccgaggtgggaggatcgcatgaggctaggagttcaggaccagcctgggcaacacccaaatgtccatcaactgatgattgaataactggtctcctgtagagaccttgtctctacaaaaaatacaaaaatgagccagggccgggtgcagtggctcatgcctgtaatcctagcactttgagaagctaagacaagcagattgcctgagctcaggagcttgagaccagcctgggcaacatggtgaaaccccatctctactaaaatacaaaaaaattagctgggtgtggtggcacatgcccattgttctagctacttgggaggctgaggcacaaaaattgcttgaacccgggagggag

SEQ ID NO: 124324 - DNA, 1038 bp, Homo sapiens
agcagccagatcactgacaggactctgagctgctccctgaaggccaccattgctgtcactgccccatacaggagacactgagcaccgggaggacacgtactcagggaaggggtgacgtgtggcagtgtgggatagaaaaaccgtggaattttatctaaattaacatgcaggaggcaatttctccaaagcatgttggagttccagggaattgtagacttaagtatttctgcagcctctcccttgctccagggtcctgggcactgggatgtgacagtgactgagatgagactcccagtccccctggtgtggatgttctaggaaaggggacagaaaatagctaagccaggaggcgtgatccagaccatcaggtgggcagtgccatgggccttggggtcaggcttccctctctccacttcccgcccctgtcctcgaggccaagagtgctcctgacctaatggtctttgtttgcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagaggtgggtgcctccctggcccaggcctcctggtgcggggac

SEQ ID NO: 124325 - DNA, 1048 bp, Homo sapiens
agcgaagcctttcctgcccggccgggagccgggtgcgaacctgctgtcgccctgggcgttccccgccgcagtggccccgccggccgggaggccggagaccacgtgcgacgtgtgcggcaaggtcttcccgcaccgctcgcggctggccaagcaccagcgctaccacgcggccgtcaagcccttcggctgcgaggagtgcggcaagggcttcgtgtaccgctcgcacttggccatccaccagcgcacgcacaccggcgagaagcccttcccgtgcccggactgcggcaagcgcttcgtctacaagtcgcacctggttacgcaccgacgcatccatactggcgagcggccctaccgctgcgccttctgcggcgcgggcttcgggcgccgctcctacctggtcacgcaccagcgcacgcacaccggcgagcgaccctacccgtgttcgcactgcggccgcagcttcagccagagctcggcgctggcacggcaccaggcggtgcacacggccgaccgcccgcactgctgtcccgactgcggccaggccttccgcctgcgcgccgacttccagcgccaccgacgcggcgggggctgcgcggaggcgggtggtgacggcccccggcgggagcccggcgagacggcggccgccgcggggcccgaggacacggaccctgggccagagggatctgaagttggcgaggcggacggagaggcggaggccgcggccgaggagagagaggaggcggcggtggcggcgcccacccccagcggcaaggtggaccccgcgccggaacggcgcttcctggagctgggcaacggcctgggggagggcgaaggcccctcctcccacccgctgggcttccacttccccgtgcaccccaagtcctggctgcacccggacagcttcccgatcctgggcctacccgacttccgagagcggctgccggtcgacgggcgcccgctcccggcgcccctggggggcccgctctccctggtggagggtaccgggctggcgtgcgaccctttcggcggcggcggggccgcgggcggc

SEQ ID NO: 124326 - DNA, 1092 bp, Homo sapiens
attttgggtcctggggctgtacaccttgccctggtactggagtaggtgagccctggatgagccacatggtgctggggcctctgaagaaagggctggggatgtgtttggaccaccacgaagggtacctggcccctcactctggcctctggaagcctggccaacatattcacaaaaagtaatgccccaagtcaggtgtttacactacatcaagtgtggggcagcgtgggggccaccaaggaatacggtgggcatgggcagcacggggccacactggcctggggccaactcctcatgggccatcctaggacccattctaatttcttaaaagagaaaatcttttaaaaaatgtttgcagaaacaagttggacctgaggccgcgcagagcctccccgacgggttcccaggagtggcgacagcatggagtccagtcagaagttcagtttgtccactctttattaaagccaggccctcctgctgacagctgcaggacagctgctggggcccaggagggacggagacagcagatcctggccatacagggctagagctgagattcccagagccccccaagcccaccttgcccttggccctttctgaggctcctgtcccgcagggagaggagaaacccagggccgaggtcattacccagcaccccaatgcctccctgggacccctgctctcctcaccaccccgccccgcaacctcaccaacctcacccagccaggctaactgaccgccaccacccaggccctcttcccacccaccaactaccgtgcctcctacccgcccccagccctggcagcctggctgctgcgctcagcccccaaggccatgtctacactaacgtggagggaactaggtctattagggaatgcagctgcaccaaaaatccgtttcctggccccattcacagtggccccaaaagcgtgaggggaatggggcttcacatgaactacaccccagctgcccgcccagtggcttccatgggcccagtccagagggtaggatgcccaccaggcaggggccttgcatagttgggtgcctggtttgtcactgagccacggctcaggtccacacccccccgaggtggac

SEQ ID NO: 124327 - DNA, 1031 bp, Homo sapiens
ttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtacc

SEQ ID NO: 124328 - DNA, 1048 bp, Homo sapiens
tctcactctgtcacccaggctggggtgcagtgacacaatctcggctcactgcaacctccacctcccgggttcaagcgattctcctgcctcagccttccaagtagttgggatcacaggtgcccaccaccacgcccggctaatttttgtatttttagtagagcagggtttcaccatcatggccaggctggtctcgaactcctgacctcaagtgatccgcccgcctcagcctcccaaagtgctgggattacaggcgtgagctaccacgcccggccagggatctgatttgtaaggtttgtacactaaatgctactcaggagtgggaaagcactcacactgagaattaagtgatggtagtatgtcagggtgggtctggcttaagcaaatggtcaggagattgaaagatgggaagaataattgctaagcttatcaagcatgtgttttgtgccagatgctgctctgagcactgcattaactgctgcaatcctacaaccaccttatgaggtaggtgccattatctccatttggcagatgaaggatactgactacagagaattgctaagtagcttgccctaggtcacctcaccagaattcatgctattaaatatactgttcaaataggaacaagtagaatttcatggtcagaatgagtttagcattaaatcatagcatcattagaatactgaagtttccagttgatctcatcgctatcctcacaagataagcctatagctctgtggactattttatatttcctgtaggatatatatatacattcctgggattcttcatccaagtgaaacagaattacagggcgaatgccctggttatagggctgttcctttaaacatgaggagatttagtttattctactatgtggaatgaggaaagaaggcaaaatagtttggaaggatgtagtctagtgaaaatgctaccacaaaaatcttagtatacagtgctaatgccttaaattgtaatctctctcaacttggtatgaagtgatgtggtataaagtacagctttacctccccctaaatgaatccctaattga

SEQ ID NO: 124329 - DNA, 1109 bp, Homo sapiens
tttgtttgtttgtttgtttttgagacaagtttcgctttgttgcccaggctggagtgcaatggtgccatcccagctcactgcaacctccgcctcccgggttcaagcgattctcctgcctcagcctcccgagtagctggggttacaggcgcccgccaccacgcccagctaatttttgtatttttactagacatggggtttcaccatgttggccaggctggtcaccagaattcctttttaaatcttgcatttaatgatggcagattatttcagtaggatccagtattcattcaccatgagaatctcatccactcagtcacaaggtagccatgtgtgagtttcaaatgtgcagatcggtccccctcctgatcattttccaatcccttctgaaggcttaaagggacagtctcccacaagatgtacttcttggaactttctgtgtaggttttgggcgggagatgaccgccttggcaggccagaccgctcataacgccatggcttgggttttccttccccagatctgcctccgctttcacagtcctccagatttttccaagagcagcagaaaatgaataaatccctggtgagtgtttctgttcatgtatttattctctactctgatttacaatacaccttaggaggagattaagggttcaaagtttaaaatgggaaagtagaaatagatacaagatttggtcagacagaacagtagccatcagcaccaagcctttttatcatattcatatgcgcagatagcgtgatccttaaagagttcttgaagtcagagtacaagcgtcttatgttcttggcatttatcacaaaaaatgataaataccatccattccttgacttacattgaccgtaagcagaatcacttttgtttttgcatgaattttaaagattcctctgagatcattatcaacagctttcctaaataataacccttgaaccattgcaattcttgcctttctttttttttttttttttttttttttttttttgagaccaagtattgcgctctgtcaccaggctggagtgcagtggcgctatctcagctcagtgcaacctccacctcccaggttcaagtgattctcctgcctcagcctctggag

SEQ ID NO: 124330 - DNA, 1349 bp, Homo sapiens
agaaaatatttcggtacattgtcttaaaaaataaaccttttatcttatacagttgttaaaatgaatgacattgtgttatggataaaataagtgaaggggtaaattaaagtgcagactaaccgataagcatgatctctgatgtaaattaaaagctgaacatacatatgtgatgatataggcattacccaacgatacgaaagcagttacttttggggagagatagtggtagagatggtaaagaaaatttactcttttctgtctatgattttctttcatttgtttaggtttgttccttttgttttctttacattttctgatgtttaaaaaaatacccagtataccttattaacaataaaaagtaacctttgtcaaaagcacaaagattttccctatcagcacatgtagatcattgtttttaacagctactactattctatgctatggctctatcttttttttaaaaaactggttcctcatcaacagacagacgtcttatggttatggctgtcgagcatcttggctgacttctatgattatatctgtaaaataagtttctgatcatgaagtgatatatcaaggcataattagttaaaaatttaaaaagatgttgtgaaatgcccttccaaaagacagtaaaagtatgtattatgagaaagaatacaggactaccagttttcttgtatctgtgtcaataacagctgttaataaactttaaaagttttgccaatatgttaggttaaaaataatatctcttcatttgatttacctttgtgagtgaaatttgaacatcgttgaccattttttactgtgaatcttttattttctttatctgtttttgtatttggttaactatcttttttattatttatgatactttttggttctttttgctgtacattaaaaaaatatatttcataaagaaatatgccctttaaccagcgacttcattgccagaagtttatccaatgaataaactcatagtgttttaatagtcacagcttctgagtgtgggagagatctcaattcgtaatatcaaaatgcaaaaatatattttcttccagttttgttttaattccattttctaaaatactgaaatcttagaaacatttgaaattgttactagaaagtaaggatccagctggttttgtttttttttccccaaaagattaattaattcaataccatttcttcaataagccacctttttcttgatttgaaatgctgtttattatgtattaaatttccacatgaatttttgttttccatagagtctttatttcaacctgatgaagtccctttataagattcatctggtagagaccaccagggacacatctgtaggctgacaa

SEQ ID NO: 124331 - DNA, 1042 bp, Homo sapiens
aaaacttcagaaataaacagttcataagttttaaattacatgctttctgagtagcatgatgaaatcttgtttcaacctgcttgggacatgaattatccctttgtccatcatatgcacgttgtatatgttactcacccgatagtcacttagcagctgtcttgattattaggttgactctcgtggtattgcagtgcttgtgttcagttcaataaagttaaggttcaataaagttaaaataaaggttcaataaagttaacctttattttacgtaatgaccctagggcacaagaatagtgatgatggcatattgtcatgattttttttattatttaatatcttattgtgcctaatttacaaattagactttctcataggtgtgtatatttaggaaaaaacatagtacgtgtaaggttcagtactatctgcggtttcaggcatccactggggttctgggaacatattccctgtggataaagggggactactatagtgaatttctattttcccttgtatatgcagtttcttttgaatgcctcagtccttgatgtttggctcctaaaaaaaaaggaaaaggacaaaaatgaagagggttggggagagcaccagcctttaagttccttggcagttacctcagctagagggggaggggcttgcatcagtgggtggaggtacaaccacaatggctgccagcccctgcacctatatcttcgtgatcagaagtagcagtcaacagtcagaacacccattcctgatatttggaggacggggtccttattgcccaccctaactcccacagctacatataagctgctccacaaacacgtgcacagttgcctgcctgtgggagtgagggtggggtggggtcggtagctgctgctgagcaaataactgaaattgactgaaatcagccacagtttaccttactgtccaggactttttcttgaagtttgaagttttcagtatactttgagagcttcataatagttgtatgagatagattctaccagcgtaagtgttctctgggtatacagactcattcttg

SEQ ID NO: 124332 - DNA, 1059 bp, Homo sapiens
gagttaacagcaaagaaagaaaaacaacacgacaggaagccctggatccacaaaggatcctggtgggaagaataggaaattctgtgtgcaatactgacatactcatccataccccaccccaactgtgactgtcctactaattaatctggttttatggattttccataatgtgctgttttagcagcaaatagaggggtaaactcatagataatagctaaatactgttagaaattaactttccgttatagctaaatgttaccagaatttttactccggttatgtatacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaaggtatggtttactttattaagcagtaaacataagcagtattttagtctaaattttgtcatattcctgtctgtatctgttaattaaaatgggctatatattccagatattaaaaataattcttggtttgcctcaagagaagggaattgctaaaactcagatttatttagggaataagatattaattttgaattcgtttttaagtagaaatagttcagaacccatgatttggggaagggcataactattcagatttgatttgtttctgaaaatgtttttctaggttcagttttgttatatgtgtgtctttggtttttgttacttgttttggtcatagcttttgcttaagtcttgttttcctagagaaacttgaggtgtatgtaagtttcgatttatatttttataattagttaatagaactaatcttttttttcctcaagaggcacaaagaacaaggaagttaaaaaccaaggatgcgttctaaagacttcattttc

SEQ ID NO: 124333 - DNA, 1383 bp, Homo sapiens
gctcttcagaaactcgttcagagcagtgagaaatttctgtcagtaatctattaaaaactggctgctttcttttatgaagtgccaagcagagactatttaaggcagcatttagcatgcctatgaagcaccaggagaacttattaaaatgctgattctgagtcagtaggtctgggcctaagattatgcatttctaacaggctcccaggtgatgctgctgcttttaatcagtaaactacagtttgagacgaatttagattataatgtcaactcttactagctccagtgatgtcctagataacactgacatgaaaccaataaatcagagtgtcagttcacattaggatgagtttgctttcctttggctaaatcactaatagagggataaatagggactttgaaattaggacagtgctttcttcagtataatttattaatatttggattttacatctatgtaaataaccttttaaaatgttttgtttaatagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactgactgaattttgttgataaaaacatgttaatatgtgtatgtttctttagtaccaacaacaaggactcttccttagtctttttaaatagagtggcagtataacaaaatagatgagaacagggacatcagcaatcagcagtagtcacttagcaaatagctattgatgctgttatatgccaggcactgaga

SEQ ID NO: 124334 - DNA, 1933 bp, Homo sapiens
tgtactgtttgggttgatacatatatagatgaagtgtattgggttgtagacacctaatgggcaaggctttgtagtcattgaatgccctagaggtatgtttccgagtatgagccacacaaaaaattacagtgagaaaatgaggaagagaaagcagatgttggagaaggagatttctccttgtatagctgctcctttgatttgaagaaatctcagtaattttatccgctaaagagtgtgagagaatattgtttcatttaaaaatactttccacagtttcacttggtttcaccaatttcaattggttttaaatcattaggatgtctaagtaaactattgatttcttccacaggtctagtacattaggttcctctgctttaccttgccatctttaatgtttgtattcttttaaaattagctggtcctttataagtatgtaaatattgtagctagcaatgtgctgtttattaacaatacctgtttccactacttttttagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatg

SEQ ID NO: 124335 - DNA, 1257 bp, Homo sapiens
acccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtct

SEQ ID NO: 124336 - DNA, 1063 bp, Homo sapiens
aaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaa

SEQ ID NO: 124337 - DNA, 1034 bp, Homo sapiens
tcccatcctgctgtcaacctgatccagtgtgatgctgacctgagaccctgtggacttgacttttatccttggaaatgaacatttgtggaaggtgtttctgctatttgagcatcagcttttcccactgacccctgacttggtctgtccctcccatctctgccactaaaacagcctacagccgatccctctaattggcccctgattccctgtgagaaaggcttgacaacttccttggatgcatcctctgcccaggtgagtgaccccaccctcctggaatctgaccatctaatctaaagttgcctttgccctttctcccaggagtctgagaatgtcctcatacaaactggactcacagctggccctgatattctagaatttctaggcagacatgaaaattagattgaagctgtgaccttcatttcacacatataaaaagaatgtgtgaggacctatgactaatgaaagcagcctcatttcttcacagtcgttttccaaataccactaattgccctatgctttcaacgcaaacacagagtattactcaaactgccacagaaatgaatgagtagagagtaccacacctgggtcactagcacatcttgaatgacaaggtttctgttctgctctcttgacatcctacccttggaagtgacaagattggagtagacactggctcagggatcgtttcctccctatctgccctctacatgtatcctatcatctagatttccagcactttcttctttgctacctgaaagaatctaaccaataacatgagtaaaaagaaccagactcggtagaagcaaacatgactatcttgctctttacaaagccaaatggttgatagacttccctgtatgtgggagagagaaaggaaattctgacccaaataagttagaccttttctgtaggatgccagaagaagctgagattccaagcacatagtgttttggtttcgattttggaagaattaaagaagactcagttagtaattggaaggggacatgaggaaattgagaatagaaaaccacatg

SEQ ID NO: 124338 - DNA, 1010 bp, Homo sapiens
ctctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacggtaagaaaagtaaaagacaacatcaaaaagcatgtggttggatcctttgtacactgagtagtattttaatgtgttggacttcactgtccagtagccacatgggattgagatgtgctataagtgtaaaatacacatcggatttcccagagttggtgccaaaaaaacgtaaaaatcctcaataatttttgcattgattacatattgaaaggataatgctgttgatatgttggctaaataaaatgtgtttttaaatttcattccacctaattttactttttaaatgtggctactagaaatttttaaatcatatggctcacactgtatttcttttggacagtgctgttgcaaatattctggtgaatgaacacagaatcagcatggctttcctttgctgagaaatcactgatgggaagtgagacttgtta

SEQ ID NO: 124339 - DNA, 1167 bp, Homo sapiens
tagtcacatttctagtgctcagtagctacatgtggctagtggctaccatattggacagcatgaacatgaaacatttctgtcattgcagaaagttttattgggcagtgctgctttaaactattgcttaggaatatgattcataagttttccccccttcaaagggataatacttattaatttgcttaccacactgaagttgttataactctgaagttaagctgaaggtactagtaacagtgcaattaagataattgatcatgggaaatatagccaggatgggattctcagattcctaccagctcattttattggaagtggttgttctttctccttttttttcaataaatattttcttgaattcatagcagatagagagaagaaatacaaatatattgaaaaagagggttcttgaatagagaattttctgactttctgaatagtttattcaacgtaagaattatattttgctgatattttaaaactttttatttttaaacattttcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacc

SEQ ID NO: 124340 - DNA, 1014 bp, Homo sapiens
gagtttggggtgggttgaagtcagggaagacctaaaggaagttattcttgatgatcttaaagttcccttccaactccagattttgtgattctgttacatactactatgatagacagcaaaaatttcgcagaataatgaggacaattatctttaaaataataaaccatctatagttcttttatggattaattatcaacataataaatgcctttttaaaatattttaaatgattatggatattgctttgaaatttgtaatagatgcagacttcttagttaaatatttatattttagtaaagtcttttgttttaaaatgttttccattaggaatgaaattgttcaaaatgtagttttgaagtacaaaatacatagtgaaacagattgctttagaaaaatcactttaaattttccagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacaggtcagtgcagtttgacagcagcttttaaaaaagtaacaatattctatattttctttcctcagttgaaagtaaatatgcacttttgcttgcttaggatctttagaaggcatttagttttaacctaatcagttgatctactgaagacttgtgccttatcttactgtccctaagcctcttcattgagttatccagtttttcctttcagtctgagaagggccagtcttgactgcatctgaatttatgtaaagctcaaattgaatagagaaactctcttcagtttctccaattgttgacataactgcatcttctacaagaaagattggcttttcctgatctcaactatagtcttacttgaagtgctgaagtctagttataccacagctctcagctttcattttctctttttattatcattgggggtatttggggtaaccaatttatc

SEQ ID NO: 124341 - DNA, 1049 bp, Homo sapiens
gttgcagtggctcatgcctgtaatcccagctctttgagaggccagggtggaaggattacttgagcctgggagtttgagaccagcctgagcaaaatagtgagaccccatctctataaaaaatttttttggccggacatggtggctcacgcctgtaatcccaacactttgggtggccgaggctggcagatcacaaggtcagaagatcaagaccatcctggcaaacatcgtgaaacctcgtctctactaaaaatacaaaaaattagccgggcgtggtggcacacacctgtagtcccagctgcttgggaggctgaggcaggagaattgcttgaacccgggaggcagaggttgcagtgagccaagatcatgccactgcactccagcctgggcgacagagcaagactctgtcctaaatttaaaaaaaaaaaatgtttttaattaaaaaataataataaataagaaaatacatagagaaagtattagcctagaagtcaggtcccttgacttctagattttgatgctgcttctgctgtttgtcagttacctagtaaatttatatatatatatatatatatatatatatatatatatatatatatatatgaaggcaatacgtaatgttttaaatgtacattttagttttgatttaaattttaatcaaggatttttattttatacattgcatactgaccactcttttatgttactctggtcctaataaacagaaaataacaatttggaatatatacatatacacacacacacagtgttcgtttttgtttgtttgtttgttttgttttttgagacaggatctcactctgtcacccaggatagaatgcagtggcatgatctcggctcacggcaacctctgcctactgcctcctgcctcctgggctcaggtgatcctcccacctcagcctcccaagtagctgggaccatagggtttcaccctgttgccctggctggtcttgaactcctgaactcaagcgatccacctgcctcagcttcccaaagtgctgggattacaggcatgagccaccatgcccagccta

SEQ ID NO: 124342 - DNA, 1047 bp, Homo sapiens
tttcttctttgataggcttggagttatgggggataacacagattgcttctaaatagtttgggtttatctattagcatttagccaaagtatgaattttattttttactgtcactcatgttaacaaaggtggtgtgaacatgtcgtgattagatatcctatgtaaccttaaactataaaggtaatacttatgtaagaactaatttaaatgttttgtatgagttaaatgtttgaataacattatttaactttattcggggagaggatatgtttacagtttttacactgaatattctgtaatttaccatgcaattgaattactaatgaaatgttaaaagagcatatcatacctctgcctcagttctcttctaagtaagctttttatgtagtcacgcaattaagactgtcaagacatatttgaatttcattttgaatggtgccagtggccctgtgctcctggttgatacagcatttatacccagtttgtcttactagctaatttaaactctgagcacatccctgtcaccttcacaactataaatgaaatatcttgccatatatgtagaaagtaaaaggtatgtgtttcttaacttctccctaaacttcagcttggcagtagtttataatttgatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtcggcatgcacgtgtaaatgtatgcagttggatacaacagggaatctggtacctgcagagactgtccagccataaaatgttaccaccttaagagaacccttcaagtgtggagc

SEQ ID NO: 124343 - DNA, 1050 bp, Homo sapiens
ctgtttgagcaactattttattatgtgatttgcggatgaaccaagccctaagtaatacaggtactgaactggaaataatagtatttggattctatttaagttctgtcatttacttgctgtgtgattttgagcaggctacttaccatttcagcctcattttccttttgtgtgaaatgttaatgatatcatggtgtcttcattacattgttgcaggagatgaagcaaaaggaaactgtacacagatctgcactgacaaaagggagtacaaagaacttgtaattcttttgctgaccctgggcagttcagtgaaatgcttgggagaatgattctgaggtagcacttagtttagctggagagaatttggggatcactaatgatgtatgttgtaggcaaaggaatggtgtgcaccctgccagggccacatataggccttccctcaactcagactggaaggccgatctatgcttatatgatcagtccaccagaaagtctattcacacccactaaaagctgaagtgtttaaagtgtgcattaactagcagaacattattaaagagaattgctgccaaactctggttgtcagttaaatttgaaaaggattcacttcctacaaccggtatttccatcaaaaatgatatgtacttttatgactatacatacacacacatatttttaatgataagtattaaatacatgatattcaaggtttacactatagtgttactgatttaaaggagtaattgctctgaaaattttaagtattctaagtcaaataactaagctgtaaatttatggaacgacttatttttatttctggcatccatcatttcctgatgcaccagctgaaaatatgcttggcagcaccaaaggaaaactgtaacccctgaaatagcttgttgatggatggcttgaagaagttgataactgagataagcagccattgtccctgttgctgttgctatgttaggggttcttaacccatgttgagtttggagggctgcatgcagtggtctggaaacttctgacactacatgtaaaattttaggtttg

SEQ ID NO: 124344 - DNA, 1574 bp, Homo sapiens
aaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaacagctattcctctttacccctggggttccattctgtaaatgaaacagagtacttcgccccctttttctgcactctcgcacacatatcaccatcttcccttactctggaaagcagctagtcagcaggtagagaagggactggtggtggtggtggtggagggtgatggggaggtatagtctagtcctcaccaggaaaataatgtgggcaggaatagagacaaaaattggtgctgctagtagtcatgaggagaattataacttttttcttgtactcctgcagaccacgtggtagaaataggaggagaaagacattccaagagagaagaatgacactgaatgaaagcccagagaaaataggcaaatggattgaatgctatgggcacccacctgcctctaagctggtggaaatttatattcatacagtctttgtggaagacaaattgtcaatatgtatcagaagctttaacaaggtagatcgattccctttgccttagaaattccacttttagtaatttatcatcaaaacacaagcaaatgcattttttgtttgtttgtttgtttgagatggagtcttgctgtgttgccaggctggagtgcagtagcgtgatctcagctcactgcaacctccacctcctgggttcaagtgattctcctgcctcagcctcccgagtagttgggactacaggcctgcgccaccatgcccagctaattttcgtatttttagtagagacggggttcaccatgttggtcaggatggtcttgatctcttgacctcgtgatctgcctgcctcggcttcccacagggctgggattacaggcatgagccaccgtgcctggccaaaatgtggcttttaaaatggtatatttcatgtgaacctttttgttatgtatattttatgtgtctaaaatagctgtaggaggaaaaacattt

SEQ ID NO: 124345 - DNA, 1098 bp, Homo sapiens
aattctgtacaaacaagagatggtaaatcagtgtactgtgtttaagtggtacactaacctttccatattcagagaagtacctccctgggtcttgaacattaaaggtgtttaataagtactcagtttgacttggacttgagcctttatttttgaagggaataaagtttcttcttccagtgtacctcagagggacttggtaagcatgaataaagccatctgtttgaaaatgtatgtcatttttggaaaagtgctacagaacctaaaatacagtcacaagtattatttcaaatgtatagttcagaagtagaatacttagaaattgcttgttaatcttaattgtaaatagctaaaaaaaatatagcttgcaataaaggacacaagagcattaaaatataaaagtcacaaactatacatctctgagaataaagggggaaatgggatgtaaaaaccctaggctggtggcactcacagttggtatacagcagaatgactttggctgcttgtcagaagcgaataaccctgggcctcttccccatcacttctgattttataggtttggagtgtgtcccaggcatctgtgtttttaatcatttccccccctaacttactctccccatctaaacttgagaaacacccagactactgtagtattatggtactatagactactgagtattagtacagtactatagtgctgactagtaagcttcctaattgccaaacaaaagaaaaattttcactgtcatcaaaagaaataaactttcttcatggtaattataaaaagactttttgagaaaaaaaagcatcttcaatagtgattttgtagaagaagccaatttgtttttttgtgtatttttatttaaacatttttattaaaacaaggggcattttactgaagaattaagagccttcagtgaaggctaagtgcaggtgtgctgccttctagtaatccagactaggtggttagtatgagttatgggttgaattctgtccccccaaaaaggtatatttaagacttcacccccagtacctatgaatgtgaccttattttgaaatataatctgtttgcagatggaatcaagttaagatgaggtcata

SEQ ID NO: 124346 - DNA, 1935 bp, Homo sapiens
agtagcacacgatacccagttggtatgtttgtcctttatttggatggaaactccagaatctctgggtagtcagctgaatgccaatttaaacctcagaaagacatcagtggtcttggtgtatagtttcaaagataccactaggctttaagtatgccctgaagcctgacattttgggtgcttcactgatgcatttcctttgctgatcttatttattggtttagtgagaatatcttcaatgacatgacagttgctatcttagaaagcaaggccaaacaatctaaacttcatattcctgattgaaggaattcctcctgcaattccgtacattataattgtggtcccttgttagaatagatgttgctcatgttttgaattaatatgatgacatgaaatgagtgatacacagaaaacattagcaatatatggtagttatgactttgccatctagtatgtcaccagacattgtacagaattatcccaggccagtttttaatactagccagtcatgtcaattgaagttagatattctcccaaaatattattttcagctctgtcactaaacttttctttatttataataatatatgactttttatagttgtgcgttgtatgggtctaaaatagtccatttgtattagtagctttgagctatcttgaatctagatagcatacaccaagacagatttcccacatatttttaaaattgattatagacttctgtcacacataatatgaacatctctctttagagaagaaaatatgagtgtaatttcaggttctttcagataatcatgagattttaatttccttggattttcaaaggaatgtaatctcttttcatttttttgttataaatagttaaggattaacagtgtgtgctttaattacaaggtatgtataaggttattctcccccccgcaaccaaccctttttttaaacttttgatgtttttgatcaatgtcattattatcaaagttctttcagagttactgcagggctataggcttaagttctttttgagatattgttcctagttttgtaatcgtaggagactttgttagctcatgacatctcagagctttgagccccctgtggtatgattttgggtgtgccaggtcaaattagactgttatatttaccctagtgtggacgtgaatcttctcttagttcccagaaattctttggttcctgtgccttggtgttgtagctaacctttatttattattaagatttttaaattttaattaaggtctttaggtttgaaaccttaagaatttcatgataataagaagcttaatacttttgaaattatcttttctatttaattaagctgtattttggtgcttttactttcagagctaaacctctctccctattcagtgttcacccaagtaaatttgaaagatgttattcttcattatattcaaaagtatataaattttactgtacatttgaagtttcatcataaatactcaagatcacaaggaattttgttaaaataaagcccttcgccatatcatgctgaaactaaatgcctatcctcaaaggcttttttgatctctcttgttttccattcttcccttaaaatagttacctatcatttccattaatttgcattaaccaccttatcatatcttgtggtctttaaaggaaaatgatatgctagctaactttatttttttcatacataaaacaatgtgtttaaccccaagtgtattaacaatgctttgcaatttcctgcaatgctcaggaaatatctaagactactataccaaaaagcagattgaatttgaattctatttttacatagtaaatataaaattgtattttatagtcctaaaattatatttaataaatatagtgtgaacagggtattattttagtagtttctgtcatgaaatacttatgcctcacaaaaccaatagtgtaaaaaaa

SEQ ID NO: 124347 - DNA, 1044 bp, Homo sapiens
acatggaaagacactcatcttattatttattgatcccaattgtttgcatttacttagtaagaattttgataccttttcttctagaatctcagctctccccccttgtgacatctgagaatgttgaccagttcctcttttgtattccatacacccctctcttctgtatcttttctttctattctgaacgttgcttcttatccgtctcctttgcaggcccttttccctcagtttccattcttgtgcttttttatacagtgggcgctcaataaatgtttgtttaattgaattgcattgcttttgaaagatcagttgcaggtttttcaggagactgattcataggcagttagggactaagggcgtgccagaattcagaaagtagaaacctatcctaaatacagttccttgtttcgggatgtattttttacacagtaggtcactcttccttggggaatatctgtactgttgatccgttcatcattgttcagcagtggcaacaccaggagaacaaattatttacattggctgtgtcatatgggtgtgtctaattcggagaactttcaaacaaaataatgaagcttccccagcttctaacttgggaagtatgaaaagttacttaaaaaaaaatcttgactcttgtttaagtacatcagtgactgattaagtcacaacacattttaatattttcattcgaggtttcttgctaacattcttaccaccactaccactaaccccaccccatgtgtgtaagttacttttcctttcatttttcgtgggtcttgtgtgttaaggcaaagtcaagaactttgctcttctgataacttaacattgattgtgtgactgctttgtgcaaattgctatgggatgcctcatggaaattacaaaggtttcgtttgcttctgcccttcaagagagacttgcttagtgggagaagtagatgcatatgcaactgctccagggcaggcgatgacaaggatcataatatagtgcagacagagacaggattccctgtcttagagtgatataaacatcactcgaagactgagt

SEQ ID NO: 124348 - DNA, 1019 bp, Homo sapiens
tttcatattctgacatgattttaaatgtaatgaacgagcattttacaaaacaattttgtatactttccttgatggaaaatattatgacacaaaggtatatgttaattttgttgtcaccaaacctagtaaaacattagaaaaagcatgtagtatcagcttctggatctccttggtcacataggattaagaggcaaggcaccctcaagtcatgtgtgactgactcatctctttcctcacatttaattatattcactaggagctgtcagagagtctcctacctgtcctctcctttacctttcctgtgccaggaccagagatcaggcccttatcttccctcattggatttactacagagtcttccgacaaaccttcttccttctgacttttgcctttctggtctattctttacacagcactagagttttctactttaaaaaagaaaagttatattattttcccacctctccctcaaaaatctactatgttatttgttccttaagaggcatttgccagtggacctgcaggtctggccaagcccctgctaggactgtgtctaccttgtacgttgtgctggaatcaacttgccatttcctaaacatgcgttgtaatcacacggctctctgtctgcttgctaaagattgagtgtggaataccttttttgtagcagctgctctggaggttagccctgcccttcatttccagcctagaatgtgactgtttgccctggagcctttccaggttctcccatcagaagttcattctctgcttgaagcacgttcatactatattgattttttacctctattaggtaaaaaattatatgttttggtttctctcttttgtatctttctctttcttttccctttttcgtttcttttctttcttttaacatgcgtgtttttcttctttgctctgggtgcccaaaaactgtgagccaacttcaaagtgtggaaaccacagtcatactgattcttaccttcagcatgttttggttcattttccttgtcccagactttcta

SEQ ID NO: 124349 - DNA, 1046 bp, Homo sapiens
agacatccttggatagacaattgacaactatgtagaaatgtgactggacaaaatggatatgatctaatattaataaactgagtggggaaacccagcaagacctgtttgttcacattcttctcgcctctctgtgcagcatttctttcttcaggatatgaggcaggaccctctctggaatgagggtcgtatagcccaacattcagagtagagtcctgccttgggccatgaaaagagggcaggagaaggtcagaaagagagagtttttttctgaggcctaaagcaccccgacattatataacaaatgctgtgggagttatgagccagaaactgtggacgaaaaccagtatatatgtatatcataatatcacacaggacatttaatcgatttcattgatctatatctctctgcttatgtcaataccacagtctcatgactaatattgcctaaaattttgaaatcagagagtgagtcctccaactttgttcgttttcaagattgttttggcaattctggattcctggcaattccatatggattttaggatccacttttttacaatgaaatcagttgggattctgataaggattgcattgattttgtagcgcaatttgaagagtattgccatcttaacaatactgtcttctgatacatgagcgtgggattttttttttccatttatttaggtcttaatttttttctattatcctttgtagttttcagggtatgagttttgtacttctttcattaaatttattcctaatcatgttattatttttgatagtattgtaaatgaaattatcttaatttcatatttggattgttcattccaagtatatagaaatacaactgatttttgtatattgatcttgtactctgcaacctgctgaacttatttgttccaatagtattttaatgaattccttaggattttctacatagaaaatcatatcatctgtacatagagatagttttccttcttccttcctaatttagataactattattattgtcatcgagatcttgcttaattgccctgactagaacc

SEQ ID NO: 124350 - DNA, 1035 bp, Homo sapiens
tcctccagattccatctgctttgtttgtttgttttgggagaaaacataagtatgatcattagaaaagaatctataaccctttctgaaagagaagataatctttggtctctagaaacaatagctttgcattttaaaaggcatgaagtgaaatgtccttatactctgttggatttgggaagcagcatgaaatagtggttaagcttatgactccagagttagacggtgtgacttctctgtacttcagtattccccatctgttaagtggagattaaaatagtacctacctcataaaggaaaaattaaattagactcaggtagagagcttaaaacagtgactggcaagtaagtgctcattcagtgtgaactgataacggtggtagtagaaataggcacactatcggaagcttaagaccgatttgatgtaaagttaatgaaacgaaaatcagtaacagctaatataatttatttattagtatgtatcagggctcgtattttaaaccaccttatttttaccctcaggagtgaaccataaattatttagtttcttcagagaattctgattatcaactcacctgcaaagagggcagaggagggaaaaacaaaagctctgttgggctgtaagcatagtttctatacacttaaaaacactttgggaaattatagctgttcacttttaggtcactttggcagttgaaaccatagcaatgatttctagaaggctaaaggaaaatctggtactgggttttaaaagttgactacctagaaactttggtgaaatacgtaatcatctgggtcctagagagctgtgtgatgttgcttcttcctctcagtcattccaggcttttctcttccctagttcggccatcagaaaaaccagcctgacccatggaaaagtcacatggtggccaggaaggaagtgtgtgaggttcttccctataacatccggttttccatttctgacagttagcagacggattatgctcacactttcacttcttgtaaccagtcatttccacctctagctaatggctttct

SEQ ID NO: 124351 - DNA, 1038 bp, Homo sapiens
ataacaagaaggccagtttgtgtttaaggggtctgtgggtggtcagtctgagttaaagtttaggattcattttaaagcctaacagagatttggatgaatgtaattctaaagtaaagtaaagagctgcgttcaaatctgggaatatttatatagcccacattgctcaatcattttgatgtattaatgccacatttaccgttattcaacctcaaagttcacaaggcctaaatgttttaaatgtatgtatttttagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaaca

SEQ ID NO: 124352 - DNA, 1020 bp, Homo sapiens
gtttgtgctctaccggagattttcatggtaaatttctgaaaacttatttgtggaacgtgttcgtttttttccttccatttttaagtacacttaacagttcagttgagctgttcaaggatctcaagtttctttttttgttaggtgtcaaaggtaatggtgagctggtggatgctgtgggtttcccttagtgttttctgttttgctttggttttgtttatgtctagggacacagtgcatgatttagttgagccctgggggagaaaaggaagattagccaaaacagggacttaaagctcataagggagagtggaatagctaatattgttagataccgaactagagctacagatgctgctgctgcattgtggagggaacagatcatactgggtggaaaaatctctgcttggaagggaaacactgtcaaagtctgtacattgtttatgtggtatgtggaatttttttttttaatggagctttcttgatgaaggtgttagagttggagaaagtggttgtctgcattatgatacattgcagtcttggtgtttttgttttaatatttcagacccgtaattagcatgttgctaacgcacttgttttctgaccacttgatggtgaaccagtgtaggatgtagtgcagtgggatgagtacatgagcagcaagaaatacatcctgtaatctgtatgcattgggaggaatatgctcctgcactcctcccccaggtcaagccagctgctgcagaaactgacatcctccagcaaatcctgaatgaatgaatgaaaacaacgtgatcgccctaataatgaccacaactgaacacacatctttggctgtattttatagaaaaggccaccattttctaacagattaatgccatatgcaactcctttgcacattttctagaactgtatgaaatgagaagtaacagaacgaacagaaaacagttacataaattttttagtgatttcgcttcaacagtgcacaaattgagttttgggattttcttgtagggactaagaggc

SEQ ID NO: 124353 - DNA, 1020 bp, Homo sapiens
tcatgcatttcatctggagtgatgattataggagaaaatatggaagcttaaaaatgtttttatgattcttttaccaaaaaattatgaaaccactcaatttctaaataaattatatcattatctgcgtcttaagcattcttaatgtgaatatttgtagggctaaggctagagtaatagagaattgatattcagattgtttcacaaggctgaggaaaagctgaattctataaataggaatagtcaattttaatattattataatattaatttatacaacccaggaaaaaatgataatttcctttatttttgtagtatagttttaaataatttaaatggttaccataatagaaatacgtaaattgccaaataccttgctgtatatatagcagacatggagttttacaaattgaaactgttttgtttgtgctcatgcatcatcctctttttgcttgttttttttcttttgtatttttaaaacttcaaggtttgttatttacattcattcctgtacttctgccattagtaaaatgtcatcctccctcttgtttggttctgaagggtattgcagtggtgaatgacaggctgctgaatgaatcctcaggctccctgtgatgtgtttgtaatagacgtaaaatcataaagtattatgcaaatagttatttttttgtaatggtaatacataaagtctacctttgagataaatagagcaactcaaatgagaaaaagcaggatgttagtgttaaaattaatgatctttaagctaaaatcattagtaacaaccaaaagaaaatatagtaaagttgcttctttttgaaacctcacagaccagaacccatggatttaaacatagaacaaatacagttttactgtccaagatagtaagtaggaaatgcaaatctttgtgtgcgtgtgtgtgtgtgtgtgtgtgtgtgtgttttgtaaagatagatcattaggattaattataagttctaaaagatgtaaaaacagtcatatttagaatactctggatggagaata

SEQ ID NO: 124354 - DNA, 1048 bp, Homo sapiens
tttaactgtatgtaaagttctgtgtgtatatatcgaactggaaatcattttattaattacagtactttttacagaaggactgccgtgtacgtttctgtaaggacttaatgcaaattaggatttgtactttggggaaatgttgaaggataatggcgtccttgtgatttttgttttacttgtgataagtcagactacatgtgaataagaaaataagggagtaactgggctccacagcagtgagtggaatggaaataaatgacagtgttcaacaaatggctagtcggagagggttttccttagtctgaaattttaaaaaattctaaaagtctgttttattaaaatgttcacaggtagttaataatctgccaaagagtatagtctaatgacttagttcttcttaattttagtttggtcttttctccagaacttaacatttccagacaccactaagatagactttctggcagcccctgtcctagtctgtgtctggcactgctttttgtcttcagtatataatttattcttttattaagtgtctaagaagctaaatcactgacactctttttgtgctacatactgtttaattattttaacgagaggttgaaaatatctaacttctggtttctgccaaaagtaagtggaggaaagggaacacaagtactcatatattgatatagaaagcctagggaactgatggaaggcagatactacctgtatttccctctgctcttcatttggacccttgaaagtgaccataagttgactcatcatttggctattctggaagaatttttgtgcttattctgaaagacaaattataatggattagcagtaattctgaaaaatctaaggattttacttacgaacaaattgtggaaaagtatttcattgtagcatgaacaaacatggcagatacctttaagcagtgttgtttattccaagtgaatgttactaaggcacataccaagttcatgaatacctcagtgacttcccctatactatgctgtgtctctagttttaggtaggaaagaagaaaacatatatttgt

SEQ ID NO: 124355 - DNA, 2493 bp, Homo sapiens
actgtcagggggacagagcagtaagtaagcataattagactacaaatatggttagtgctgtagattatgattttgtgtatatttgtatatttctacaggctgattttaatttgttgttttcgtatatacttaaggacccagggaaatgtgtgtatgtatgtgtatgagagagggagggaaggaaggagggagagagagagggagaaagagaaagagagtaatagcatgcgcaccctaaagttcacattcctttttcagcaatcactggataatccctggctcctgacattttctccatacagagtagaggttcatgatcactttttcataatactttaggtaattttaatatactgagggatagtgacttaggatttgctcacttcgtataagataaaaccaatgatgggcacacatttacctgtgtaacaaacctgcacgtcctgcacatctatcctggaactttaagttaaaaaaaaaccagtgaacacccaactagacatattcctgaatgtcttccttgtgattcaggggaagtttactatttatagtgttatatttccttctcggaagcatttattcaatgctgaacaccttgactgaactgtttacctcagagttatttggtaaggtgtaagtttgttgtgtgtgggtttggagaaaaatcaatccgtttagatataaatcctttcttctgaatcatataatatagttttagaatggcaatcctgttatctgcagtttaattttcttaacaaatgtatcaattttctctgctggggttggctttataatttttgagtggaagattatgttggtatttaaattcaaacttgaaacaagcattgaaaagtataattactgcatttctattggctggaaatgagtatttttatagttggtacctgtgtatggcaagttaaaacagacatgatccttacacattctacaagtttacaaatctgaattttttaaagtatcattataactgtctttggatattttgctcatggtttttatcttcttcttgatcctgttactgtctgtataaaaagttttaaagtgtattcaatctctttttcacaaaatagaatatatcatactctcttagtacaggaattcgtattcaatttacatgctttgaaaaagtgacctagtgtggccaggcacagtggctcctgcctgtaatcccagcactctgggaggctgaggcaggcggatcatgaggtcaggagatgaagactatcctggctaacacggtgaaaccctgtctctactaaaaatacaaaaaattagccgggagcagggggaggggggggtggcaggcacctgtagtcccagctactcaggaggctgaggcaggagaatggcatgaacctgctaggcggcgcttgcagtgagccgagatcacaccactgcactccagcctgggcgacagagcgagactctgactcaaaaaagaaaaaaaagaaaaagtgacctagtgtatttttctgtgttactgagaataaaactaataaaattcaacaaattttactctatataattgcaagtttgagtcatgtgttttaaagattcatatgtaatatatgattagaagcatagttatgaaggtaagagtattgaatgatttaaatttacactcagagacttggtacagaaatggagttggtttcttcacttattggcatgatggttccagcctttatggttaagagatattcagacctagagtgtcattggattgagttcttacttcctactagcataatctttgactttttctcctcactcatttctcccatccttctggtcactatatcttgtcttaccttctcagaattatctactgaacatggtggggtttttttgcattctttccatgtcctaattattacttcttgcttggacttttggaattgtcacctcttaagtcttttcccatgccagttgtcttgcatctttaatgtaatcattatactgctataagtacagtctttctttaaaaacaaaacaaaaaaaccccacaaaaactgattttaatgaaagatttctgttggttccttggtgaattaggggtaaaagactcatctcactatcctccactgtgtaccttgtgttcctgccaaactgaactcactttctttgggtatatttttcctgtcaggaatacttgtgcctctaatatacatgatttttgcctgaaaaccctagccgttctttgcaaacagctttccaatatcatgcttctctgcaaaatattcctgacgtttccaggtaaagagaagtgtggctttctttgaatattcaaagcactgtatttacacctttacatcgtactgtcactatttaagacacttgtcatctcatctgaaatgtcagtttcttgagggcaggaattctggactgttcaggatctcattgcccaccaaatgtatttctctacttgaatgtttctatttcactctaacaaattgcctgacattttactac

SEQ ID NO: 124356 - DNA, 1037 bp, Homo sapiens
atgattgacagagtctcgctctgttgcccagactggagtgtaatggcataatcatagttcactgtaaccccagactcctgggctcaagcgatccttccacttgagcctcccgagtagctaggactacaggtgcatgccgccatgtctggctaatttattttttattttttattttttttagaaatggggttccactgtgttgttcaggctgttctggcctcaagttatccttccgctttggcctttaaaagagctggggttgcaggagtgagccaccattttattttttaaaatgcgtatctctgaaaagatatccttgaaactcactatctttgtatgaattagttcaattagattattttcctcatgatattaaattgagaacaacagtaccaagataatgggagtcttcttggagatgagatgggagtgacggacataatgctttttggggagagtaagtagtagtctttcagtaagatgatgtttggaatatgagaatatagtctttcatctccatatggccccaaatcccaaaacctagaactaaggcagcactggagtctctgttgataagagtttacagtttacaataaggtttttgtggttaagtctatgttaaaaggatccagaaagttcaactagtgttacgtgttttaatgctgatgagcagagttttttgttttgttttgttttgttttgttttttactatcaggtgtattgttattagtagatacttagtatcatcagtgtgaaattacataccaccttgctttgacaaatcttaagaactttcgaataagttatgggagtcctgaccatcctttaaggaaaacagtgcactcctctaaaagcctattcaaagaggtcacattgaggaattatatatgttttctagtctttttgaagtacttttttttaatgtcttcggagaatttcatttagaatactcttggagtgaatctgtcttttaggggtagatacgacttttgaaaataaccaaatgtcattaagaacctaatgtggagagtaaggt

SEQ ID NO: 124357 - DNA, 1050 bp, Homo sapiens
ttattttgcattgagcaaatcagtggtatccagacatatttcagtacagatttctatttatcatttgctttgcagcagtagattagcttggctggaaatcataccttactcaggttaaatagttactctttttcctaggcctttccccttcatctcttctacatttaaccatggatttaactcttcaccctattgctagacagttacgagctaatttgtagttattacataagcaaagtgtttaagtgtgtgaatcttttgtttataaattgtatgttaaaatatatttggattaggaattctacttttcagtttagatatcatgagaagggctattcacttgtctaggagactgttgtgttttctgtattatatttagctgttctttattcaaataggaaataagaatgcagataattttccaaggaaggatgttacttttcagaattagaggaattataggcatacacctatctaaatacattttacatggcataatttgattgtccttttgtagagattccataatattaatagccataatcagctttttcttggccttgaaaataattttagggatgctttgttctttactgacatgtccagtagttggtaaggtagtgtggaaggagcctggttattctctttgttctgtaagaggcccttctagatttaccccattgcaaggagaagatcttcctcaaggcttctatcttttctacatggctcttcttcaaccccctcagtccattatcccatcatttctcatggtaaatatctttctccataaaaggaactactatttcttaatgctttcctggttcttgctatagacttccataggatgcacttggaactttgtgagtgtcaggcttggagggagagaataggcaaaaacctattgatggttttagtgtgaatcctccaatttcagttactttctcctctagattgagcaggagctgatttctttactaggttacttagggagaaaacttacctctctaaggctagccaattcaatgacgttggaggaatattagaatttat

SEQ ID NO: 124358 - DNA, 1019 bp, Homo sapiens
tgaaattggcttcttctttatcatctgtctcatcagttctgtccttgtaatgttttatgctgctctactcttttgatttccattcttcatttagtgaggaagaggataagtttaatatggcaggcagtggaatttccaaatagaaataactagcaaaacttagaggtgtgggcctggacagttagagatctggacacagataattaattcagaaccatccttctagaggagttagattcacaaatatgataaaatgtaggtatagaaaataaaatttaaaaataattttaaaaagaaaaaaatttaaaaaaatgtacttatagagtatgaaagaagaaggtcaagtgatggaggacttagtttttggaagggtgcacacacacaagaaaaaaactaatatattcatctgaaagcagcaagaggaggagggagttaatatttattaactgtgtaccgtgtactgtttgttttataacctgtttcatttaattctcaaaagaccattgcaacattacacagatggaaaagcagtcactcagggaacttaaatgatttatttaggagcatagagctagaaagtgttggagccagatttctaacacaggctaatctgttaaccaatataagctccatttttattattactgaactgggattataggataatacaaacatacatatgtatgtatgtacctagtgctgtgacactgcactaaaaaatggtagctattctttttagattaccaaaccaacatatgaaatgaatgctatgtgctgacactatcgagagggaaacattatctagttttttttttgtttgtttgttttgttttttttgagacaggagtttctgtcttgttgcccaggctggagtgcaatggtgtgatctcagctcactgcaccctccgcctcccaggttcaagtgattctcctgcctcagcttcctgagtagctgggattacaggtgcctgccaccatgcccagccaagtttttgtatttagtagagatggggtttcac

SEQ ID NO: 124359 - DNA, 1096 bp, Homo sapiens
gttggaatgagattgacacttgtctgcttatttaaaacaactttcatatttcattggtttatagttaggatctttgttagttttgtagactagcagtccatacccccttttttgagcactctatgtaattgtaaagatagggatattaatgtgctggtcccttaaaatgtgtagttgttctcaggcagaagtattggtttgcacattgtctcagttaaagtcaatgtcacataatttgtcttttctctttctcactgccaacccacacagcccttcttcaggcatgagcagggctgccccactgtctgcctctgcttctatgttgtcaacccacagggtagcgtcggcttaaatattaacgtggtcggtagaataaaaatattctctcagtgcacagagaacttgtggtgactgaagaaaagaacactcattaatttgttgacttcaaaatgtgtgccctttggaaaactgctggaaggcccaaatcctgaattaaaatgctgattacaatatgcacgacattaaacagtcaagaaataaaaagagcttaatccagggatggctgactttataggacttggggacgataagctctagcaccctgctgcttgggggccggttcactccctgtggtaattctgttagacaagtaatggctaagccgtggtacaatgttatcaaaaagcagaccgctcgtgacaacagcaacgattctcaaagagccattgcccagaaaatcacccccattcagtgtcgtaatgacattggctttctcctactaaatagctaatataatggaaaaccaatatttgaccacagtttataaaactattttaagtaaaaaagttagtgacattttgagacacgtgaaagtggctctcaaactgccttatgaccacatgtggcaatctgacctcaattcgttaattataacatggagaaatctttgtgtttcccaaaattgggccaagaaaaatgaatagcagatacctgaacaaaaaagtggtgttacaaagcagaagacagttcaatgaattcaactcacctaagtctcataagttggccttacccaaaagatccctctccaggacaagac

SEQ ID NO: 124360 - DNA, 1036 bp, Homo sapiens
cttagaagggcacacttgtgaggagctgactggaacaagacagggcaaatgtccccagcattccctggctctctgcctgtgacctgagccccagctttgcactttctctggtttctggaccctatctggtcctttgtcaacactagatgctcttctagataggaaatcccctggcttttctctcactgagggagcttacctatgaaattgccctgggatacatgcatactaaggcatcatcatatgaaagtgttggattttggcactgtgttttctaccatgcagaatgtctgttttcttctctgtgaaacagagaacagcttcaagtacaggaaatgactgctccatctccatttcatgcccctttacaaagaaggtgcctcttgtcattttaaatactgagatgaacttttcaacatatgtggtgcatggttccctttctcatacattgagaaggaggttgaaatgtggatctgtatcattttctatggagatataatagcttgcaggaatgcagttaatctttgaactggccgacctaggaaaacaaaatggatggcctcgtttctattctctactccttttccacacacaaaaaaaatttagatgacagtcttatcgtaaaacaggcttatacttttattgtatttctaaatcgactttcagatatattttttgtcccacaggaaaagttgctgccaatattagcctttttaaattttaaagagtatatgtactagataaattttttgatgcagaatgaagacaagttctcactgaaggacagactgtagaatgtgatctgaatctagtaaaactggctattttatggtgaaccagtttaacccattcctggtgatggtaatagtgctagctatcattttagtgagcacctactatgaaccagatacaatgctaggtgttttatttatgttaattccatctcatgacaaccttcagtgacgtcaaggctgggattttccttgtcatgtaaaagatggaaggaaggttccggaaggttaaggggctgcccact

SEQ ID NO: 124361 - DNA, 1056 bp, Homo sapiens
aagaaactagcacatgggagactatgaggagaccatcctaactgaaagaaagctcatgtttgggggatggtagggagcaagatgggaaagttaggctaggatcccattttagaagatcttcaaaattggtcagagaggttgatattagaagtggaaagaaataaggaagttcttacaataaagaaatacgctggtccttctcaagaaataagattcttgaaaagaaggataacatgatgacgtgggtgttttaggaaaattactctgtgcagagagagaaacagagctggcagtttggaagtgtgacaccagtatccatctggtgtccatggcagacaccaaaatcaatcacaggtctgctctgccgagacacagcctgagaaccatcttcactggccctccagtcagccagtactaatcaatcagaattggccatgaaacctgattgcctcctatgtgtgtcagacaagtgaacgataggcaggagaaggacaggagaaacaaggtgaaggccccaggctcatgacttggattttagtagttctgagaatataagaaggataagtatcctgagatgtttattttgtatttataggtttgtattttaattagggccagaaatagagatctttttgtataaatcattattcagttctagaaatgttttgctttttctttcaggatcattgtcactggtatacagtttctaggcacttgctgtttaaaaaaaaaaacttaaatatttagttaaccttgaaaatagtaactccaacaaatgatgtgccaaaagaagactctcacccattttaatctacaaagatttggatgcacctgctctgtccactcgtgggagttaggttgtcagaatatgttaagccactatttttggttttttaagaaaaggttttgttttctgttattttttaaaactgggttttagattgcaaaatagcaaacaaaatttaaaacaaaatgaaatcgtctcatctctggtggaggtgggaggaacttctactttgtcagtgtgtgggctgcgaacagaacagaatgtttatc

SEQ ID NO: 124362 - DNA, 1125 bp, Homo sapiens
catttttttttctcatcaacattataacaaaatgacattattcaaggacctacttactgtgtactgcaaaccattgaacagttaggtgaattctatggtatttgaattatagctcagttaagcttgtgtgtgtgtgtgtgtgtgtgtgtgtgtgtgtgtgtgtgtgttccccttggctcaaaattctaatatttaataaacaagtccatgtgctcagtatcaattttgcttgtggttttataaaccttttcaaattactcccctgagcctttgaatttcctagctaaggagctctagtttttttagtgtaaccttatgtacatccatttatcaatcaacaagtacatatttagcacctgtcttgagctgcaacagccaaattgttttaggaataatagtaatagtaggaagagaggagcaattactacaggaattattaataataattttaaatagttggaactgcagccattccgttgggagaagcacaatagtgacttaactgtgattgtggtgacagggagccaacaattgagtccctgctaatgggccaacaggggaaggggttgaaaaggaggagtgagtggtttacattacaaaaggattgtctgagagctgctcaagtgtggttatgaggggaggtcaggctggagacagaaaggatgataaccgtggagctgtcaagggcatgtcaggggtttaggcaagcgctgtggcagctagacagggccggctgagagcagacatgccctggccctgcctagcgttgattgataaaaaggaaacacaatgagaagataattgagcaaaccaggaggcctggaccagtgttacaaaatttaaaagtgagtcttgggagccatcagaaccttggctgaaaatattcctggcttcactttgaccagagttggaccattttgtggaggaataaaactaccgaaaggcgagtgtgtgtgtgtgtgtgtgtgtgtgcgtgtgtgtgtgtgtgtgtgtgtgtacatgaataaaatgctgtaattggcagatggattgaaaagagtacatccttgacatctattgaactccttcctcctggctgcacatatactaaacacacacacacacacacacacgcacacgcacaca

SEQ ID NO: 124363 - DNA, 1002 bp, Homo sapiens
gtaataatatatctgttagggtataatgatgttatggtaatattaagaataaatgttcagaaaccaaccaaataaactgtacttttgttcttttgttacctctctagaatggttttcatctaggctttcaatgatgacatatcacattagaatctcaagctgatagataattatcaggttggttcaaaagtaattacgggtttttccattacttttagtgtcaaaaaccacaattacttttgcaccaacctaatatttttctttatgtggactcaaatatgatataatggaatcctgttacgatacaactcactattagatcgatataagtatgttgcatattgttttgtatgccacaaaacatgatggtgaaagccattaatacttaatgtatcacagtaaaatacaaggatattgtgtgacttcccaaccctcttgcaccagtatttttaatacatgtcctgtgtttataagatttgtattttatcaagtcatcttttaatatataaaattttattctgaatggcactctgtgttgataatggccattttgaaatttaagtaaatatttccacgattaatttattctgttgatttacctaagcaaatagcccctgaaatgccttttgggactctgactggaaagaaaacattgtctttagagagggttgccaagctctgttaatgaaaagcaagccatttgttttctttgcttcagggtgtattctgagtgtgttggtaattgtgccattgcagctgtatttcctgactgttagttttatgcttgatgaaggatgataattaatgtgttaaacactcggtgcatcctgtttggagggacaagttttttgctacagaattacagagatataactcatgccccaagaagcacaaagttttacttctactgaacctttctgtaagaaatagagttataattcttttacaaagttattttattataaagatgaattgagtcttcacttcatacttgaaaaatat

SEQ ID NO: 124364 - DNA, 1121 bp, Homo sapiens
agagaactgtgcccccagcagagtctttttctttctttctttctttctttttttttttttttttttttttttactgcatcaggattcaatacaatgagaatctactgcaatccaaaagcgcgaattgaaccttgaaccttgagatacatgttcctgggagatgaattgtggtgaacttgagtctaatgattggtcctgctcctttaaaatacttgtttgacattgctaaaggggagattgtacaagtcccataaactcagttacttttaattattatattcaaatatcctcacttgagaaggtgtcctcctttcctctcttacttctgaaatgtatcattttattctgagagtattatccaacataaaattgaatttttctgtaagactacagcaatattttctaattgaaaaagcagtattaaactcaatgatttttcatctcagtagggatacgtgcacagtgtctgattctcagtattggatctgcacatggagtgtttttctctctagtggttacagaggatgaatgcatattgagataaagaagtgattttggttccaaaaggattttaaggatgatgagagaacagtgggtacttcattgccaggtcatgtctttgcaagaagaaaacgaggcatgaactagctaaagttcaccttgaacttgccttgctctttatcgttcaagcaatttgtatgtgtttcatcaccttgcttgacaagacgttaaaacattcaaatgcatttcttttgctttaaaccatttttttgattctgagatgtgtataatgtcagtgcatacatacaagtaccaaaaaatgctttaagaccctggcccttaaaatgaaggttccaagaggaacccaagaaagtccactcaccttgtgctgcacctgacctggctccagacaggacacctggccaaagaatttgttcttcattatcctctcccagctggccgcccgcccattgattggcactagctggcatgttgcatggtgaatgcgttcacagtgagcactgttttgctctgtcaactataagcacttcaggggaaggagcttttatttcttatgtatcctcttttgtctagccaaatgttttgtacacagtgtgccc

SEQ ID NO: 124365 - DNA, 1040 bp, Homo sapiens
ctgggtgacagagcgagactccatctctaaataaataaatgaccatttcctacaacttggagaataagagaagatagatggggtaacagaaataaaactaagaaataaagggtacatttatttgagtgaagaaaattttaaaagggccttcaaaaccacaggagctcctcaagatatttatgtaatagaatataacttatctagggttgagaggaataataatcaagacgtttgtcacttaagtgcatctggaggcatatgaaattagactcttgatagtggcctatgcttggctatgtccttggtgttttaacctcaggcttcaggctggaaatgtgttttctagagcagacatggagcacaaaatattaaatgaactttgctgtattcaaaacgcccaacagtgtagcatcctccctgtttggcagggaaagggctcagcatttggaaactcagcagtgcattaagtattttaataatcattgttgacatacaaagcatatggcctttcagaatcattgggtcaagtgttgaagttgtcttctaggtttctaaaattaccttacaaaattcaaacaaaatgaaattagggtacatttcaaactacgctaattcatgagctttgtgttatagcaagtgaaataagttttctcctaagatataagagaatctatgagtaactgattatgttaacgtaaaggaaaaagcaaaattgacacccctgcagaaaaagttaattcgcatttcgttagaaaatctagaggttccatataagtaggccagccttacgaataccttatatttactttgtacctcctagtcatgcctaagacccacctcaaatatcccatcatttcagaagccttcattgtctgtttccttacagtttatatcagttgtctataaccacaataatgctgtgaaataagcaaccataacactcaatggcttaaaacaataagcatttctcattgcacacaaggctatggtaagcaggaccattctcgtctttgtgggctcacttgtgtctgtggtcagct

SEQ ID NO: 124366 - DNA, 1067 bp, Homo sapiens
ctgaagtggctttattcatatcagacaaaaacatacttcagcacaaggactattaccagaaataaggatatttattgaagataatagggtcaatttataaaaaggatataacaatcccaatgttgtctacaactgataatagaatataaaaatagaataagaacttaaaggaaaaatagacaagtctacaataatagttgaagatttcaacactcatctttcagtaattaatggaagaaatagacagaaatcaataaggatatagaagactgtcagctaccttgacttcattgacatttacagaatgttccattcaacatcacagtatatgttcttttcaagtgcacatgaaacattcaccaagatagactgtgtttaggtttataaaacaggtctgaataaatttttaaaaatcaaaattatgcaaagtaatctagttatgacagaattaaactagaaatcagtaacaaatatatatctgtaatatcccctgaataattggaaattcaacaatatttatccaaataacttgtggattaaagaagatgtcacgagggaaatcaggatatattttgaaataattgaaatcagaacacaacatatcaaaatgtgtgggatacagctaaagcaatgtttagagggaaattaaaaccattaattattagaaaataaggaagttctcaaatcaataatataaatttttatcttaagaaactaggaaaaaagaacaaattaaacctaagtacacagaagacagtaattaagagcaggggcaaatgaaaccataaacagaaaacaatagagaaatcaaaagctggccttttgaaaagatcaataacattgataacctatagtcagattggtcagaaacaaaagaaagaagacataaatcattaatacttagaattaaggaggacattactatagacagtacaggcactaaaagaataataaatattatgaacaactttaagccaacaaatttgataactcagtgaaatggacaaatccctttaaagacaagctaccaaaattcactcaaatagaaataaataacatggtagccc

SEQ ID NO: 124367 - DNA, 1020 bp, Homo sapiens
gagccagctgcccacctgcccctcggactgcaggctcggagctgggggttcagtgaggcctcagagctaccgctggttttatagttgagctcagctatggggtaaataggcttttgtggcctggcctgggaaccgaaccaccatttaaaaaaaagaagaagaaaaaacctgcctccatgggaaaatgtattctgcattcccaatagccagccaacaaatgttagaatgactgtgggggctgtcttctgtcttcatgcccctagcagagcgaggaggcgaaagaatccgcctgtgtgttctgggttctgggtccagctctagcactaaacccaacataggaccttagtaagccctttaacctctgtgtatcacatcatctgtaagacaataggattgtactaaatgagttataagcctccttctagtataatgaccccaattgatcaaagctctaccctcattttattcattcagaggcattttactcagggcacatgctttgtgcaggctctgggcttggtgggaatacagtcaaataatacagatcccagcactcacagggtgcagtgtttacttggggagacagatctttaagtgaatgttcataagtgctatgattgcaatgggcactgggttctgtaaaagctcaggagggtctgaatcagatgaagtctttgcagaggggttggctcgcgggctcactcccctgatttctattttaattgactcctctcccagggtatcaaatctggttcactgggaagcatagcttctgcatctaccatcctaacagtttggcatggtcccctggcctcatcaaggaaagtcttgccctcctctttgcgtcactgaaagatagaatacagggatgctcccaccaaaccatagtcttgattcctgtaagtactgccctgaatgcttgcttcttctctgccctagggagccatggccaaaaaaggttctctcttgctctccttggggccttccctgccctgaagagaggcaggattggcagcaact

SEQ ID NO: 124368 - DNA, 1063 bp, Homo sapiens
acctttgtgttcagggatttttttttcccctctgtggtctacttttagttggatggagtctttgaaaaaaaaattgtcttttgagcataattttgcgtttataaatggataggctaggaaattatatagtggtctgttaatttgtacctttcctactggatgtactttcacagcttttatattatttctgcttttagttcgacttcgtggtgagaaatatttaagtttaaataaatacatattcatgatgtgtttatgtcctgaaaagttttcagttacgtttgtgcaaaataagtaaatatatttacacacatccccaaaatgacagacatttaagcacatttctctcacatccttttctgtttcccaagctagaggctgatcctcagctgctaccattattcagtctccacatgcaggaggcctcttgtttctaataattctacttccaaagtgtctcttgaattggttccctcctctcatccccagtgctcttatctgagctaggatcttcctcaatttaaaggactataattggcacccctttccacactaatgctagtccaattctgtaacataaagtgatcatgtctttctcctggctaataactttctgtggcccttccttggacaattgacaagtccaaagttagtgtggccttctaggccctccacaggctggctctgacctacctcccccaaccccagcttccctctagaataatttccctcccgcctctcttccctgctgctgccacacacatacatgcacaccctgtgtttccagcctcattaaaatctgtgccattcaccccattcttaacacactctgacctttgcaggctctgtttctcccaccagaaattcccttctccctcttttgtgcctgtaaaactttgaggcatcatttaaagccacgtgaccctcagggagcctttgccgacttcccaaagcaaggctgttacccttttgcactgttcctgttgcactttatacatgcttcttagcctgccacttggtagatattcaataaatgtttatcaaatgagcaaataggtaaata

SEQ ID NO: 124369 - DNA, 1048 bp, Homo sapiens
ataataggaaaaggtggatggatttaaaggggcagggctgagctgtgtgcagttggaagttcctcctgacagcgtgattcaccccaagaccacgaggtattttatgagcaaagttacaacgtgtgatatatgtgctctttgaaggcagagtaaaagggtatgatttaaaagtagaagtcagcttcttgtagcagattacatcagctgaagttgtgagcttgctgcagagctttcgcagcctgaatgcccttgagagagtcctcctgtggtcaattaagtgtcttgtttttcttgaaagtcagaaatgggatggagggtaattattctaaatgggataaaagctgtgttaggtgtaagaaaatagtcctgaatcctctaaagagatagtatagaaatgtatacgtgggcatttataggagtctgagtcctcatagacaaggacaagcggaccagtgttttaatgagggccatttattaaacggctaatgaaatcctacagcatttgtctagtgtttcatcaccataattcaaaaggatagctaaaaggtattataggaaatgagtgatactcactggtatttgcaggtgcgtatctatttaaaatagtgttaggttttggagactgttcatgcactaatcatattatcaaaggatatgtggtgagaaggtttattaacaaatgttggtggcttactcggtgggaccttattagggccatcagtcagtggtgctccggtgtcctgattgtgaaggtttgggtctatggcacttggtcaaggactggtaaacagcagtattgatatgggggatgggtttcctgtgaacaaagacttgggttaattaatttgacagtatcattaattactgctgaaatcattggtttttgtcagaggtcaggctcttttagcaattgagggcaggtcccatgagagttggagacactaagtaatgcaagagtgtcactgctcaaccatctcaggctgtaggacgaaggcctttcctttctgcctgggccattcagctctctggattaaaccagtttctgctt

SEQ ID NO: 124370 - DNA, 1097 bp, Homo sapiens
ttggagagtgatctaaaatggcctagtcggagagatgctaatcacatacgctccattcctcctcaaagggccaaatgtagaaatgggcagtggtcatgccttggccatcctccatgaacacgggattggccccagcttcaaatgagcactcagcccaggctcaagaccacccccaacaacgcggatggaggtgcttgccagtggtccagttagtagcagtaaactaagggatgggtacatggataatcttctctggctgactaatcagttggaactacatgcatttcgattattattcagcaaatattgatggagcatcttctacattccaggtactgttctagactcacgagtctaagattggcagaatgtcaaggatttaaattgctcactggcttagttttgagagtgtggctttgtcctcttgtctaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtaggaggttttatgagggttagcagaaggggtacctgctggaaggtaatgaggtgtgatttgaatccctctggtgaagaagacataactcaaaagcaccaaggatgcaattaatcatcgctggtgtctttttatgtgacagaataccaattaatgtgatacataattctctaaaggataagatagaagagacagctggaaattgctgggatttcataactgcttttaattgaagtcagattttcttataatgtgcactttttgtaagattgtcacatttaaatgccttttcatgcataactaaaaatcaagattagatcaaatgaatctgggaggttagaacagactactggggaaatcttttaaaatcgctaatgcatattaaaattaatagaataataatgctcctttgttttgcgatatgttcagaagcagtggggtttagttgcagggttaactcatgcag

SEQ ID NO: 124371 - DNA, 1263 bp, Homo sapiens
aaaagtcatagtaaaggaaatagtcaacagagtgaaaagctaacctacagaatatgagaaaatatttgcaaaccatatattggataagggatcaatatctggaatatatagagaactcctgcaataactcctgcaaattaagttgggtcaataacaaaatgacccaatttaaaaatgggcaaaagacctgcatagacatttctccaaagaaaatatacaaatggcaaaaaaatatgaaaagatgcacaacatcactaatcagagaactgtaaaccaaaaccatgagatatcacctcacaatgcttcggatggctattatttttaaaaatggaaacaaacattaacaaggatgtggagaaagtgggacccttgcataccatcagtgggcttgaaatggtgcagctgctgtggaaaacaataggcagtttcctcaaaaaattaagtagagaactgtataatccagcagtccaaattctgtgtatttgtgcaaaagaattgaatacaggatctcagagagatacattaagacctcatttaatgtcattgatagttcttggaaactgcaactttaggcaaaacgacataagccatttttttcttatcaatattattatgaaacagtgttattctggacctgtgtatatcactttgcctatagttgcagcttccaagaacctgtcaatgaatttgacactgtatactgtgtttattgcagcattattcccaatagccaagatgtgaaagcaacctaaatatccattgacacatgaatggttaaagaaaatggtgtgtgtgtgtgtgtgtgtgtgtgtgtgtgtgtctgtcttcaacattgcatatacaatgcaatatcattcagccttaaaaaggaagtcctgtcatatactacaacacagatgaaccttaaatgcattatgctaagtgaaataagccaatcacaagaacacaaatactgagtgtttgcatttttatgaggtatctaaagtagtcaaattcatagaatcagaaactagaatagtggttgctgggggctgtgggaggggaaaatggggagttgttcaatgggtgtagaatttccatcatgcaagatgaaaaagttctagagatctgttgtacaacaaagtgtatattgttagcactactatactgtacacttttaaattaaaagaataaacttttttaccataataaaaatattaatcaaaaagtaccaactatcctaatagttcatggtgacattgaactcaagagaagaatatgata

SEQ ID NO: 124372 - DNA, 1051 bp, Homo sapiens
atccatttaaagttgtgtagtcactcaatcacccaggctggagtgcagtgaggggatcagagctcactgtagccttgtgtgcagttgtgtggaatgctcaggtaatcgtgtccacgtcaaaaatccaaaaggacaagctgtatgatatctcagaggtaggaaaaacacccattaaaaactcatcaaaatcgtgttactttaattaatacctagcttttgaaaagatggaaggctaattgaacttcccatcctccatgggaatgcccatttctcaaccacttgagaacaggatttgatgaatcaggattttaaaaataataattaatatggttaattatgcctggaggaattgttccagtttttttcactgcttctactgaaactattttaatatttatactcaaatacacttctctccataagaaattgtaaaaatcattattgacataagaggaagtgacagagacaaacatctaggaaaaatgatgaaaacatactttgcccaaaagaaatgcacagacatccaattatttttttaccttagtggctaaaacctctgacaaatcagtatttcccctgttcatcaggcaagtggaggaccccatgtgggagccctggctctgaagactattggctttgtgctctcaggccgtgttcctccctggatcacaagtcccatttcagaaggaaggggctttattcagttcttcctcatctctttctaggctctaaattatatgacttctgttttttctgaagttacacaccagagaaataaacccaaatacctgcatcacttcagatcatttgaaaagaaatagtcagtctaataaactgagtaggagacacacatttccacttctctgaagaaaagttcactacaattgagttctgtaaaattattgcatgatgtgtaagttttagtgtatggaagaacaaaatattgaagactggtcatatttccagatgaaactgatctctgaaataacaggaaaatggaatgaggaagaagttacgtaaattagtaccatgcaattggaagctaaatctg

SEQ ID NO: 124373 - DNA, 1155 bp, Homo sapiens
gtatcgtggaaggactcatgaccacagtccttgccgtcactgccatccagaagactgtagatggcccctctgggaaactgtggtatgatggctgtgggctaatcagaacatcatccctgcatctactggagctaccaaaggtgtaggcaaggtcatccctgagctgaatgggaagctcactggcatggccttccatgttcccactgccaacgtgtcggtcgtggacctgacttgccatctggagaaacctgccaaatatgatgacatcaagtaggtgatgaagcaggcatcagagggctccctcaagggcatcctgggctacactgagcaccaagtcatctcccccgactttaacagcgacactcactcttccaccttcgattctagggctggcattgccctcaacgaccactttgtcaagctcatttcctgatatgacaatgaatttggctacagcaacagggtggtgaacctcatgacccacatggcctccaagaagtaagaccccccagaccaccaaccccaacgagagtgcaagaggaagagagaggccttcagctgccggggagctccctgctgcactcagtcccccaccacaatgagaatctcccttcctcacaatttccatgcagaccccctgaagagggaggggcctaaggagccccaccttgtcggttaccatcaataaagtcccctgagctcacctaaaaaaaaaaaaaaaacaaaagaaaataaaattatagccaatttcatttaaaataaagaaacaaaaattaaaaataacacactgtcataaattaatgtaagactatactaaaatcacatttcattatacattggggttacttttaaagtgtgaagcttgtttaatgattaaatatcttaaattagtttattatgtgaaaatattttgttgataacaataaggataattatctaataatataaaaattctaaaattttcaacaatttctaagtataattttttagaaactagaaagaatgaatagcttcttaaaatgctgttttaaattgtctattagaattcagtggacaacatttgtcataataataacctagaaggattcatgttaattttagaaacacaaattgctaatggtgagaatacattctgagcaatgcatcattaggcaa

SEQ ID NO: 124374 - DNA, 2729 bp, Homo sapiens
gtaaatagtatgcaagactacagaacttctttttgaaagtgttacctgtaatgaattttaagttaaaagactctgcatgaacgtgacactgactgcataatttgtttacaagaaattatgtccaacaaggtgatctaagaaattcaaccacttgataaagtttgcttcctcatttgaagaattcatctttatatcttgctgcagtatctggcaactttccactctcctcccttcatgatagtaattatgaaaagttattttcatcccaagtagtctacatggtaaaaggaaatttttgttagtagcatagacttggtgcttttttaaaagaacaaaagttttaaatgaaagacaatttaagactactcaagtcattataaaagtcaattatcaaagttaaaacattatcacatatatattaagaaatcctagctcattgaactcgcctgcagctctcgggttcctgtggctttcttctttatcggagccagggctacatgccagcaaccatgtccaagggacctgcagttggtattgatcttagcaccacctactcttacgtgggtgttttccagcacggaaaagtagagataattgccaatgatcagggaaactgaaccactccaagctatgtcgcctttatggacactaaacagttgattggtgatgccgcaaagcatcaagttgcaatgaaccccaccaacacagtttttgatgccaaacgtctgattggacgcagatttgatgatgctgttgtccagtctgatatgaagcattggcccttcatggtagtgaatgatgctgacaggccccaggtccaagtagaatacaagggagagaccaaaagcttctatccagaggaggtatcctctattgttctgacaaagatgaaggaaattgcagaagcctaccttgggaagactgttaccagtgctgtggtcacagtgccagcttactttaatgactctcagtttcaggttaccaaagatgctggaactattgctggtctcaatgtacttagaattattaatgagccaactgttgctgctattgtttacaaaagttcagacaaaaaggttggagcacaaagaaacgtgcttatctttgacctggggggtggcactttcggtgtgtcaatcctcactattgaggatggaatctttgaggtcaagtctacagccagagacaaccacttgggtggagaagattttgacaaccgaatggtcaaccattttattgctgagctcaagcgcaagcataagaaggacatcagtgagagcaagagagctgtaagatgcctccgtactgcttgtgaacatgctaagcgtactctctcttccagcacccaagtcagtattgagatcgattctctctatgtaggaattgacttctatacctccattacctgtgcccagtttgaagaattgaatgctgacctgttctgtggcaccctggacccagtagagaaagcccttcgagatgccaaaccagacaagtcacaaattcatgatattgtcctggttggtggttctattagtatccccaagattcagaagcttctccaagacttcttcaatggaaaagaactgaataagagcatcagccatgatgaagctgttgcttatggctgtccaggcagccatcctgtctggagacaagtctgaaaatgttcaagatttgctgctcttggacgtcactcctctttcccttggtattgaaactgctagtggagtcatgaccatcctcatcaactgtaataccaccattcctaccaagcagacacagaccttcattacctattctgacaaccagcctggtgtgcttattcaggtttatgaaggtgagcgtgccatgtccaaggataacaacctgcttggcaagtttgaattcacgggcatacctcctgaaccccaaggtgttcctcagattgaagtcacttttgacattgatgccaatggtatcctcagtgtctctgctgtggacaaaagtacaggaaaagagaataaaattactatcactaataataagggccatttgagcaaggaagacattgaacgtatggtccaggaagctgagaattaaaaagctgaagatgagaagcagagggacaaggcgtcatccaagaattcacttgagtcctatgcattcaacatgaaagcaactgtcgaagatgagaaacttcaagacaagattaatgatgaggacaaacagaagattctggacaggtgtaatgaaattatcaactggcacaataagaatcggactgccaagaaggaagaatttgaacatcagcagaaagagctggaggaactttgcaacccaatcatcaccaagctgtaccagagtgcagaaggcatgccaggaagaatgcctgggggattccctgttggtggagctcctccttctggtggtgcttccttagggcccaccatcgaagaggttgattaagccaacccaagtatagatgtagcattgttccacacatttaaaacatttgaaggacctaaatttgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaagaaaccttaaaaatgatttcattcgattatca

SEQ ID NO: 124375 - DNA, 1758 bp, Homo sapiens
tccagcctgggctacagagtgagactctgtctcaaataaaaacaagggagatagattataatttcatgtctattttagataactgataacatgtattggtggattatgggaaacaggtaaatccatagtgatttctagctgtaagtacttggatgcattgtgactgtgtttagggatatggaaaatctttgggacagaggaggtttgaagtaacagggcagaaaatcaggggcttagttttgagccaaaatttgtccaattgtaatcttcattttatcattttagtttgaaagttgaatcgtttttgataactttggtataatcaaagttattgataatcgaatgaaatcatttttaaggtttctttttttatggtgccaattttaaatagttttatttaagacattgcattttccacttacaatacagtgtttataaagtgcaatgttatttccttcccctgtgcatatgttccatattcaagtattgagaatgcccagtaacttactatagcagcttaactttttaaaactgccacagaatttgctacaaatttaggtccttcaaatgttttaaatgtgtggaacaatgctacatctatacttgggttggcttaatcaacctcttcgatggtgggccctaaggaagcaccaccagaaggaggagctccaccaacagggaatcccccaggcattcttcctggcatgccttctgcactctggtacagcttggtgatgattgggttgcaaagttcctccagctctttctgctgatgttcaaattcttccttcttggcagtccgattcttattgtgccagttgataatttcattacacctgtccagaatcttctgtttgtcctcatcattaatcttgtcttgaagtttctcatcttcgacagttgctttcatgttgaatgcataggactcaagtgaattcttggatgacgccttgtccctctgcttctcatcttcagctttttaattctcagcttcctggaccatacgttcaatgtcttccttgctcaaatggcccttattattagtgatagtaattttattctcttttcctgtacttttgtccacagcagagacactgaggataccattggcatcaatgtcaaaagtgacttcaatctgaggaacaccttggggttcaggaggtatgcccgtgaattcaaacttgccaagcaggttgttatccttggacatggcacgctcaccttcataaacctgaataagcacaccaggctggttgtcagaataggtaatgaaggtctgtgtctgcttggtaggaatggtggtattacagttgatgaggatggtcatgactccactagcagtttcaataccaagggaaagaggagtgacgtccaagagcagcaaatcttgaacattttcagacttgtctccagacaggatggctgcctggacagccataagcaacagcttcatcatggctgatgctcttattcagttcttttccattgaagaagtcttggagaagcttctgaatcttggggatactaatagaaccaccaaccaggacaatatcatgaatttgtgacttgtctggtttggcatctcgaagggctttctctactgggtccagggtgccacagaacaggtcagcattcaattcttcaaactgggcacaggtaatggaggtatagaagtcaattcctacatagagagaatcgatctcaatactgacttgggtgctggaagagagagtacgcttagcatgttcacaagcagta

SEQ ID NO: 124376 - DNA, 1189 bp, Homo sapiens
aaaccacaaaacaaagcagtaccttatattactagcctctttttgttgcaggatctctccctctaaattacagcagttcattcagcaagtagggaaggtaattcttgttaatcctctattctgttggcgattcttccacgtacttagtagagttaaggcaaaaacttaccgaattggaagtatgtatcagaaggaattcttaattattcactttgaaataaaagaattttccttataggttccaagtagtagactgtactataatactgctcttctgaaataaattgaatatttttaccttgccaaaactatcattgaaggctggaattttaggtacagtatttttctgtgaatgattttatgttgttaaatattcttttaaaaattcatatctgtaattgttactgtagaaaaccaaatacaaagaattctaaaacctttgtaccgtctctgtgtatttgagattacttaaaatatctttttttctgttccaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtg

SEQ ID NO: 124377 - DNA, 1073 bp, Homo sapiens
tcccagaggcgccgcgcagctccctcagcggcagtcacagctggccagcgcgcacccggcacgcgcgcccccagggcctctgcgcgcggacccggctctcaggcgccgcgggagaggccccctactcacggagcgcgcggcccgtgcgcccacgctccgaccgcattcctcagtacgtggcacccttggaaagtgcctgtctggtcaatcgaagagtcctcgtttcgaccaaaaaaattcccctcagaaatatgcatggcacggcaatgaaggcatttcactatgaagtggaatgatgatggtccgaccaggtcaggacgaacatatgaggggttagatctaagcaggcactattaaagacagtcgcatccgggccctcctgccgcaagctgccctcccagccaagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcgtaagttcgtgaccgctctcctaatgttttcccttgtccttcttgcgtcggggtgcgcctctttctgttccctgggaacgtcctcatttacagccacttaccgtccgtcagaccagaccctgcctcgcctagtgtttgtcatcttagttgtcccaggcctctgtgaccctctacgccatgcattgtggggttttgtctgacaggaggaaggagacggacactgctcggaaaaaaaacctagttttttctagttagtgaatattggaacagtctggtggccgctctcttttgcaggttgtgcggtccaggagggatagatgtgcgctgtgtgggtcagagactagcataggtcaggttccctatgtgttataccatctctggaggttcttgtattcgccgcattgcaccaccaggccttttggtaaataagaggggtccgtgatcttggaatcctcactttgtctggacgtcgttgcttttgggaaaatttcgaagtg

SEQ ID NO: 124378 - DNA, 1956 bp, Homo sapiens
ttgttttgttgcttcattctttctttgctttgctgggcgttttgtccaattctttgttaaaaacgccaagaacctggacaacttgcagtcacgatcctctaccggtgacaatatcatttaaatattggtagtggcttaaggtagcaaacatccctttgtggaacgtttactcagtaaatccttaaaaaacagatcagaaacaaaaactggcctcccagggatttggactcaggaggtgaattaggcgcggagagggcggagcctttggggtttatgggcggaattgcacagggtttggcggggatctctgctccgccttggcactactcggctccgctcgcctccgcgcggctccctgggctttcactcggctctgttcggctcctgctcgggaagggtgcgcgggggcgagtcctgcgcatgcgccctcaattcctgctgctctcagggctgcgctcagcctcgtgttttcacttccttttcagagctgtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttagtaagtgtatccgaggcctctgcggcgagaggtccatttcagccattctagaagtcagggccggtgggagcagggcaggggtgggagagtcctgcgggaaagcaggattggtggaccctcgccctccatggtccgcgggaatgaagcccgcttgttttattccctgatttttgccgtttttattgactgttacgatgtctaagtgggggattacgaggaaggtgcagaaacatctcgaaaagatgagcaagagggtcagcttcgattttagctggtctgagttggcgttggcagcatcagggctggagctgcctttgaaactgcccgtggagctgtccagccctccccaccctgcttctgcaccccaaccttctcctgaccccttttgctgagaactcagttagacaaaaattccttgtgcgaggtcatctttatgttctcttagcaccacaactctcccctgtgtttggtgtgattatgaatgacaatgtaatttttttctcttcacagtggatcgcagctccaagaggaggcaggtgaagcctttggcagcttctctgctggaagctcttgattatgatagttcagatgacagtgattttaaagttggagatgcctcaggtaaatatttccttctctcttcccctttcccagctttctggagttaggcttatttttagactttttaaatcggttttgattaaaatgccaattttaagtgaaagcacgtaaacttcatttattttgtccatttgatttcccattttgcctttagatcctgtcactagacctataattgcttctgttttcctcagagataattagcagtcaggggaaggactttttccaaagatgcaaaaggatttctctgttttacaccttaaaatatatttatgcttatattatagaggaaaaaactgaaagatatcccgaagtagaaaagtatcctgagaggtgtgtggaccattaatagtccctgagcagggttcttcttttttcagatcacttgacaatctcttaggggagttttg

SEQ ID NO: 124379 - DNA, 1116 bp, Homo sapiens
ccagtagcatctttcctacctgccccagcctcacctccacctccacttccactgttgtggcaactattgtttccagacattgccagttgtcctctgggggaaaaaaatgttcccgtttgagtaccactggctcatacaaaccaagatgacatagctggaactagaatcggaagtggaggatgagttgtgttgactgattggctgtcttcaagacatatacggttttggtcaaacatagccctgggatagctgtaaataactagtagaatagtgattgatctgttatctattgtgtatatttatagtactaacactgttgtaccagatcaatgaacagaattagattgatgaaattgatgaacaaatttatattgcatatattgtatattagcataaaactaaattaaatcatattgattttgttatggggagaacattggatataatggtattgatggttgatattaattaaattaatttttattttattatttgatattgtaaagggattcttgaaggttggtgttttaaattctaattttaaaatttattttatttttttgtctggccattaccactcagaggagtttttaaaaattctgtaatggtaaaaaatttcttaactgtctgttagttgaaatagctgttgcttggagagattctgatatattgtatgtttgagaaaggttatcttttatttaaccaaatgggaagtaggatttcaattttaaagatatatttttttcaaacgtaagaaaggtttattgtagacttgaaattaactctttctgcctaagataatttctccagtatatttctttttttcctttcctttctctctcttttttttttttttttggaacatagcacagagtcattctttgatgactaggaaattttgtctttgcagcctatggaaaaaatagccaagggccttgatttttctcattgtcattattacccagctatggttgtaaataaatatggtttatctccattcctccagtgcatatgtacaaaaaagaaatagtgactaattagatgaagaagttatttttcagatatcagagaaagataagatttgatgtattgctgatccctatagaaagataaaat

SEQ ID NO: 124380 - DNA, 1046 bp, Homo sapiens
ggggatgagatccagtaccaagtagagagattgagtagataagagtaaccatagtaattagggaaaaaaggatatatgggtccagatgtagctaggttgttagatgtggtagttggagcatgtgtaagttatttttaaaatgtttcttgttttctcagtgaaataggaagcaaagccattagcagagagtgggacagtggggagttagagatttggggaggcagagttgtataaatttatttgggagaataaactgaataaggaaacatatacctaaaatatatatgtatacacacacagacacatatatgtatatatacacacacatacacagcaataagaccacttgatattagtggtaatgaatataaagagctcattaatataaatatattcatatgaatatgatattagtggtaatgaatactgttactgagaaaagtaaacatggttgaatatatgtgtatttttcttctccaggtgtggttcagattcctgggagtaggtaaagaatatgttaactcaggagtagcagctactttggcagtgtttgttacattgatcactgatgatcacaaacatgttactgctgcttatatccatgaatgtcattgctgatgtgtgatacagtcatgatgagttctgtcagttttggtgattctcttatgatgctgagggcactatctctatttttctctgcttcattataatgctgagtaccatctctacttcttaagtcattcttaggtctacttcttagattgtggtcattgactatggatgtatttttttaggccagcacagtagttttgagtaattgaattggttgctaacatttagacattgggaaatcgtacacatttaggatttcaagcttcttttgcaaagttctggcggcactagggttttttgctgttgttgttgttgttaagtgatggagtgccccaggcttgcctcaaactcctgggctcaaacaatcttcttgtttcagcttcctgagtagctgtgactaaaggcattaaaggcatatgcctgcccttgcagta

SEQ ID NO: 124381 - DNA, 1056 bp, Homo sapiens
accctaggttggggttcaggctttgttggagaaattatagttaaaccctactggatggagagaaggccctctgtgttgagagggccatggaaaaatgatcttcatgttgggccagggctgtgaggtcactgagggactgtgtatatagctggggcagagcacaggaggaagtactccacccatacctgctgaaaagcccctccgttctacgagacctcctgccattgagtttatagctccctctaccattgagcttagtgttatgctcactctgagaagaaatgctgaagaaattctgtccattattgcagagtaggtattgaagcatgcgtgagaggcaattaataagtggcacaaagacctgtgttctttttactacattcacactcatgtttgttaacacatttgagcacttgtcatcataacggtgttgccatcttccatgttttttttttttttacaggagactaccatctagggttggtgactaaaattaagagtaattttcaaccttttgtatttcgtggagatcacgctctgcctcttcctctccaatataagagggggggtgggtacttaaatttttattttgtcacataaggatgttttagtattttattaaacatgctttatattaaaaacaagattaacagcaaagcaacctatataaattatcaccatcatttcccatattttaacataaaaactagggtatattatgtcctaaaataaaggataggcttttaaatttaataaattttactttagtaaagtaaaacaaattttctcttatttttatcatttttgcctcaattggtggactgatccttgagaaatgttgccatacaagattgctgggatagcgtagaatctaccattgaatcttggagaatcccatgtgttgatgttcaggacaaatgactaaagaatcttacctcttcttccttattgtctatccaaaaataaaatatataacaaatgatttgatgtattgacatgaatctgtggtctgtatcataggcataggcattactctaagttgggcctgagagtggc

SEQ ID NO: 124382 - DNA, 1049 bp, Homo sapiens
tcatgcatagattttttttttttttttttggtaactcttccagtcctgagaattgaaatttttggtgataaattgtggtgaataagtaaggcagttttggaaagacagaacttccttttagggaagagaatttattttactgtttttcttgttgataatttaaaagttctgttaggacactgtcaagtagtggttacttcatgctatcataatagacaaaacaactggcaaagttgtttctgaatgaagaaaactgaggcctctttaccatttaggtttactgagggatttttttttggatactgtggacgttacataagtagacacctcctgtgatggtgcaatctggcaaaaattcttttatatactatttgaacacttgtgctaatgtctacacttacctgtaggctgtactggaaattataggccttcacaatatttccaaggacgtaatactagtttgattaaaggtataaaaagccaagaaaattcgagaagccttttagtatatgagcttcaaatggaaaacagggaaaaagaaagaatattgtatataaagaataaaaaaggttttgaagttcaccatcacatgagattaattagacttttttccttctattcttgatgggagccacaagttctacatagaaaatgatgtgatttaatgtaagaaaaccagtacattcttgtcattaaatttttattttatatcttatggagagtaagacttataaacctgactgtgggaaattttttggcatgctctccttttttattttttatttatagttttactatttgtgggtacatagtagatatgtatattcatggggtacatgagatgttttgatacaggcatgcaatgtgaaataagcacatcatggagaatggggtatccatttctcaaacacttgtcttttgagttacaaacaatccagttaccctctttaagttatttttaagtgtacaatttagtttttcttgactgtagtcaccctgttgtgctattaaacagtaggtcttagtctttccactttttcgactcatta

SEQ ID NO: 124383 - DNA, 1038 bp, Homo sapiens
tttgagaatttttctgttactttgttgtaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggtaggtttatttaaacccatagttggtgaacatgttcacaagatatcttttgactctatgtcctataataagtgtaaataataaaagaaattttaacatttattcttaaagttcttgccaagatcactgttctaaaactttaagagtaaatgcctatgagttttgtcagttttaaagctagtcagacgttcagaaaacataatttttatagtgagatctgacagataaaatgaaagataatccaagttgtcttaaagcattaaaatgtcggcatttcagccccatgaattatagttaaaaaaaaatagcatattttatacgagaagctgaaactgtatttgggtaaccttgctctatttttctttaaataaaatcattactgtgtctttagtatctctgttactatctctttactgttacttttaattccataatattcctttcagatttattggctttacgttaaaaaatcagttgttttcagtgtttggggactggttaagattcgttcaagtattctgagtttaaaactattttcattacactataaaaatgttacttacttttctgaactctgttctttcatgagtattagtggagacttccagagattacatacagtataacagaacccaccgaatatagaaacaattttgagaatccagctacctttttttatgtcagttatctagacattagtatgtaaaatgtaaaacagtgccactctcctcactcaatttttgtgtgtatgtgaattgtatttagtaaaagtgtatacttcggtaatggacccattatttaaaataaattaatgaatattgcaaaaaattttcagttttaatttttaatagggtaactgtctaaaatata

SEQ ID NO: 124384 - DNA, 2766 bp, Homo sapiens
actcatggggatcagtacagatatctttccagtggacaattcagatactagttctagtgtggatggaaggagaaaacataagcaaccagctctcactgcagattttgtgaattattattttggtcagtatagacactggtacatgcacattttcactgagaacaatttgttaatgaaaatgtttgatatactgttaatttttagaaatttattagccatgctgcatatatcatagagggatgtttattttcctaatatgttgtgggtttttacaaaatgctaggttcatttatttgtaaatatacttaaaagttttaaactatgtaggtttatcaatgtgatcatctttatagctagtttcttcctatgtcagtttttacttcctactaaagtaaaattcgatatttcatttaaatagagagaaatatgcgcatgattcaaattcaggaaaatatggctgaacaaaagaatataaaagataaattagagaatgaacaagaaaagcttcatgtagaatataataaggtaagttagctacaaaatatgcaacataatgtgatagatcttactgatgatttcttttgtgaatgtatggcatttcttttatgttttgtttttaatttcttctggagctctttggctcttccctataactcctactcctcattagcttcattatcatcactgtctcttactgagcactttgtgtgccaggcataattttgatctctttacatgtattatttaattcccagcttaactttatagtgtaggttataatcattgcttccattttcagggagaaaactgaatcctgaagaagttaaataatttgcccaggttcacacaagtagtcaagtcacagacttgacaaatgaagtcagttggtgtgaggccaactcatgtgactctgttctctatttctaatcaataaacattgctatagagcttcactttctaagtttgtagaaaatttagaaacttttctttaaattattatttatcttgaattatattataatgtttggaataaaaatttccaaatttgaattttcatgtacctcttcatcgtaatgagaaaagattcaaaaagaagtatcttataaaagcaaaatgtggttaaaatgttataccaagtataacttgacatataaaacgggtattgacttattgttagaaaacattttaagtcataaaaaaatagtaggaagtacgtttccaataatcagctacactgtgtagtaaaaagagtacttggaattagattcagaggacctggggattcttgctagttctgtgatcttggccaactcacaaaaactctatgatccttagtttttttcattgggaaaatagtggaaatacatcttgagagagtcacaaggattagttagcagaacatgatgttatataacaaactgtaaaagaaggtataaacgtagttaccattattagtaaaaatgccagcagaaaacaaaatgcttacagcaacaaatactgctgaataattggatagccttgtctctcagtggtattgtggcttgaatatattaaaaatatatggaggccgagcgcagtggctcatgcctgtaatcccagcactttgggaggccaaggcaggtggatcacgaggtcaagagatcgagaccatcctaggagtttgagaccagcctggccaacatggcaaaaccccgtctctactaaaaatacaaaagttagctgggcgtggtggagggtgcctgtaatcccagctactcgagaggctgaggcaggagaattgcttgaacccaggaggtggtggttgcagtgacacaagatcgtgctactgcactctagcctgggcgacagagtgagactccatctcaaaaaaaaaaaaaaaaaaatagatcgagaccatcctggccaacatggtgaaaccctgtctctactaaaaatacaaaaattagctggatgtggtggtgcacacctgtagtcccacctactcgggaaactgcagcaggagaatcgcttgaaccccagaggcggaggttgtagtgagccgaaatcgtgtcaccgcactccagcctggtgacagagtgagactctgtctcaaaaaaaaaaaaaattatatatatatatgtggaatagaaatgtagatatttcttaaattgtcagatattttaatgaagtttactaatttggcttactttgtagctatgtgaatctttagaagaactacaaaacctgaatggaaaacttcgaagtgaaggacaaggaatatgggctttactaggcagaatcacagggcaggttagtttctttccaattgctgtctccttcagttcttgctccctatatgattttcaaagaacagatttttgatacaactgtcatttgactaaccgaagaattctgtttgatcagggcctaatcctttgggataatgatttctgcttgaaatacacctagagcattggaagctgcctactgagaacctctagtttaatttggttgtttcaacagctatcttgtgtgcaaaattttttcatttgctctaactgattgacctgtcatttgtgatgaagcttaagacttgaagcatgagtttttcctactacattcttctttcctttaatttagcagttttagattccctgccacatttttttctttcctgtccttatgctgtatttttttttctattctttggatgtataatttaaaattaaaaaaggcaaactagagatattcatttttatgttaatttggttttcagctgtataagag

SEQ ID NO: 124385 - DNA, 1618 bp, Homo sapiens
tgttaaattaactgaggacacagaaattaaacatttcaaaaagaataaacatattgataaaacaaatatattagtgttgttgtatgtttttaaatacttacttccaaatgatttaatctattttggtcattaaaatatgtcttaatttctcaaagaaaggcatgaagtcttaaattttatgagttttttatgctatcaatgagaaagataaagtaaaaattacagtagaaaaagacaaagtccttcaacaaagttaagaaagtttataataattggctaatttttttgaggtagttcatgtagagtgtgttgggagctatcctgaaggttaagtttattaaaatttagggtaaagtagtaagtagttccaagttcaggagatacacctgaataattctgaccacagtataaattttgcaatatgtcgaaaatgaaatcccaagcataagcgtaacataatggagtaaatgaaacaataaaaataaagaaaaaaaataacaatcttatataatgaacaaaaatttaattcaggaaaattcccttggggttgagggtggagttgaggactatgattttgaaacagtagttaaaaacttatagagctggtgatccttttattaattatttgaacctgtatgagtatctactgtgtcttactaattttttttttttaatatgagattgattgaggcctttttgctgtaggacttagaggtttttattaggttttttgttttgcttttgtcatatattggaaattaggaacctgagaaatacaatttttattttaaaaatcagtttatgatagatttccaacccatcatattttagtcgtttaataaaaaaagtgccatcttctaattttgataagatttttgaatagtattactctatgttatttatttctttagtttctgttatgaaatttttatttctaattgcattattacaatatgccaatgtctggaattttgtgaaagtcttctggaaggtaaagatatttttattactctaaaataatggatatgcaaagtccccttccttcgttttgccttattaagaagataatatcgtaaattgtctgcaaagttttaaagaggtaatgtagaggaaattaaatgttttattggtactatattttaatatttcttaggacaagataagctggatataaagcaatgccataaaatatttttggttataatgtgatctttaaaaaaaatacattgtttatgcactattcttcttgggttaaagaatttttatataaaatttcatatgtttaataaaagtaatctcataagctaatatctgccattttccctggcatctcatattttggaattggcactgttattgtttgaaaatcaccccccaaaagtctacacttttttattacattgcatcttaaatactatctttacatgctatttttttaactttcaaataagatattttaaataaggatttattttctctacagatatatttcagcgcttactcagacatacgtgtatgtctgttaggttctcttttaaaattaaacttcatgggtcacaattagtcttttatttaatatactgtgtttactttctcaagttcttttaaactgatgttt

SEQ ID NO: 124386 - DNA, 1031 bp, Homo sapiens
ctggaattatagtttggagtcttattcctcacttatattgtgctttaccttctaggtgtgtgcacaccgtctctctttctccccgcactcccaccccgtatcatcgtgactggaaagccacaggaagttgccacatagaaatattctgctttccctatttttttttttttttttttttgatacagagcccttgctctgtcgcccaggctgcagtgcagtctcggctcactggaaactccgcctcccaggttcaagcagttctcctgcctcagcctcccgagtagctgggattacaggtgcccgccactacgcccggctaacttctttgtatttttagtagagacagggtttcaccatcttggccaggctggtctcaaactcctgacctcgtgacccacccccttggcctcccaaagtgctaggagtacaggtgtgagtcaccacacctggcctgctttccctaattttacctaatgagaattcttatttgggatagaatcacttagtaagataattgtaaaaatgagcggttgccagtaaaaccagtggggctgtacaaaaattggctagatttaagctaggagaaaataaataatggaggaaagcattccagaggagaagatgggatgcccgtctggggcaataggtagattcaagcaaagtttatggagaactttatctgaaacagcacaatttgtggttgtttttattggagtataacattacataaggatatgagaagatacgttaaagacactatttttacaagcattactatctgtttaaaatgtagtaaaaataattacagaacttaaacttcaaagtatttacaaccattactatttgtttaaaatagagtaaaaataattacagaacttaaacttcaaaatatgtacacacacacaatctgaaaaaatgttagaaaagcaaatgtttcagcatacacagatagccatttattttgaagataatagcaattagaacataagtattactttattggatttatttttaaaggaccaagtgttatt

SEQ ID NO: 124387 - DNA, 1040 bp, Homo sapiens
caacatttaacattggtgaccaaccttcctccttaaaacactatcttttcttggttttgtttttttccttttttttgagacagtgtctcactgtgttacccaggctggagtgcgggaactgcaggtgtgtgcctggctaatttttgtgtttttttaagagacagggtctcactatattgtccaggctagtcttcaactcctaggttcagtccttccaccttggcctcccaaagtcctgggatttgctactgataagtacagttttttttaaccctagtttttatcagtagcaaaacataatagtttaaaaaaaaaactgtggttaaatgcttgaattctggagcctagttatttgggttcagattttcacccagcatttattagttgtaacttgtctagttacataatctttgtgctttagtttcctcatctgtaaaccgaggataataatcttttttacctctagaattgctgtgaggattaaatgaataaaaatatgtagtgcttattctccttcatcaactctctcctggaccgttgcaataaccatcaccttctctagtttgagtacctctagtctgtatccagttgtcttactaaaacatgaatttgttactattgtactcaaatttgtccagaggcttcccatttcttgcaaggtaaatctagactgtatagcatggcttataaggccctccaaacccagcctcagtctgtctttttgttttcatttccagctgttcacagctccaggtgacctaaatttagatcatcgcaggtcattttttctttctaaaactaacctgttgcttttatgccatcttgcttttattatactttatgttataccttctctctgaaataacctcgtctttttctctgggatgagggcttctcaatcacttatacttagtccatatgtcttggtcagtgtatgattcttagtgtataagcaccattttttaataattaaattaattttaatattccaggtccgaagccaatgcttatcacatagtatgcccccagtacataaccaa

SEQ ID NO: 124388 - DNA, 2189 bp, Homo sapiens
tcttggcaggaactattgacaattgactattgacaatttctctaaatgagctgatgatatgtctttactaaaaatttaaacacttggagtcatacaaaacaagtatgatccaacttctagttgaaaagccaactatattgtttttgatttttctttcatttttaaattaagcattctgtttcatctgttactcctgtatcaaggttttcatttgtattgattttatatttctttggacatatgaaatagacatttgaaatagacataataatgaaacgaggtgaactgaatttgaaaataggactggacacaaattttgaaatttgattgatttccccagcaaaatgttatttttaagtcattttggcctgggaattatagtaatgataatgttagatgcttactgtatcccagactatgttttctggtctttgactctactatcacattcagttcttacaacagtcctatgaggtatatatatctccattttagaagagaggtaactggggtacatagacactaagcagtgtgaaatagaaattattccagttatatatttaaatgatattatgtaaattaagttatgtattagaatataatttcttcccttccagaaaaatactaccatagtgtatgataaaatctactgaccttcacattagttgccaagatttattgagggcttatatgccagtcagtgtgctagtgccttccacatttgatctcatttaatcctcataacaactgcttgagatagatactgatttcattactattttatgggtgaggaaaatgagaagaattacttgcccaagattgtacaactggaaaatggtggaattataatttgagtctaggcagtcttaaccatacagttcatgcactaattaggcatactgcctcaccgcactacactgctttagcatatttgactttgttgggacaaaaaaagtagatacttcctcttaacaggcaattctaactatataagatacagaatatattgatagttactggtatgtgcatcagtgaagccctttgaaaacaattttttctacattaatttgtttactagttgcatatgaaataaatacaaagcccaaacttgatctttgatttaaaatactgcacagttttttgtcctgggaagataggagccaagagaagtcacattgcttattctagcttattttagtgaaatttaggatgtagggatattagcaatagctttttagtttttatcaaacttatcaacttgaatttaattgggggttaaagcagatttccatatctaatgtgtctatattcggatgcatttcaaagtgaaatacaaatacatattttcagttgtcttctcatctctattatttgtgcatgtaattaagagttaattgtatttctattataaatgatttggttgcttcctcttgcattatacttttccagtagtaaactacagacaaagtagttctcagagtatcagattcagaatgtgctcaaaagctcttcacttagagactgaagcactgaaaaaagttagcacgtgtgatcttactatttaacaagcaaattgacctctattatttcttatatgttgataaatacaacatgtctttgaaaattatgtttcacattgtattcttttgtgggggtgtttacagttttgtttttactttctttggaggttattcagtttggcatgatagctctcctcagtaacgctttatttgtctgtgtgccacttttcactttctttttctcaatggaacctagaagcattaaacacatctcttaattgttaatataaaaaagtgaactttttctgcgatgtgtgactacttggcatttttacctcatcttcacagatctaaatgtttgaaggaaatgataactttttatgtttaccccagtcaaaaaattttacttctaatcactaaaatttctccactgaaaataaagacaaaaaggtaacaaataattgtaaccaaacatatttctaatatagtctttttaaaagaaagtcagcttaggcacaggataagaatcatttgaaaatttcttccccgagtctctgtatttgagtataaccagcactgtaacacactgatcagatgtgcttgttttcagcacagttttatgttttctcaagcgatgttaaattgccatatttgatgaaaaaatagcaa

SEQ ID NO: 124389 - DNA, 1026 bp, Homo sapiens
aaagacttgtgaagcatatgacattctatttttgacttattagtcctagtgtgaaagcattaatattattagcatgaaatttttacttcagattttaagctcatgaataaagatatatctgtgttgatctctagatatttttagtaatacccaaatatattcagtccttattgttttaatataagctttctgtgttcagtataattttatttttctcaaccttaaatatgaacttaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatcttttcgggtatagtgacaatggaaaatagtttaaactttaggaatagagtaggtaatgttatagataatcaaaagcaattgtaattgtaaagctgctgtaatctagtgatctctagttacagtgaggaacgctatgattggatgagatgtttgataaaagtaaaatgtgtatgaaattacatataaacagattattagcttattgaaagatctcataacattggaggaaaaatattcataatctttagcaaaactagtagacttttgtttaaaagaataagataggactagttgtcactatattagcttaaggaaatgttggtaattattactgttgctgaactctggctgcttttaagcaaaatgacagattgccattttctaagtggaatatactaatccattagaccatggccctcttttaatatttagtgagaaattactcgcagttgctttattttaggttttttgagaaactcttaggccttgttttggtatcact

SEQ ID NO: 124390 - DNA, 1028 bp, Homo sapiens
gaacaaagcagacatgtttcaggtatggaaatgtctaattcttctctcatgctgtgaagagttgcttgaccttattgtgtatttttatatgaattgttttgtctcatctttcattttcttgtttcacatttaatcttgtaatctggctgccacagatatagctaactgaattgatcccactctttaagtgactattaaatacagatttggatttggatatttttctaattttttaaaattaatttttatgtgtaaagaatatttttgtctttcttactacccattcattcattattggctgatacagaagtctgtagtggtattaatgaaataggttcaagccctccacgttagtcttatatttgtgaaatgattaaaaaccattttctaattattttgtatagaaactgctcatgtaggtaatttgcactaaaattgttgtaaattacaaggaataaaatattgtacttattgatactaaatgttattccgtattggtagaatgcagaattttgtgcaagcttgtattatttgtaaagtgatttaactcattgaccacaatttgtattttctccatctgttaagatgtttaatcaaaataattggccactattcaatgaaagaactcatcgctacctgttaatagatttgcgtagatgtttgagctgctagtgagatttttatttaagtaatgacagtattcaagactaatttttttgaacattcttgtgatggaatttttacacagaaatgaaaaagttggaaaatccaacccatcagttctctggatatttagttttttttaagtggacagacataatagtctatattttcagagtccagtttttgttttgctttatataaacttataggggctacaagtaaaatgttccattggcataaaagataatgtgattatcacaatcaacttgatcataaaaatgtacatccttgttcaagtctatgttatggattttgcttctttctaaagtttagcttacaaatggctataaattatttgcatagga

SEQ ID NO: 124391 - DNA, 1032 bp, Homo sapiens
cctttgtaaataactctctgacagaaaactggctcccattttccttaatgtatactcttgtatcattactctcctgatatgaaaccaatctcttatcaccctctactcctgcccacatggatacctactttgcttgtcatttgataacttttaaactgaattgttcaggaagaggagagaagggatgaggactgacatttgtattttttacaagttccacaggtgattttatgagattttatgagcagttaggaataagaactactgttatacctagttgttaaaaacttcagtttttacaaagttttgaagctaaaaattaactttttggaattttaaattttaaaacaatgtgtataacccaagtcaaatgtcaacaaattgacattttaatattatattgtatattgccatataagatataaagtagacttagtattgtaatttaaaaagtaggacatagctcatgcttcagtcttttccaggatattcttgataaagatctcaacaacttgtatctgctgaaacacttaaaatgatgataacttgtcttaatatggttacatgaacatgtataaatatttcttttaaaagtgcttcctccaggtcatatgtattcacagacgccactgaggatttaaatatccatcatgtactttatcgtgactatgtcagttactattgtagcttttcatctttgtttaaagctatgttttgtgagaagccatggagtatacatgacaggtcattatctgactactacaaggtgagctgtcttagcttggagacttctatttggttcagtcttatttgatctttctagtatgctacattttttgagtagtaataatttttgaattcatatgcataggaatttcatccaagtccttataggagattttctagaactacaaatgcgtgacagactagctaaggcgagtgatatttctcaataatcatttgtattaaaaatctttaagtagaggacatacgatatttttaattttggttttattttttatcttttctgca

SEQ ID NO: 124392 - DNA, 1004 bp, Homo sapiens
caggaggttgagactgaagtgagccatgatcacaccactgccctccagcctgggcgacagcaagaccctatctcaaaataaataaatttataacttcatttttgttgttgttgttcttaactgtagcattgtgtcagagttttgtagtcaatttaatagtattctgagattttcctttaagactcttgagtttgagctatcaatgttcccaagacccccaggagtcatgcatggccctagctctgtagaggcttgtgattcttcttcttacaaataaaggccatttttttcttgcttggaaaataacttattttgtaagtagctgttaaagtattgagaaagccactatatgagtgtattttaagacataagaacagtcattccaaggtaatgacagaattttatgttcctcagaagctgatccttgtacatttttccaatatacatttttcctcttctatttctgtatcctcataagatttaagaagtataccacaataaatcctaaatattttcagaatagtagaaaaactagaaggagagttaatatgtttaccaaaattttcataaataatcttcaggtagcagaactgtcaagctgttttggatttgaaaattgcttttgatcagtactgcaagatagacttaggaccttttaagataactgaataataatctggtcagtatccattgagcaaaaattggattgttttggaaaagtatgtgaagcttttaaaatttattgatcatgagcaattctaactgtacatacggtatattgaaaagggaatactttttatagtcagagctgagtttggaatcctagctcctctaatatttttggatatgtgaccaagggcagttcctgagtgtcaccaatcttcaatttcctcattggaacataggaacaataatatttatcttgcctggcttttgtgaggattataaataacgaacgtaaatacaagcctttaataatatacaataatatatttgtaatatat

SEQ ID NO: 124393 - DNA, 1036 bp, Homo sapiens
ggccaaaggttgttaaatgtagcatatcacacacatttcgcactttacttaatgatccaagtgtttattactatgaggtaaatgcaccatttaaagaattatggtggaattgtaaaacgttaaaaactctaattaatttcagtctgaagcatgcagtgtgctcattttgcctaaaacattttcattatcgtcagtattttccagttattaagataaattatttcttcattgtgcagcactagcatattttctgtattaaaaacacagttttaaatgctgttgagagttacatatctagcatatgtttttaaatgaataaaacaatatagttttttgaccacagatggaagccaagtagtgtatctgtttttctttctacacttgttccgtagctaccagcagttagaacaggttgagtgtctacatgttttttccctaaaagctatatatgtattcttacacttttaaaagaaacattattaaagtatagagataattctgactattaatttggatccagttataataactgttccttctctggttagtaaaaggaatatttaaaatctaaagaaaatatcataagaatatagaaacattttaagttagtgcctgtctgcaccgtctcccttcattttactgttgtaccaccatggatgtttgcctgctgtgaagaacatatttggtaaaataaaaacaagtgacatcttctctttgtattcatagagtcttgtaactcttacttatttctggaaatagtttgttcatatggccaaattataaagggacttagtaaaagaaagctatgttttctgattacgaaggaaatctatgctcacagtgggaaaacaagaaaatgtggcaaagcacaggtaagaaaataaaaatcaataatatcaacattatgaatattttaggtacttaggaatttggggtagaatgatggaaagcaaactgttaattatagctgtatatttcagtgtagaggctacaggtgccttgcatttgttttcttataaaatctgttcccatacat

SEQ ID NO: 124394 - DNA, 1121 bp, Homo sapiens
atacgagcacgatccattctggcctatgcgggtgaagaaggtgagtcgccagcttcagacgccatctaggttcgtttcaaaagttagtgtgcatcttttttgtgtagcctggaaaagatgatattctatgaaagtcaacaaccagaaattcagccatccaagatttaatatctgttgatgtgttgagcaatttgattctgtcccccaaaattaatcttgaaaatggatctctaacaaaggagaaagactttttaaaagtgaactcattttgctttttcccacccttccagtcattagagttctttgtaaaccaaagtgttaggcctttaagaaggtctgaaaatggctcccaaaatttcagatgtttcattgtttttttctgaatttcagaagtcagttttatcttttgaaaatcatattctaccttctcataaataagtatatatatccaatcataaagtttatttaaaatcacaagaatagctactgttcgaccaaaaattgcaattttcagtttctttgagtttcttgaacataggctccgaggtccagaaatctcatatgtaaattttgttcatttttaaaatatgttgctcctaaatctcttcaccctatagggtgaataaagcatgtttgtcacatattcagacctcacttgcaagctttattgccaagaaatacaaggctcttggtaattgtctctcaagatgatatccaaatgctaatttggcttctgtgtgactgggtaatataatgtcatacttaatcttgtctttctgaaaaataacacaagagtgagaaaagcataaaagtaaatcaagtttgttcatattaaggcatgttctttctcaagaatataagtgtatgttatttaaacattatcaagctaaatgactctttgttcacatttagcactgataaataattatttctatttgtaataagcataacattttatgttttccccaaattatcgatttggggggagttttgtgttgcctatactttttctatttttctgttcatgaagtattttagtgatagaaacatagtgttcctagtcaaatttgctatctgtgtgtgtaacaactgtgcacacctataattaccttggcctttgc

SEQ ID NO: 124395 - DNA, 1105 bp, Homo sapiens
ttgtattcgatttataaaaattataattatatataaatatataaattataatttataatttataaatattatagccagtaatttttatttgtgttttaaaatatgtaacattagtagataattattatgccctgtggtatgataatggatttttaaaatgttcttaaaagcaaattttaagattttatttttattttctatcataacaaatttaaacctcacaaattattttcagttaaaagtaattattttgattatatggttttaaactggttgtttgctgatattattaacatagtatgtgctaaagcctctggtacaacatgaaagctgtaataaaatttactgtaaaccatccatgaagggcacttttacagatgttgtgattatgtgagcctagaggctatattgctgtaattggcatcctgtgaggctggtgttctgcaattgttcctggaagctcagcgaacaagaagattggatttcacaacgtttacatttgttggctgttactttgcgttcacataatgaggaacattcacataatgaggaacattcacataatgaggaacagccattcttacttgccatactgttctttataatcaaatgcaaaaatacatcctatttcttttttttgcccactacagatttgttttctttaatatttttgaagcactatctattaaacgttactgaatgttctttcttacaacaaacattatatttattcttgcctcagtgcaaatgtacttaactttacttgtatccatctaaatctcccaaatatcattccattaatttttgaatcttccagtttggaagttcattttattacaattctttcagtggatacaatgggcattttattggaaatatttatcagaacaaatcctaaggtgtctatcatcatctttctcttctttcccaataagtaccttgagatgctttaaatctaaccacccctcccaacttgtgtaatattgcttctcatattttgtttgtgtatatttgtatcacttaatattagatattcttatcaattccttatacagtcaatggtgacttagatccactcacatatatgtactgtttctccaaactt

SEQ ID NO: 124396 - DNA, 1028 bp, Homo sapiens
tacacttttttcactaaaatattatacaaaatttatattaagattttattttacaaagttttgtgccaagcttatgttcctcaataacccactcataaaagctattataaaagtccttgcattactttccactaagttatcgctttttattttaagaccctttttatgtctaaccatcttcctgtgtttgccactctggtgcctgtacaatgttttcaaactgcaatgcttgcacaaatttccaagaagtacttttctagtagcatctacctgccagcatatccatgaacactatttctctaaaacattacttgtgaatagtttccattgattatgacatcattgaggcaggaatggtaacagacccagatggaataatgtggattacatgtatctgtataaaaacatacattgcattgcataacgattttaggggactccattcacagtctgaattaagtgaccttttattccccagtttgtgttaatcaaattcaactgaggaaaattggcaggcacttagtacctattttatggcaaggtctgtgtgtcaggtgcaggggaacaaacatgaatagcatggagttctctatcctgtgtaaataaactatttgaggctagtgaacttattacaaaaatagaaacatatatggatgtaaaatggaggagggagtaattctcttgcaaaatgagacagggaaggaaaactttcataagacacaagtttgaaagataagcagtttacacaatggagaaaggctatagagagacagaattccaggcagagaaggaacagttgtgaagaaattaaatggcatgtttccagggatagaaagaagtttggagtaacaaaaagtaggaaataatttggggtgggaagaagggtgggtatgagtttggagaagaagggaatggatggatgacacagtcttttcataataataagtttatttgctgttttctgattcatagaatctaggagatcaagtcatttgggtttataaaatattgccaggaatgaaagaata

SEQ ID NO: 124397 - DNA, 1045 bp, Homo sapiens
gtccaggcaggagtgcggtggtgcgatctcagttcactccaacctctgcctcccgggttcaaactattctcctgcctcagcctcctgagtagctgggattacaggcgcacaccaccacacctggctaatttttgtgtttttagtagagatggtttttcactgtgttggtcaggctggtctcgaactcctgacctcttgatacgcccgcctcagcctctcaaagtgctgggattacaggcgtgagccaccgcatcccgccgatttcatcttttaaagagaacatcttaacacttaatagactcagactcaaccatacccaatactttcagatgtgaaaatttggtaacatttagcatcttatatatgttgctgctgatatatgggggaaattgaacataccttctctaatgttgtgttatataatttctgatgcacatgtacttaaataccctcttttccttttcagaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacagtgagtataaatttatatgaaaaatgtttaacttcattcttttatcctattaagcagcacctttgtccccattgagaagagatgtttgttaaatgtgacactggtcagtgtgctttctgtatgtcttttctgtattgacgttctctaccatttctggttctgctaaaaatagcaataataaatactggcaattctgtatatacagaatgatttagcatttgaaaatgtctttaggagggtaaaataaactaaaaaaagaaaaaaggtattacaatttacttttcagcatatgactctgaataacttctagcaaagtgttgacatagttgatttgatagattttataaatgtaacattttgatttcattgtatttgggaaatacagtttttgccacgtttaatagaccattcctttatca

SEQ ID NO: 124398 - DNA, 1046 bp, Homo sapiens
ttcttttgctatgcagaagctttttactttaattagatcacatttgtcaattttggcttttgttgccattgcttttggtgttttagtcatgaagtccttgcccatgcctacatcctgaatggtattgcctaggttttcttctagggtttttatggttttaggttttttaaatattaggtctaacatttaagtctttactccatcttgagttaatttttgtacaaggtgtaaggaagggatccagtttcagctttctacttatgacaagccagttttcccaggaccatttattaaatagggaatcctttccccattcttgtttttgtcaggtttgtcaaagatcagatggttgtagatgtgtggtattatttctgagggctgtgttctgttccattggtctgtatctctgttttggtaccagtaccatgctgttttggttactgtagccttgtagtatagtttgaagtgatgcctccagctttgttctttttgcaaacaatgtgtgtttcttaggacattgtttttgaaaggaccgtgtagccttgccactcatgaaaacaaaacaaacaaaaaccttagagaggttttctacctgttttacatgttaacgtttgtttgaaaagagcacggtttgctaactattgaattaggaaaagggataatatttattggccagccatgagatatatgtgagtgacagtgatctgccaggaagagtgatagttgttttttcttgcagaggttaatggtgtggttaaggttgaggtagagatgtctgtggtggtggttggaaagagggaggtttgtcaggacagtgagtgaaatggaatggtatgttaaagtggaatcactacttaattacagagaaaaaatggatcccgtggatccatttattcttattgctttctgtcaaaagttgccggtttaagggctttttctttaaaaacaacaatataggaaaatatacgtatatgtgaataaaacgtttgtaacacaatgctaattgtaaattgttttatgcaactggggaattgttgggtattttc

SEQ ID NO: 124399 - DNA, 2189 bp, Homo sapiens
gggaactgagccccacatccaattccttactcccttgacaaatagtcattaacagtaataagaatattattggtttgtaaattgggtgttatctaagccaataaaacattgttgattataggtttggtgttttgaccattagctgacatttgattaacctttttttctatgataagagaaccatggtcacttttaagcatataatgaacttttatatttttaacagaagataattgttttaaaatattacacttattatgtgtaattatgtctacagggctcactcagctatccatttttgttgtctgttggggaaatactccttaagaggattgtgtgcacaatattaagttatcattaatcaaatattctcttctgggagataatttttatgtgttaaagtagtctcactatggaaaaacttctaatataactattaaatgtctctcctcacttacattatttttagagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaat

SEQ ID NO: 124400 - DNA, 1717 bp, Homo sapiens
atttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtc

SEQ ID NO: 124401 - DNA, 1647 bp, Homo sapiens
taaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttataatagcaaacaaatagaaatgcccccaaaatgctatttttttaattcagttataactgttactcttgtagttgtgtatgacgcaataaaatttgtaaaaaaatttcagcatgaaaaataaaatttgtatcacttatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccatatcgataaagtgatataatcaagcaagttacacacctttttttggtttcccagtgcatatgaaagtta

SEQ ID NO: 124402 - DNA, 1170 bp, Homo sapiens
gaggtctttgaggtttggggacccaggagaaaaacgtacatattactgcaatttaagtaaaccagataatttcaatcactgttattccatcgtttgtcttggactgtgtgtgttttcatgtacgtttcatatctcgtctggtttgtttagcgcagcaagttatagtaagttcttcgtgttgtttattttagcaaagtagagcaaacctgttttaatgtattatttcgggagaataacttattccttcttccgtctcccagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttt

SEQ ID NO: 124403 - DNA, 1017 bp, Homo sapiens
gaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatc

SEQ ID NO: 124404 - DNA, 1005 bp, Homo sapiens
ttatagggagacaaaaaaatgaagttattaatgtaaatatatatataatatataagaataattactggtctgtaaatgagtgatggtttatcaacagagggaaaggcatagactttgtttgtacaaggcattttttttttttttttgagacagagtcttgctctcttgcccaggctgtagtgcggtggcacaatctcagcttactacaacctctgcctcctgtattcaagtgattctcctgtcttagcttcccaagcagctgagattacaggcacaccaccatgcccagctaatttttatttttagtagagatggggtttcgccatgttggccaggctgttcttgaactcctgacctcaggtgatccacccgcctcagcctcccaaagtgctgggattacagaaagtagccaccatgcccagcctgtacaagacatttgatgcaaggattgttccattaataattcatggtgaccttgaaggaaatctttggtttttcaagattctatttaatacaacaatttcctctgtaatgtaaacaatgatttcatcagcgataataaagatgcaaaaaaagttttatcaaactttatatgatgtaaaaactcagcattcagctgatgcaattgagaatcttgagtacaccatcatttgaagctggaattttacctttaaggtttaaatttggcggaacattctggaaatgtaaaatcataatgttaatattaaaatctatgaagatcagaagtaatagtctcaacaaaccatagccagagtatgtattcaattctgtgcatgcacattaaaaatatgggaatacctgtacaggaagctagtttaggaggatgttaaatgtactggctaaaaacatgagctttggagtcagatcagtgttcaaatcctggctctcccgttattacacatgaacctttagcaaattccttgaaacttatgatgagaatgccctcctggttaaatgaagactgtttcatagaattttgagagt

SEQ ID NO: 124405 - DNA, 1048 bp, Homo sapiens
gtgaaatctctcttcatggtcaggacagttactgagcaacaggaaacacaactattccttataggcctggtgccctgtttttttccagccctcaggttgggagcctttcgcatattttgcatataacctctgactttgcaatggaacggaattttattatatttaataccatataatttttttagtactgtattttttggtggcttttaaagccactattcaaaatctttatattacccaatactgccaatattctaaaattcttgtgcaaataaattgtgtcattatgtacagttaatggacttagtaggcaaatcaatttttatttttttggttaaagggctctccattgtgtaagtgcctttaaaacatgcttattagttaagcatctcaacaatgtggaatgtgggttggttttatcactctccaattaaaagttattgctccataacttccaagaaaggaagttaggcacttggagaaattggttcagtattacattgtgcaaatagaataaataaatccagactactgattctcaacctgttttctgccctaaatcatcagagagataaatagattctctgttgtaataactgagtctcagattctagctcaggaagccattatgccttctcagtactggccttctaaaacttgatatgttcaattttcaaagaaaatcaatttagaaagaaaaaatatgctttgagatgataaaaaagggaatagtcatgtaatacaaaatccactaaagctacatttctctatgccttatagaaatggacaattatttaaatattaaaacataccactaccccaattatatattttataatataaaaatacttcttaaactaagtagtagtattactactgaaatcatctgtgtatatttgatatgggacatggataatgggtcacatcttgacaagcatttcaggcctattgaaagctggttgtaacaggatgcagtttgcatgaagggctcattatgattatatcttggacacagcacagtaacacttttcttttctttttttttttt

SEQ ID NO: 124406 - DNA, 1034 bp, Homo sapiens
gaaaatactcttctgagtgtttccgttctggattgttattagtaagaaaaatattttcacaatgatactatcaagcataaaattcagcaaattataatactacccttattacacagtctcaggaaaaaaggtaataagtattattttgcatttagtgatagaaatattaaggctcacaataacaattgattttaaaataatgattaattttccagctaaagttgtcatttgacaagcatttactgaaagtacttgagaaaacgacagcagtaattatagcagtaataaagcatagcaggctagacttgcctctgtaatgctcatgactcttgtgtaatgtagataattagcaaactatcgaaaccactggaggaacatcctgtaacatggttagggagacctttgtcctcagatttgttagctaatgacattgtataaggatttggcaagtaattgaattctgttgactcttaaatgtttggtaatgtacagttaaaactataaagtctgacagaggacatggagttggtaccttttcttttaaatttttcacagcaatcttccagtatgttcttatcttccttggaaaacctagtgtgtctgtctcccagcaggtgaaatgaaatgacaatagactttcattttgaaattcagcaatttcgtaagcttattgaaattttgtttatcatttgctaaactttactggtataaatattacatggcagaaataaaattataagttgtacattagtttattcatttaaacttttgtaacacaaagatcaagaaacataacatattctgtatttttgccaacaaatatctaaaatcattatattttaagttacaatatctgcaatcataataaatataggtcttttaaaatataaaaatttgaggcataaaagtaatatgatatgttccaagtcacaatggcagtaaatataaatgctaaactgaaatatgaaaatctagttgaggatttgcttagagtaagtttgtaaaatttgttttgaagaaagaaaaacagattg

SEQ ID NO: 124407 - DNA, 1015 bp, Homo sapiens
acattttgcctgctctaagaagtttcctcactcctccagcctctactcctccccacctaacacaatcataattgatcccttacttccagactttcctctaggatcttaagtggcacattattgttaaacatttttcatagccctcctatcgtttacctatgtttgtggttatctgcctttctaaattgtgagacgctaagtccttgtcttagttaattttgagtttccctctgcatcagagcacgttttatgtgtgccataaaatttggtctaatgtctttggcttagcttgtttgaacttcttatagttccaaacacatattttggattactccgggaagtataatgccttatacctatatctgccataaatatctccattcaattttccccccatttcttcactggacaacgttcacagttggccaggagcccaactactgagagatcttctttaccaacatatggctgaactgaatgattgcgctggacttgagtatgctcatttaagtctaatgaggtccatagaggtgactgtatgactcataacatgaagtcatttttccaattagcattctgacaaatgcattagaaagagagccctttcaatagatttccacagctgctgaagggatcaggtgtcagaagattttcagctttgttcggctgttctggtcaaataacttatttttacccagactttgccacttgatgcagctggcagtgatcatatgtcatctgagcctgagcccagtttaaaaatggtcctgttacagtgatagaacttaagaaatttcaggagggatcagctgtaacttttgattgactcattagtcttttttaaaaatgaggttatttccagatagtataatacaaaaaaaatttttaaaaacaaccccattcatgaggattagcacttggtatagaacatgtatttccaagcataataaaaaggactacagaccctgatattaccctacaataacacctaattcaactttggccttccaccacc

SEQ ID NO: 124408 - DNA, 2011 bp, Homo sapiens
ggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataac

SEQ ID NO: 124409 - DNA, 1025 bp, Homo sapiens
ataatggaagacatcattccccttggttggttatcatcccttgttctaaactcagtagcatttaacatagtccagcaaatgaagtagtagccctaaaaatgtttattcaaaagcaatacagaaggaagcagtgaggaaaggcagagtccttgagagattgcataagcttgattgcatgttacacattttaattcatttattacataatttttaagtatagccagtagcaacccgtcaaaggaagtccagtacttaaagcaaatgtatcttcctccacagccccaaacaaaacaaagcacattataaaacactcagaggtatgcaggccatttattttattttattttttctccaaatactttgaacaaagaaaaaaataaaggaaaactaggatttactatctcagctttgttcctgatagtgctatttttatgtttatggtcatttcatcatttcacctttaagatcttaattttctttgtatgaaggactaaagtaaataaatgtatgccagactcctctgtttctggcacagtgctctgtgctggagacttccatcccaaccttgcaatgggctttctgaggcgccattcctgtctccatttcacagcaaaggccactgagaggtagtctaagaaacaggtccaaattcataaaaactactaaatgttcattctttcaaacctaggtacattcagattatttgaattctctaaagtggttcctcttacttaaattcagggcaaaagaaacaaaaaatgttctaaatttgaattcagagcagcagcattcattgacaattgttacttttccctcaaagatataacaatactttataacccaggaacacactgttgccccacatcaaaaatcaactagcaaatgccttgttgatatacaggaacatggaggtgttgtgtcaccttcagctttctaaaatctcatacctttacacacacccatacaaagtgactatcaaagttaatagaaagaactgtattcatccacccatccccccaccccgg

SEQ ID NO: 124410 - DNA, 1050 bp, Homo sapiens
tttacctcaactttatgaggaatatgacactaaaacaactctaagactacattttattgtttttaaatgtccactaatacccatgatgctgagaatgaactggcatgataagtatcaaactctgtggtatttttaaaaatcatatttctctctccagagacctccacaacattgtattaaagttgttgtgagtatgtgagtattttattttctaggtgcatcctggtgagtttctagaaaataatcctttataaatgaataaggattcagaaattattgtttaaggagatactaatactttattttcacatcccctccaggtttgcatatagttcggctgctatgcctattaaaggttcactgatgtccatagttaggtttttgaatgaaatattctttagaaaatgctttcatttcttattgcctccccccagcgcccccacccccgcttcaattcactattgctcagaagatttacattaaaatgaagtttatctttgggaaattgagatgttcctgccactgtgattgtctgctgggatatatgatgttgtccctgttacatcgcatctctctactcttaaaaaacatactgatgcatgtcattaaagtactttatttcttcattcagagaataaaaattactgagagggaaaatagctaggatcggtatttctaaaggaaaaaaaaaacctggagaaaggttattactaataaagcaaagagagacagaatgatctctttgaaaagcaatctattttagtatatatgacatagcaacaacttggaattttatggaaatgaaggcgctccctagccctattagataatgtcctcttggggttgcctaggtttgcgtggcagctgcagtttcttctcagactaataaaaagtggaaattaatgagagagtgactttagctggggtaggaaaagcaagctacactattctgtatactgctttggctagcctggggtggtgatgaggtagggatatatatacattgaggagagaggattttttttaaagctctattgaaaaactcttaga

SEQ ID NO: 124411 - DNA, 1031 bp, Homo sapiens
agttttaagtactgtggttaaagtactcagtttaaatacttgtgaggatcacttaaaaatagtgttattaataataagtcccatatggtgaattcttacagtgtgcagatactgtgcgaaatgttgcacataacttactccacgtggtcctcccaacaacccttttaaggatgtcattattattattattcccactttacagatgaggaagttgggagttagagatgttaaataacaacaaaatgtcatactcccatgcaatgtcagaactgagattcaaaatcagttctatcagatgacaaggtgcctgtttataaccattgtgctgtacttgtactaatgatccttaaactataatctgtggatgcataataggacagtgtgaatatgctgtcatcttaatatttttgcatgagttaaactacagcttgttacggttgttgaactttgtacattttattcgtgaagaaacagaactgaatgcatatgcaatgcctccttcctctgccacaaaacatttgcctttgaagtcgccgcttagctagtttggatcatagtcaagcatttaacaaaagttaaaatgtaatgccaaacttcattggttggattttttattagataaggtagaaatgaaagcagcaggcaatttaattagcagtaatttttctgggcaagtcattactttgatgaacttcagagcaatgtttatggctcctaattaaccatgttagtcatttgattgaataatcactttggaaatgtttctacaatttgattagagtctgacccactctgatagtcataaattaactgatatcacttaaggataacatgactttacttactttatggggataatctccccttagccatattttttcaggcttctctggactgtataaaggacaccaattttaagtatagaccagatttaaacaatgctagccaagtgtatccattttaagagctagatgttaattttatttacactagagtataaatagtaacagcaattggcaaaaacacagtcg

SEQ ID NO: 124412 - DNA, 1056 bp, Homo sapiens
acctcatgatccacccaccttggcctcccaaagttctgggattacaggcgtgagccaccgcgcccggcctcatattttcttttaaacctctgttaattgtcagagtatggtagtatgaaataaatactcaaagttggtcaggcgcggtggctcacccctgtaaccccagtactttgggaggccaagacggcagatcacctgaggtcaggagttcaaaaccagcctgacttaagatagtgaaaccctgtctctactaaaagtacaaaattagcagggcatggtggtgcatgcctgtaatcccagctactagggaggctgaggcgggagaatcacttgaacccgggaggcagaggttgcagtgagctgagatcgcaccgttacactccagcctgggcaacaagagcgaaactccgtctcaaaataaataaataaataaataaataaataaataaataaataaatactcaaagttacagttgtgtctatgttttctatcacttcaactttattttaaaatttcagcttagtaagactatcacaggcttgtaaaacttgtaatagtgcgagcctagtagatcatataatctaatgttgtttggatctggtcattatttgtgtggggtattgtccaaaagaaaaccccaggtgcttacaagagaagtttataattgtgtagataaaattctatactgttatttttcgccatgtagccttaaactttcaaaagcacgtaaattcagataactgcgataactgcattatttacttattctacttttactttttctttctttactttacttttacttttttttttttttggacaaggtctggctctgttgcctaggttggagtgcagtagtatgatctgggctcactgcaacctctgcctcctgcgctcaaaccatcctcccatcttagcctcttgagtagctggcactacaggtgtgtgccaccacatccagctaacttttcaagtatttttggtagagatggggtttcaccatattgcccaggctggtcttgaactcctgggctcaatcaatcctcccacct

SEQ ID NO: 124413 - DNA, 1022 bp, Homo sapiens
agtgcagtggtgtgatttcggctcactgcaacctccagctcccaggttcaagcagttctcctgcctcagcctcccgagtagttgggactacaggcgtgtgccaccatgtccagctgatttttctatatttttaattagagacaggggttcatcatgttggctaggctggtctcaaacgcctgacctcaagtgatccgccagcctcagcctcccaaagtgctgggattacaggcatgagccactgcaccctgccgtaaaaagcattttctaagtcagttaactcagcatctatgatccaaaggctattcttacggaagacctttagaactctttattgcttaattctatacaccataaatgttgtgaaaataaaagaagcctcgtaagggaaaaggtagcttatgattgtgctctaataaagcctgacattaattatgacatgggaaatggaaggtctattagttataattataattacaggaatgcaatttcaactgcctaatatttaagataaaaaatgcaaaatagtatgttagtagagtataaatttttattcaggagaaaagaaaaagacttcaatcagaagacagtgaggaaacaagaaatagatatttagggctagcttaatgaaccagtacagtatgatcatgattgtatcatgatactaggttctaaaagatccaatccaatccatctattattgtccctttccttctcttctctagcctattatgctgcataaagcagtacacattttttgttgttgttggttggttgtttttgtctaaatccaacatgatattttttttcatgcccttatggtcaaatgcccacataagaagtgttaaatacacattgagtgcttcatctggagtgcgtcatggagattcccgtagaaagtatcctattttcttagagtcaagactgttttctcattttcatgaccacatatgaggttttgcaaattcagaatgtccagtgacgcaaatattttagatgtttatagcaatatattttattag

SEQ ID NO: 124414 - DNA, 1093 bp, Homo sapiens
ttgattccttacaaagctttcagttacaagtattattaacttccttttaaggcttcacaagtgagccagtttcttattttaacttcaagttacaattttctgattcactccttgacagttcttaatgataatttctgtttctttttttggctaatgaaataagcaagagaagggaaatgaatgcagtgccagtcagcctaactgctctgcaatatccgagtttctaagtttattttctgcaggtgtaggtggaatttcagtgctttccatgaccaccagtgagcctagagttaaatcacaggatggagtgttcttagaaatgctaaagcaatcgctttgccattctttagcttttaccttatttttatttaacattaccgaaattaaatgctaactttccaaattaaagtctcaggaatgcttttagtgggggggttattaggcttatatttgctcatagaaatgttttataggttatttttaagcactcctggggcatttttagagcacttttaaatctttaattaatccacatctttgtggtgggtcaatgatattatggatgagaaacacagaacagaacgattatgtgattagccaattgttataaagtataaccaagaacaaagaggcataggactcatttctagccttctgctgaggcctcagaacttcctcatgtcctaacagcgggacttgccccaaacctatacaacactatatgttattttcacctttggagatcagctgtgcatttatgcttatttttatcaacctgatactgtatttgaatctattggaagccaatatggtctgcattgctgtttgacagtaaagaggtagtctttttacaaccggcttgggtttgagtccttataatacctagttttgtttcttactagaacgcaatgttaattaggacattgttgaggaattgaaagtcctgatttgagaaaaaagtcattcctctcttgctttctcagcaggtttttggttggttggttttttgtttattgatcagtttggtaacagaattaaaagatagaggatgcagtttgagatctttttctggtatataatgatttaagaatct

SEQ ID NO: 124415 - DNA, 1031 bp, Homo sapiens
catatggtttctgttacaactactccatttggccattgtagctcaaagtagccctagactagaccgaaatgaatgggtgggagagtgttctactaacgcttcatttacaaaaacaggtggaaggccggatgtggcccatgagctgtaatttgccagcctctgttctagaacagcatacagaagactattctaaaacatgatttttgaacagaccagaaaacgcaacctcaaaataaagagactgtcttcaaggctcttcctccaaaactatggattttatttctgtttagagaagaattaaaaatatgacgtgtttctcttcccagggtaattgtttgctactcacagaaactgataaccctatttcactcttaagacaagagttgggaggaaagcagagtgaaaggtcagagccaagacaacttatcactgtatttactttcgctgtccacatatagaaggagacctttccatcattgtgacattttggttatcagagtataagggaagcttcaactgttgaatagcaacattcttccttcagtggaatatgagtggtgtgaatttttaaatgcctttggtcacagtaataaattgaaagaaggcagattgcctaaaagcaaacgtgaatactctgagaagtgtttttatttagatacacgtgccaagaatatagtactaaggtcatacatacagatacatgtatctgacacacgtgaattagtcaaacttaaagaatactgcctaatgtctttattagggaatttttaaaacaccaaataaagctctaattggacttccatgagctcttgataataaggactgtgtcttactatttatcttcattccatagctccatattccttcaccctctcaggacctgccgtagtgtctggggcatggtagatgaattaacaaatgaattaatgaattaattgctgaagaaatgaatgaataaaaatctcatataatgtgatagtggtgctcatgcatgaaggaaataatgagtgtctgtgtataaatcaatttga

SEQ ID NO: 124416 - DNA, 1059 bp, Homo sapiens
aaaaagtgttgcactggaaacattctgatacttgtaatacagaccctactataggatcagttagcatcttatgtgtaagattatgggttatgaattctggccaatcaaggacaccctaatttgtgggtctaacaaaattgcttctatcctcaatgtttttttttatttcaaagttgatgtattcattgaaagggaaaaaaagtgttgatttttcaattaagatgcaacctttacaatgtaaagcaataataattatagtgttcgctcagcctgaagaaaaaatttcactacttaaatagcaataatcaagatgagaactacattagaagggtgctaattttatgatcattgctatttaaataataaaaatgaatccacaggacccttgctgtaacactatttgcaatgaagtggtattcagctttaaaatggtcctcttgaagcccatttaaaattaatgggctgcttaaattgtgaatgaccaaagatcaccttataaaatagctacttttccaatcaatcaattattaggctatggctgggcttctacaggaccagatgtatttgacccaaagtatttcacaaatattagtgcaatcattcttatataataacagatttttctttttcttttttttcttttttttttgagatgaggtcttgctctgttttccaggctggagtgcagtggggcaatcatggctcactgcagcctcaaccacccgcgctcaagcgatctcccaactcagcctcttgagtagctgggactccggtgtgcgctaccatgcccagctatttttaaattgttattattatttgtagaaaggaggtattgctgtgttacctagcggtcttgaacttgtggacccaagtgatccttcctcacaaagtgttggcattgtaggcattagccaccactcccagcatatgataacagattcttatattttcagcccccaaggaaaatcaataacaacaacaaaacaaatcagaatttgagtttcatcaattggattctgcatgctaaatataagaaaaataggttctagtttttctctc

SEQ ID NO: 124417 - DNA, 1045 bp, Homo sapiens
tttgttcagcattttagatttcataggccattttcacatcctgtatctcatttgattctcacagttaccttgggatatagacagagtagacaaagctcatacagttttagtgtggttcctatataaggaactacattcataggtgttgaatggcagaaccaaaactcaccttgtaacattttcccttgtatgcattccagtaaaatgtacaaagttgttattcattgatttgccatgactatacaagtgaattaaagacgtaaaataagtgtttttgccacatccgtgtatacatatatatattcgtatgcttgtgtaatacaataaaagaaaaatggaaaatttatcaaaaatgatttttattcttcatggaattattctaatttataacataatgcacaaactaatacgtatatggaaagcaagggtggagtgggcaatccctgaagttccctgtttgtctatgaaaatctttatgcttgtgctttggattgtagaaatgtggttaagttctatgtatacataggtcttcagcttcaggaatcctgaatgtttgcttaacaaaataatgatgctctcaaaagagaattttaaaattggtttggactctatttggcaacacataattaggccaggaacatttgctaatgtgctgaaattaattgaatatcacattttgcgtcttgtctgatactacttttttatattatttcatgctgctgatagtgttgatgttgaagacactaaagccatatgatataaacgtgatgagatttatctatgggactgagtacattgtactgtataagagtaggacattggacctaggcctcttgagttcaagtctctactatttactagctgtgtgaccttgtacaagcaatttaagatcattgtgcctcagtttcctcttgcataaaaatgggataaatattatctcccctagggtgactaaatgagtatttatatatatacacacacacacgtgtgtgtgtgtgtgtgtgtgtacataacattgtatatgtttatgtgaaatatctaagta

SEQ ID NO: 124418 - DNA, 1100 bp, Homo sapiens
tccagtatcttattccagatactggaataagaaatacttttctcacccattttgttattcagaagggtatttttaaattctgctacatcactagcacaaatgtatatttgttggatgaaggaatgacttcaattcaatatttttatgccaggttttgtctcgtttatcaatgttaatgtatctatgcataattcttagcttagtattatgtcgatttttcacattaagtatgatcgtgatctataaaccaataccaagttctggataaattttgattagaaatatgtgcccccctttttccatttatcccccagaacttttcaacactgaatttagtcctaaaccataagatgtttttcttagaattatttccagctgcagagttaccagcaaaagttgttgtcaaatactatcaaggccaccgaacatggttaaaaatggctcatccctataaagatgtatgggtagtattgaagcaaacctctcagtagtgttagcttttcctctgaaatggtggtcctgctgtgaagtgaacttttactgctgtttggggttgtttttctccatcctcatgaacacaacagccttattatgttgatttgatttgattccctagtccttggcactggggccagaatgtcaggtgatgcagttgtctcaactcacgggtctgtagggaaagccaaatagctggatgtcattgctgtgtttctctggatgtttttgccatctgaaatctccatgttcctgtattctttcaggaaaatcaatccctgttttcctttgtgaaagctctattttcattcatagttttattgcagattaaaggctgttgcattagaaagttatcagctaatcaataaacgtcagtcatcccattttgtgataaagctgtcccattgatcaaagtggaaatgtgggcttttggcttttacatagcaatttctgaagttcggataatgtgcttatggaatatatagacctatcctcttatttataggtcttatgtagagatggacatatgaatttatgtgtacgtaatgtacatataagcaggctaatatatacaaacatctgaattttatgtaaaatataacatt

SEQ ID NO: 124419 - DNA, 1033 bp, Homo sapiens
taattttatacttattttaacaaaatgtactctgtccaaaggcaaggccactggattccctagtggatgatggctatcagtgtctgtcttaacaccttgttgacctatgctaaaattcatgttataggggactgacaagaatatctttggacttttaaaaaatgaggtactctactgttaagtattactatttacagagtattgtcctattcattgagatcatatttgttctttaagattcagatcagatgttatttttcccttgattatcttagtcagaattaacaaattttatgtgccaatacatactttacatagatcctaattttaatcctattttcattggcttgtagaggatggttcatgcccggtttatgtgtatgattcacatgtttgaggtattcattgaatactgaattgaatgaatagtttcttgggtatttagaatcttattttttaaaaaacgtattcatgcacaggtggcttgaattgtttgaaaacgagtgccaatatctgcttttatttccctctgttttatttttctttgagggctaatggaaagctgtttgcatttatgtaacattagagctaaatctcagttatcagattagggcactctaataaatattattagatactcctatctcaccacacatttctcaataatctctattaggacaaatactctgaaataacttgatattattcctgttttacatgaagagaaacccagggcataaaataatcaaatagctaaggcatgtgatgactgaaattacacagctgagaatcccatctcatggttgcttagtctatgcagatcttccctccctgatagccaatactcagactacacgtacaagcttcaaaactgtttctattctgaaaaaaaaaaatctgcgtggctaacaaagaatgtgtttcactaatagtttttgaaaattattctcatcaaggtatgatagatgaagagagaccaagagcaccttccaatagaggtttgtctcaagaaagatgttctgtgaactcatct

SEQ ID NO: 124420 - DNA, 1050 bp, Homo sapiens
ttacttaccctccctataattagtcacaagttattttgaagaaagtgatctataccttctttggttgaacttgacctcatattaaataattattttgttatacaatgaatggacttgatagaaatataagccaaacaatatttattggaaaaatctaggtaaaggatgtcagtggaaaatatttgcagaaccaaatattatactttttgtccccatatttttaataaatacacatacatctatatattctgatatgtaaaaaagtaaacacaacaattattagtatttgaaactaaaataaagcagtcatgaaaataaatatatttgggggctaccacctcatagaatatgtaagtttcatgaaataagatataaagaagaaataacctgagctaaactagtacatgtggaccttcacatcgtaattgtatgcttagtgtttgttatgggtttttattggtatcatttttccactttttttaaatcataataaacatgtatttaagatgcacaatgcatatttgcttctgtctgttactgaattttttcctaatgagagttggtgctgtatcttactaggtaaaaattttggttagatgctattgtttttttaaatctaaagcactatttgcatttgacagtagctaagggtaatgttaactcaagaactccattattggcaatatatcaggaatggctagattaaaaatactgtttaaacaatgtctgattaagctttaagatcagaaaagtacctttgtgcaatggttttgtatgtaatcttttgaatcttttgtaaatctagagtttagcaaagaagtttttttggtttgttttgctgtgggtatgacattattaaactattcagagatttgtttcatagttactcctagttattgcctatatagtcctgttttgactagtttttaggtcctgttgaagaggcttgagttgtgatggaccctttaattatcttttattgtagcagaatcttgtattcacatttctgtttgcaaaattggaatgattatattttgcaaatgagatccg

SEQ ID NO: 124421 - DNA, 1091 bp, Homo sapiens
cccggattcaagtgtctcttgcctcagcctcctaggtagctgggattacaggcatgcgctaccatgcctggataatttttgtatttttagtggagacggagtttcactattgttgtccaggctagtctcaaactcctgacttcaagtgatccgcccgccttagcttcccaaagtgctgggattacaggtgtgagccactgtgcctggccgttatatcattcatctttgaaaatctaccacctttcattttgttcttcgtaacaaagttatgtgttatttttagaactagtttgtttccatttggttacattagttcatttcagtcttttctctgtagtgattcacatgatagtgactttcacatttacattttatcttcttccagagcatttccaggagtgtgcataagtcccagggttatgcaaaattcccaacagaatagatccttgtaactctactgctttgtcttacactcagtaaaacacactggaatgcaagtccattggaaaaaatgttattaaagaaataacaataaccctgactcttcactatttacaaaagtaaatcttttgcaaacttctgtactttatcagatatctgtaatacaatactagaggaccatacaaaaatcatccagacagacccttgtgtggggactcaactgtttaaaaccactaatattattacatggatggcactttaagtaaatgaaaatcataactacactttgtttctttaagaatttctggttttaagaatagcatttgggtcgggcacattggctcacgcctgtagtcccagcactttgggaggccgaggcaggcggatcacctaaggtcaggagttcgagactagcctggctaacatggcgaaaccccgtctctactaaaactacaaaattatctgggtgtggtgtcgcatgcctgtaatcccagctactcaggaggctgaggcaggagaattgcttgaacctgggaggtagaggttgccgtgagccaagatcgtgccatcgcactccagcctgggtgacagagtaagattctgtctcaaaaaataaataaataaaataaaataaataaaagaaagaatag

SEQ ID NO: 124422 - DNA, 1013 bp, Homo sapiens
aatgcgcaaggagtgatgcatggagtactcactgtcccttaattgcagagtgagcgttttgcctgtacaaacgtggttgccttggggtttactgctgatatttataatctgccattctaccagctaactgctgctactgaccaaaggagcaaatactaaggaaaagggtataaatgccatcttaattatgaaactggcctaatgcatttttgttctgttggtgacatctaaatttgttttattttttctaatacagatacctgcattacttcaagtaacagatgttgtgggcagtgttttcagcatttatgtttgatatgttaaatttctcaggcgtagagggttgtgcaaggttttgtccagattctctaacatgttacatgtttcaactcagcttggttataaagaaattactgtggtaaaatatacataccacaaaatttaccatttcaactatttttaagtttgtagttcaatggcactaagtacattcacattgttgtacaaccttcaccactattcaacttcagaacttttttgtatcccaagctgaagttctgtacctgtaaaacaataactcccatttctctgccctcagtccctggtaaccactgttgtattagctttatttttgatccgagaagaaaactgtataatgctgtttgatgtctaaatacaggtaattgacataggctttcaagaaacttactcagcaactatatagaccttaattagacacccttagaaacactcccagaaggatgatggctaatacaagtcctccccttcttgattaaagtatgggaagagaatgtcatattgccaacatttcccttcctatgggcaattgaattcttctttctaaaagctaaacacgtcgtctgagtaaaagaattaatctcgttgatattttacatccaaagtaattggtaacaattccaatactataccaattgtcagggtaaaatgaaccacctataggtaattttttactccttttcttatttgacctc

SEQ ID NO: 124423 - DNA, 1055 bp, Homo sapiens
cttagctttaaaaaaaaacccaacaggcacatagtttgtaagaataggagggttttcgcttccctgcagccaaccttggaaactttttcatcgcttactttttcttaagtaatgattattatttcatttgaaagttaaaaataagcataacataaaggcaagctatatttaaaattacccatctctaaggcaatattagttaagaaaagtattaaaattaaaaaggagaattggtgagtttgtgacatataggtcatgattaatatttttatgaatttctttctgataatatgcattgatacgtagcaaaaagacagaaaacagtaaaacaactttggataataatctaggtaaaacaaatagctgagagtgcagatactgcccttttaaagccgacatcctgagacttgatggcaactggtctattaacgtgcaatgaactgatagagccgctccagctattaccaataaaatccacatgcttaatctccttgaaagcattttattggtcttttggtatatactttctccccttctcctttcctcctcttccccttcgtctttaattacatagtgtggggaaacattttcattccccaaaggtgattatatccagcacagtttataatagatagtagtggaaaaaacattgcttttttaggctgacctctattgttaattttcaactttggagttggtatggcttgctgcaagttttcaggcagctgcagtttgctccttcacagtattcccctgaattgaagaaaaaaggaaatgtatgatacaagtgtggcaatactttgtcatattttccttgcctagatccaacttgtgtttttagttaactgctttccgtttactctaacttgaaattagaggtatacttaagcctttgtctatttaagtagcatgctgcttcgtttggtctattcagtttcttaagattagcttctgtgaaaatgtgagtcatatgttttttgttaaaattctgtaatatgttcaggaataagtgtgaagtatttattcagtatgttaaggagttagaacagaaatag

SEQ ID NO: 124424 - DNA, 1064 bp, Homo sapiens
tgtaaatgtgtagctgctctcttgactgttattttgtttccggtctagatgttctttcaggttcactttcatcaacaatattctctgtcttcagggtaaaatgttttccagtggttttgtattgagtcaagtttagtgctgcctccacacttcgagtaggagttttatctgcaagaacaacctttctacagcaaagcttattacatcatacgaataagggttttttccttttggttttatgtgaccttcaaacaacagtcaggtcaacttaaaagcagagatgtcattactttcccctcaattcgctttaatggctgatggtaaatttatattcaaaatcataagtaatatgtgctattgttacttactatgtgtaatgtcatccacaatatacagtagtcataatacactcatttttatttttcagaaatcctacttttttttaatggaacataaaattggttatgtgctcatgaattattttcccccacttggtgcaataaggattaaaggctttaaaaacgacattattttatgtggtttacataaaacatgaatttagaattaagcattgaattacagaactccatataatctcttataattgaacaacaataatttcatgtgtgtgtgggcggggagaggatgggctatcacccctctttttgatgtgctagaaaataatctaaaatatgagagaaagacttcccatttgagtttgacttaaagacagcagataaagtatattttatttctaaacattcattggaattgcataaatgttttttcatccatgttttatttacaaaatagaaattttttttaaaaatagaaaaataggatttggtgtagtatagtgtagtttttccagaggatcctaataaataaaatattgctaagcttttctatttcagttataggaaatgtgcagtttgttacattttgtagtataactttattccctttgatttgtgtataatgttataataaaaaataataatagagtcagacctctgtagcattagagaaaatatttggctagaaacaacggctagttggctctg

SEQ ID NO: 124425 - DNA, 1049 bp, Homo sapiens
ttctcttttttttttttttcatttctctactctttttgctttttttttttgtgggggtggggtggggaggaggggctgtccaagagagaataaaacccactgttttaatctagcattgaaccagcctaaaaacaactttaagtgtaaatgcttcaggttgttttgatgctgagataccatgaatatatgattgataaatagtaatgtgctaagatcggcactgggaagcaactctccctgcctgcttaacataagctttcactgtcaaataagtgagaaaatgaatattagagttgatactatggacttctatttttctattcagagaagatccattagacttatgtatgcatgtctgtgtgtgtgtgtgtgcgcgcgcgtgtgcgtgtgtgtgatctgaggtttacattcttttaaaggattttatctttccctttgtagagtcagcgtgggagaaattgtaacgagaaaccaacaaatgtcaggaaaagaaaattcattaacagagatctggctcatgattcagaaggtgaggtttgattttgggctgaatccccatttttttacctacactctccaccctgctaaaagaaaaggagcacttcagtcttatcttaaaaataataaactttgaaattactgaatctaactaagactttaacttggaacgatttacataatgcggcagtttgcatgggagactattttatggtcctatcacaaagtaatgaaagaaggaaataaaaacttctcaatgacaaccttcttttaatcattgttttgtgtttaaatacctttgtccatggggcatataactcaccccattcactaagataacaatttaaaaatatccaatacagtgggacaaattcagcagctatgtacactgcttacttttttctttctcctttattacaagttaaacagtattagtgattgtttggtttcccacctcctttacactaaaaccatctactattaacagaattttcaagggtgattttgatgactaaattgtgaggtcataataccttgtttatcgaccataa

SEQ ID NO: 124426 - DNA, 1155 bp, Homo sapiens
tgaaggtgaggattggaaattcttattccaactgtctaaggcatctaccaatatgtcagctttcaataagacacatcgtatgagttgatttatgatctttgcctcttcaactatttcattttttttcttggttgtcagtaacctctgacttcccatcttgcttctctttgaattaatggaaatcacagggatgctcagacatcttggagagatttatgttgtcgggcagagcttggcactaggctatatattactcccaccagctcttaactgagtctcaattggttccattttcctaagccttcctctctaatgtccttttaaaaaactttctagtatatcacaaaattgcatttattttatctgctcttgtctaggttgttaagaacttgcatatgtatcttggcattttctaaactactgaagatttactttataaactactgatcacacagacctcagcaaaacattggtgctgccaccttccccaagtttctccagattttcctccataagccaccttgaagctgacattccagcctcccacatttcacattcatttcggagttcatatttctgttgtctatctactgcttgttcaaattttctttccctataactttctcaatagcctgacaaatattttgagttttcagtgcctagtgacatgtagcagaagctatgctacttatgcatcattgtctacaacacaggatctgtgtggagattacccagatattatgtagaccaccaaactaaaccataccccccataagtctttcttctccataaggcgtctccacatttcaaaaataaacaatgcacaataaataagggataagttattctgtaacagtctccttgacccaatatttcctggaagaaatttctttgagggataaatctgataaacatacataatatgggttagttatgactttggagtagaaacagcattttcaaagagtagtttcttccatcaagtccactgctagaggttgagatttctccgtgtagttagtctgtctgtctgtctgtctgtgtctgtctctctctctctctctccctgtctttctgccccgcaaatgctctaggcctctctattattcagtttaaatgccacagaagaggcttctgaaactttcagtggcatac

SEQ ID NO: 124427 - DNA, 1063 bp, Homo sapiens
tgtatatcgattgtaaagttgtaatacaatgtgtcaggaaaaaataaaagaaaacctttaagctttaaaatatacaagaaattacggacccagttaaaccttaagtgtataatcctgtcaaaatctgacaggatttcaaagtctccaaggtaaaccccaatgtgaagtaaaaggcaaggctaaaatctaaattgaattttgttttctaagaactgcaatagattatttttagttttcattactcattttgatgaagaacaattttttttaatgtaatattccctttggcaagatgccattccttatctgtatgggcttggttattttatagattgacatgccaggtcagaaatgataacatttagtcatgaagaattctgacaatgtttggattaaaacacctagaaggactgtccttagaatttgaaaaaatgttctatctttacctctaagacaaacagtggtgaggatttctttctccaagtgtcttcatggagctgttttatgtcttgatcttccctgaggaatttaaaatttgcatccatgcaaggaagcaaagaactaacagtttactaacactgatttagtgcttaaatatgcaacagaatctgctagattctgaagtattgcctttaatttcacctcagctttgaggtagtcaccattttcccacattatagttaagaaggaaaatttaccttctcttccatttctaaagaggaagaatggaaagtggaaaattggagaaattgaggagaagggcaatttctcattataggtaaaatgatggggagagttaaagggaagaagtgagaagaaattgggatgaggggcagagctagagctactattccacatagaaggtctgtgaagtccgaggttaggagttcgagaccagcctagccaacatggtgaaaccccatctctactgaagatacacaaaattagctgggcattgtggcacacgcctgtaatcccagctactcaggaggctggggcaggagaatcgcttgaacccaggagatggacattgcagtgagccgagatcctccactgcactcca

SEQ ID NO: 124428 - DNA, 1164 bp, Homo sapiens
atgaaattatttttaattcgactaagtgtagtcattggagctttctttaatcaatttcagaagcgtaagttagatttagggatttttttttttttcatttgtggcattctgtgaattggtcatgggtattcagattgtgaacctggatataaagaggagggatgaacgttattttcggtgtctgacaagaacaagcatggagtctttgaggtcttataggaagtaaacagaagtctaagaggtcacacacgtgaggagaataggtgattagccggtgtattttccccagtgctatgtcattttctcggagtctcatttaaaggataatatgcccacagtaacagaaagaagatgtttttctcagacacatcccatatttactatatgaagtgtggagaaatgcttattaaagatttttgtcatgatttccaggttcagttcaggagtgggtggtcacttgtgctaggacttcatttcttacagccctatccccacatcatttttccatggaagtaaatattatctaatgagataagcgaaggcatgttagaggaaaagcatgatttatagcaaactgtagcttcaaatggatttatccatagtagtatactagtctattttgcaagtgtacatttctcatctatcaaaaatcatgctatttagcttcagaaatcataaaatgagattgtccctggaataacttttaaatatctggcatttctttcctatgtaattttacgtaagctatataaatagggttagctgtgacctaaaaaatatactcagtcattttgtctggaacacaatatagcatgtgccctcattaattttatctgtgggatttttaatggtataactttgcaagataatgaaaactgtatggaatgaaaagactctcagactgaggaatatcattagattttatgattaggtaaattctgacaagttgatgcattttttaatgcatacatgttttacttttcctctttttcattgtttttatacatcacccaaaggggttaatgtatttctgtattatatttatcccaggccaatcagaaaaataattgaaaaacttattttgactttgcagaaatacttccttgacaggtctgggttaaaaattatgtctacttctatcaagtcaaagttgtccctatctta

SEQ ID NO: 124429 - DNA, 1002 bp, Homo sapiens
aaaaaaacccaaatagtagaataagtggttcatcaaagatgttttgctcttgtgggacaatagtgtgaagttgtgaaaaggtgatttttaattgtttcttaaactcttatttccctttagaaaaaacacactgattttaattcaatcatagctcataaatagtgaatcatatctgcaagcagacattcaagacttcactaccactagagaagagtaaagtgatggttgatggtgggaaattcaatccagaaaccctgtcctacaaattatcaggttatgtgataattaaaattctaattttaaattctaatttcaaattccatttttatacatttatttcatttagtattcaaatattgtatctatgtgaactgtataacacgtagggctttccaaatacaattttttttaaagtaccatcttaggtcaaactatcctattttagtcttctttctaatccacatgaatcagttatcaaataatcaggggaaggacagatgggatgagaaatgcgcagctatttaaaatgtctttagagttccatcaatagagtaatctcggaatgagtttcccccagtgaggcagctgggccatgctttataatacactttcttttagaatcccaagttgtgtattttgttctgattgttcataatgagatggaattgtgaataaggttatggagaagtcaactctatatataatttctcaatatgaaaagaagttttattgagtttcatcattttcttaggtttgatgatataggacttgaaacttactttctgcgttcaaactgtctggatgtaaaatccttactatttggatgaatttaagcaagtaacttaaattctatgctttagacttctccttgtaaaacaggaataatgaaaatacaagccatttcataaaattaaatgacgtaatcatgaatgtaaggggcttaaacagaatacacataataaacattaaaaaatattagctattatttccaacttacttgga

SEQ ID NO: 124430 - DNA, 1018 bp, Homo sapiens
tactattgctgattgtttttgttctctatgtacatttttttcttaagatcagtgatgatttaatatatattggcttgtctttgtgtaaaatgagaaatccagtaccactttcaaccttatcattatctctttacattcccaggttctgtgatacactttaaataatgtattttttaaatccttatcttttcagaattattagtcatgttgctttgcttcatcatctattaagaacaattgtctatctctttataaccaattcttttttctgtaatgttaaatattattttaatacttgttaaagatagtaaagaagactttattcaagggatgacttcaatgaggttttgcagtaggagagagagactggcctcaactttgaatacagcaaggaaaagtagagatttatagccaaggaacaagacgaggagccagtgggtggaaataaagatttggagaacaatgatgttatagctttttctatcattctttgagaaattacaaaatcctcataaatttgattctaaaagcctaccataaatttgtttacccttctctaagtactgacatctatatagtacaatgatgggatttaatgttttacagtcactaagagaaacattaggggtaaggggtgattctggttaaactcacttgatgggattcttattgaaggcagaccagggtgatgagatagcacctggaagatggtgggggatgagaaatttgatcagatattgaggttgataagacattgagggtggagaatttttgctaaattaatttaacaagattcctgataaaaccggatgatacagacctgaccaaggtcaacacctgaagggcttaaaggagcctgattacagtttgatcaaggagaagggctttgttagtaatactctgtaaatactaatggttaacaaggtaccattttcttctttatggctttttaatctcaggttccattacacaacagtgtcctgatttctttctataaaatgtgtctgttccttgttgc

SEQ ID NO: 124431 - DNA, 1029 bp, Homo sapiens
cattacagattctttgtgcagagaaatgctatttaaaacaaagaatttggaaaatctattaagaaatagaattagggttaaaaatttggagaatctgtggatttgtcctttgtgcatagatagctttcattggatttgtgactactttagagtttcttggaggtaccatacaagagtctagcaagttgaacggtccactgctatttttagtggtctcaaaagtaatttggtactgaatgtccagtgaatgacaggtatttaaacttatttgtgggtggcaaataacagctattgtttatgaaattatttcggctgcatttttaacctgtgggtaacatttcttctgaaactatacattttaattaaatataaggaccatcttttagctaatcccttggttttgttttaacttaaaggttgttgtttcctctgcttccaaaatatgcaagcatgacctcagttatcaagaactaggcaaattttagttcacgtaggataatggaattgcaaaatgttaatgctgtaggaggctactgaagtcaggacagccaaggcccaaggagttacatatatttgcccgaggacagataacgggtagagtaacagaactcagatctgtatccatggtcagtaatattctctctttgtggtggctcacgcctgtaatcctaacactttgggaggccaagatgggcgggcggatcacttgaggttaggagttcaagaccagcctggccaacacggtgaaacccttgtctctacaaaaaagttaaaaaattagccaggcatggttgtgggtgcctgtagtcccagctacctgggaggctgaggtgggagaatcacttgaatctgggaggcggaggcggaggttgcagtgagcagaggttgccgcccctgcacaccagtctgggaaaaagagtgaggccctgtctcaaaaaaaaaatcttttttgtttgtactcagattattacagtgggaaaaatctgttctttttctcatgttgtctaaaggagtcatggacaaacacta

SEQ ID NO: 124432 - DNA, 1013 bp, Homo sapiens
accaaataataaatgcctgtcatgatatagtcactagatacagggagttgaactgagcaagtatgatttcctatttccaaggagcatattgtccagttggggataaaaagtaaatgaatgcaaattaaaatgtcaaattgtgatgaatattctaaggaaaacataactgtgcttatataagagagccagagaaagtgacttagattgggagtggaaggcagtaagtgaaatctcttggcagatgtggtatttaacttaagtctttaagggcaataaataattatctatttaaagaacaaaccagaagtaacagtatgtgaaaggcacataaagagcttcattggggcacagaaagaaagcatctgtggttggagatgcaaatggagtggaagtgggagtagcaagagacaaggaaagagccttgtaggctttttatgttgagtttaccacttctactgttaccgttgctactattatcatttatatattgttttaaggggaaaatgaagtgagagaagactttatttgaaaatgacatgatccagtttacctttacaagaagattatggtggctgctcctcttaaaagtacagttctacagaggaaacctctgcagtacttgttttcatacatcacattacctctaaatgcatataagcgtgttcaacccaatattcattcctgtaataaaagaatggaactcctaaagaatgctgatctatactctgaacaaacagggactgtaggggcttttcatgtattttggttatccactccttcctgtttcctggaggacgtaatttaattattgttttgagtaatcacaaatgacaagcagggtgtaactgaaaatcacgtgtaaagcatgctctgattttgttgaggctgttctatggtacttagtttcttttttttttcccttatgccctcaaggttgtgtccagtgtatggatccatgccttttgttatagacctcagtaaattcaccgtatgacatattagtcaaacaacac

SEQ ID NO: 124433 - DNA, 1072 bp, Homo sapiens
tgaggggtaatatattagtttcctagggctattgtaaaaagatttcaaaattgagtgacttaaaatcaggaatgtattatctcgcattttggaggctaaaagtccaaaattgaggtgtcatcagggctaggatctttctggctccagagtagaatgttcttgtctcttttagtttcttctgttggccagcagtactttgttttttcttttacagtgccttttatttcatttgcttgtatggtttttcctaagcctcaccatctttctcaggacttagtatattgcctggcaaattttccataaatattttcttcggaaaaggatagacgttcctcagttttccagttattctttttcatgtttctccaatacatactgggcatatatttttaactgcctatgaatacttttagtggttgtcctatgggtaacttaaatccaattggttcctccaactaaccaacagacctactctttctgctacatcatccaacttgagtaatgatgtcaccagtcctgttgctaataaaacaatttctggatctgggccctcccttccctatatttcttggacttatttcagattctcataacctgttagtgagattatggccaacagcattgtaatggttctccttgtatgaatataaaccacacctttcctttggggttgaatggtgatagttttgattttttttccctaagttatttacattggggttagatatgtcacatgtgatatatctactcagtgttgtcatataaggttaataattcgtgtgttagggaaatattttaatttcttcttttgttgtctcacttttgatgagtttatcaaataagttatgatagggtaaagcattttagggagattcttagcttttaatagtttgatatgaaggtcagtagaaatgtctaaaaagacagttatagggttactgataacattgtttcctgtattacttctttcccccaattatttggactctgaaaaagaattatctaggcagtgtttgatagatatgggtggtgttgcctctaagtttgtaatggatttttggttaggtggggc

SEQ ID NO: 124434 - DNA, 1138 bp, Homo sapiens
agtagctgggattacaggtgcccgccaacacgcccagttaatttttgtacttttttttgtttgttttgagacagagtctcactctgttgtccagactggagtgcggtggtgcaatctcggctcactgcaagctctgcctccccagttcacgccagctaattttttgcatttttagtagagacggggtttcatcatgtgagccaggatggtctcaatctcctgacgtcgtgatccacccacttcggcctcccaaagtgctgggattacaggcataagccactgcgcccggccattttcgtgtttttagtagagatggggtttcaccatattggccaggctagtctcacactcctgaccttaggtgatccacctgcctcggcttcccaaaacactgggattacaggcgtgagccactgtgcccggcctatcttgtggatttttatcttcctgacactccattatttttttcctagcccaaacatataccctataccacacacaccctataccatgctggctctaggatgactttgagtaaattcaatgttgagggttaactggttaggaattcagcaagcgaatttagactgaatttgttaatcatgacaagcctccctccgaaaaaaataaaatcattcatccaagtacttcatctatacacacactgatgaacatttatctttaggtagtaaaggagccctcccagccctcgctctcccactgacatgctttttacctgagttcccggattttagtgattttttataatgtttgtgttaccatcaattctccttttcttcaccccactctgtcacatgctgtggaggactctggcaagagggcacggcccctgtctttgcataccatggagggttgtggaaaagcagaagaaattgtcagccagtaaactgagttatttccctgctctgcattagctgcaaaaaagaacatacatttgggggaaaaaaggcaggcaggttttattcctggccaggaatggaaaaggagagagctcttgctctaaagacaccttcctcccaagctgtgggaagctggggaactttaaggagttagatgttgggtggaagataggtaagcatattcagagaggaactccagatgtactggcatacatcat

SEQ ID NO: 124435 - DNA, 2158 bp, Homo sapiens
ttttaaagtctttgaataagggaattaattaaatttccactaatggctaccagaagattttaagggtggaagcctttaaattccttaattaaatttcagaactacaggtgaaattacagagtatatttataaatcattcattaaattgcagatctaatatacagatcaaatttctacaagtgtcatagcagtgaattttgtatttttttttctccatccctcttgaggttttgtgacccattttcatcagaaatagtgagttgcttcagcagtgattatcagattggagaggagaactgcccccaccctcatgcctcattccagagaatgtatcatatgttctgggggagtgcatgtaatttgaaaaagatgcctcggttattctgataccaggcatttctgcctccatctctcaaggaaccatatccgctttactactgggttgagatatactctcagtggaattaaatggtttgtacacaattaaaccatttatccttaagagaatagtcaggctttctgactgccatgccttctcttgttttcttgaccaaacttttttattctatgtgctaaggacagaaagtaacaaatgttcattactaacacactattgagggagaataagattgtcagtagaatgggcactcccagttgttaagcatcattcatgcaccaaacactgctctaaatgttacagacaactttattcttcaccaatgtaggatagcctttattacctgcatattatagacaagggaaacaacttcatgcaggcaattacctctccaaggacatcaaataaattcacagaaaagctgtattcaaatacaggctttgtcaaatcccaagcaacaatcttgatttagagatggctttggagccagcggcctgagttcaaatgctggttctgctgtttcactagccaggaaacttgcagcaagctaccaaacctctctcttctcagttttctcatttgtaaaataacgttagcgatgacagtagagatactaatatacctcatgtagttgataggaagattaaataatacatgtaaagcattgagaagagtgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagag

SEQ ID NO: 124436 - DNA, 1113 bp, Homo sapiens
tgatcttgaactcctgacctcaagtgatctgcccgccttggcctcccaaagtgctgagattacaggcgtgagccaccgtacccggcctagagtataatgattaatgtttatcccagtgatctgagtcatcaagaaaaggtttataataaagttaagatagtatttaatgcattttagaaagacttttctttaaacatttttgttctttgagagttttatgttcttctgtctggaagacttcatcccaaatgcctgtgattgtgcgtatcacagccattgtttactgcctaattggttttcatattctgcaagttctaaccctctgaagtgatgcccaaccttttccccgcatacgatggttctcagggctggctgctgtgagcttcactgtgttgttttctgacagtgctaatgcctgggccctcctgctcagcttttggttccctctgctgctgtggaactctggcttctgcctgtctcaaggctcagcacaaaagagaattcgtagcactttcatgtgaaagcagacccagtcattattatttgtattcaagaagaacatggtagtttcaaaatgagtgctacttttaaaatacttcttgaatctttgaatattttctttgactatcttgagtatacagaacagtgtaggacattgttaccaggtgatatttttaaacctctattatgtacagttggtaagataatataaaaacaaatattcttaggaagaaaaagcaaatactcaaatgaaaatgaaaattataaagagtgtcaaaatgctggtttggaacaaatgaacaaatttgaaaaactcagaacaaagaactattaggagtaggtaagaaaaatagaaacgctgtgattattttttgctaaataggttttagtagcatcgtctcagacagataaatgcttacccttataatttttttttttttaaatacaaggtcttgcactgtcaccaaggctggagtgtagtgacacgatctcggcttactgcaacctctgcctcccggactcaggtgatccttctgcctcagcctcccaagtagctgggactacaggcgtgccaccatgcctggctaatttttgtattttcagtagagtcgg

SEQ ID NO: 124437 - DNA, 1024 bp, Homo sapiens
gtttgtgcatgcatctgtgtgtgtgtgtgtgtgtgtgtgtgtgtgtgtacacatgtatttccctaaagtgattggctggtcaaaactgtacagtaccacataccccatccccaaggccccatatttacccatttagcaactttataagatgaaatccttatacttcatttatttctccacattctctgtttttgccttgtcaggccacaggtctttcctttctgccttctctgatacttcctcaaaacctgtgccaatcatacctgtagctgtggactttgctgagagagtctagtatttttagcacaagctgtaatgagagtgtcattgacagggtgttgcttctctttcagtaatccataccaccagctgtgtgatttgcctgtcatctatcttcacccactcatatgaactcactctcttactgtcctctctctcctcccctttgtctccatttttgcatttttgtctttagatctctgttctcatttagattttggttataggaccttttcaaatgggttacgtaggttgtatattctttgacacccatcatgacaaaactattaatacctttctttctgaaatgtgagtcatattttgcctagctttctgactcatatcagagttcttttctctccgacatatagaagttattctacagttttctaagttctggttttgcaaatgagaattcaacttactttccattgtaaactttacatttctcattctggaagagcatttgattttcagtttatccttgaaagtaaaaaatttgaaaaggatacgtcttgttgtatgtgtgtgttcctattaatcacactcagtgagccctgtaagtctagaggactcaaatctagtgattgtaatatgggagcaaaatgatgtactggcttctccacctgcagcatttattttctatattagtagtattattttatttatgtatattcagaatttataaatttaaaactagtaaaatatttaagaatttcaattacaaacatttaaacctaaatga

SEQ ID NO: 124438 - DNA, 1611 bp, Homo sapiens
ggcaggaggatttttgagcctgggaggcagaggttgcagtgagctgagatcgtgcccctgaacttgagcctgggtgacacagtgagactctgtctcaaaaaaaaaaaaaaaaaaaagacttcttataaatcaagtataaaaagaaaaatactacagtagaaaattggatggaaaacaaaagaaataccactggctgatcaaaatataaaacattttgcgcagtaatcaaaaaaatgcaaattagaacaataaattttattttttagcttattatactggcaaatgttaagaaagagctataatgctcaggaacttctttacactatttgggggagtgcatgtcagtccaaccttgctggatggcagcctggcaaaatgcatttaaaatatgcataatctttgatctggcaatatttcccaggaactgttcctaaggaaatcataattcaaacttgcgaaaatgaatggaaaatacttttcactgagtatagttcataatagcaaaatacccataatgactactttagtagaagaatgtgaatagaataatgtgtatgtttagatagaaaaaaggtgtagaaagatagatgcccagtggttaatagttcttccagagcctgtaagtgtgaggaatgggatggattagtcgatattaaaggggaatcctattcattttatctctttttaaaaaattgttttgtatgcgtattttgattttatagtaagtgttacctctaggaaaatatatttcattttgtttaaaaaggcagtattcaattccatactgcctttgcattgcttgatttgttttccagaaaataaggttaatttctaaggttctatagcattttattctttactgtagttaggattcatgttttaaaagaatgaaaatatccacatgacagaaacctaaaactaactgggggaataaagggtatagagagtttagaaagggatgtttaaattgtgtcctccttaacattaacaaatgtgttccctttaaaactctaggtaataaagacatcacatgggtaatgttagaagctggtgctgagacagatgttgtcaactctgtgggaagaacagcagctcagatggcagcctttgtgggtgagattttgctgcagttttgcattagattatacccaaaatttcccttgtggaaaaaaaacccactttgcttctcatggtgaaaatattatcatgttgctttaaaaaaacttaagtatttacagtccactgtaacttaatgaaacacctagtgactctggagaaaacaaatggctatttcgaatttccactttttcaaatacaaagagtagtggggccattgtaattgctcacaaatgcttataacatgtatattttatgtctctgatggaagtagctaaccctaatgtttaagaatgctaaccgagaagtcagtaatcccaagttaaattttggctgtgccacgtgatagcaaagtacttaataattctgaccttcagtttcctcatggtaaaatgttacagggttattgtgaggattaaaagaggtgatagacttgaactttccatgtaacactaaataaatggtattagttactgttgttaataattattacaa

SEQ ID NO: 124439 - DNA, 1009 bp, Homo sapiens
gcattgaagatgtgtttcacctaagtatttccaaaccaagcactctattataaatatgtcatcaattcacaagatgtggtgctgacaaattatataaatactgactgcattttgaattccaagtattacattgactggaatttaagcttcagatggtgatttggattagataccctttaagattttttttcagtattaagtcttatgctttgtggttattgtattaccgccaaaaggaaaatgtggccaatgtaatatactttaaggtcagtgaaaataaaaacaagatggagctatttttagtttctgtaaatctattctactggacaattactttgtaaaataaatagtatgtgattggatgtttcatttcttagcaacctacactgactagatgtactcttacagataactccttaaggtttatttccttgatgttagatttttctcttattctagtgacgaataaccttacttttcatcttttttttttttttaggtactgtccaagaagctggaacattattatccagcaagaatgttcgtgtcaactgtttggacgaggtaagattttagaagtttaataaaggattttacttcctataagaagagataatatatcctttttttttttttttttttttttttttttgagatggagtgttgctctttcgcccaggctggaatgcagtggcacaattttggctcactgcaacctccgccttcttgtttcaagtgattctcctgcctcagccgcccaagtagctgggattacagtcacccaccaccactcctgagtaatttttctatttttagtagagacagggtttcactatattcacctggctgagctcgaaccctgacctcatgatcctcctgccttggcctcccaaagtgctgggattataggcatgagccaccacgctcagccttcaaatctcttaatacaagttttttttctagcatttttgctcatattacactaataattcctaaactaaatgtaagc

SEQ ID NO: 124440 - DNA, 2216 bp, Homo sapiens
gtacggcgacaacctggggcctctgcatgccccagaaagccgtcgctgagcacataactgccagctgtagaattttcaatattacatgtggcgaaatatttgaaccggacaggataggggagcggaacgtgtaggaggaatttaattcccccctccagctttctgcatttggttttgtcctcccaggttgctccaatggcgatctctcgctaccgcctcctgcggctcctcctcctcggcagggccaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtacgggtgctgggctgcgacgcggccgcggccagcctggccggggggcgtggcggagcccggggggcgctcctggcctgggtgacctttggctgcggttctgcaaggtttgcagcctggaaccgggaaagagcgtttctccctttggtctgggaaaggttgcaggggcggagaggtggggaggcagaagcagtgctgggacaagaggggtagttacagaggctcggcctctaaatccgcttttggaaacgtacggatttccacgccccgccttaggttaatgcgagcttcccggggtgtggaccccagtgtgtgaattcttcactgctcccgagggattttgaccgcggtcagtcctggtagtttcaggttcttaggcgggtgtctaaatgaccctttagacttccgcaggccgaatgatctggatcctttgccgatccccgcccccgcttgggagtggagggcgcccttagggagaggggttcttcataagggtacagaactaggtctgtaatttgctgcattgagacttccgtatccagggcctccctggcttccagaagccccgacagcctcaggaaccctagagagacaaggaaattggcgaggcctccacacccacccctcggcccacgttgcacagatgagaccttctaatcgcgctccttcgcgctttcttgtccactcccccaaggcgtgccccacttccgcagtgctgagtcccagcggggagccccgaggacgagccagaagccatatttccccggagtccccgagtggacgtcccagaggagttccctgccgagtcccgttacctggcaggtgacatcagcgtgactgcatgcttcttctgcaccctcacggtgcagggatggtgatgcgtgcgactccgggcaattaatgtggtgattttaaactcaataataatatagccatgtttgtcctcgaatggcagagatgccagtcattgcagcataaggcttcccagtttccagttttatttacttagtagccaggctgaaatgtggaatcctagagaataaggcagatttattcttcatagcgacaaggaaactccacatgcgaaggagaaaaaattccggtttgaactcaacaggtgctgatgagctgagcccacccgatctgatctcaactattctaagtcagtcacagctatatctatcaatgatgtgttctttgcctggaatttggggatttgggttagagtttagattgttgtactgcatggttcttgctgacctatttggcatttcagtctttcagttcttcctgtctctaggtaatttctccctgcctttgatggctctgggattcaattaagcaaacatgcaagttctagctgtgtgccaggtactgtgctgggcaaaaaggagacaaaggatcaattcacaatccaccagggacaaaaattcttttaggcaggacagagctagtacatgtcctctctctctctcgctctcgctgtctctttctctctctctctcgtttgtttgagacaggatctcactcttcacccaggctggagttgcagctctctgcagcctccacctccctagtggctgggactacaggtgcgagccaccatgcccggctactttagaaagattttttttttttttttgtagagatggggtggtgg

SEQ ID NO: 124441 - DNA, 2244 bp, Homo sapiens
ggtcaaatttatctttgtttctcaggtttaacccagtgtcttgcacctagtgtatgctcagtacaagctgagttgaattcagtttgatttctaagttattttaggtggatttgttttcctacttgactaatccttcctggcaatgtgaggtgaggtggcactaagcacgcacaatcataaccagaggcagaaagtctttaaatgttttggatctcaagcttcttgacattctgatgaatgctatcaaccaagaaaaattgttcttgtgcacatgttacaaatttggcatgccattcttagatttccccattaaagaccctgatttccagctctctacattaggagaatgctgcctttttgttgcatttttgagtattacatctttcagggtactgtttgtcttgacatttgactttttttccttagacttaggtatctttattgactggatatttgataataagaaattttgatttttttaagttggaagtagattacggttatatttttaaaagattacttatcttttagagataggaacagaattatttcagaactggatgagaagacagctgagatttgctttaatataattctgtgacagaaaggaagagagactgaatgagaatataaatgagataaaattgactatgttaacagttgaagatgggtgatgagtatattcacttgattatactgttctctctacttttggatatatttgagattttccataatgaagtttttaaaaagaaaatttggaagtattacagcctctaagaaatcttttttttttaaacacaacataagaaagtaatataaatacaaatgttcttttttctatacttggagtttcgcttatgtgattattcatttaagtgttaaaacagttacacctaaatctgcaaagaactgtcttgtgaacaatgcgtttccataaacatttgacatcacattttaacttctccaaaaagtaaaaggttggtggcattactcagtgcttgtagaacaaattgatgaatatcttactggtagttaatcttcatcttttttgaaaagaaaattctgaagaaggggtacagatacatttagtttaactgagaaaatcaagaggtgaatgaagtggagatactgatgttcttctgtgcgtcataatccaactcagaaggcattccaaaaaaaaagagtaccaaaactgtttcgagcaatgtcagcactgataggataagtattagtctaggaaaatcaggagcaggcccaggacagggtgtgactggtaggttcttactcagtgtttgcttagctgaatacttaatctgacacctactttctaatttgtgcaattttttaaactgattttttgatctttacaattttttattgtgttttagatatattaaatgtcctttataacatgtcatcctagactttgggattttacaagaatatttaattaatatgaaatccaccaatcttagcaggtcataaacaagaatacttttcattcttaactcactcatttctgtgtattgaggccatggcgctctttagcaagtatcttttgggcagttaggtgccgagtggaatgatttgccccgttctaaatttggcgtgtattaagtgaagagtgccaaaattgttcaggtagtcatatttgtaaactatctattttgaaaataaagatttgaataactcattgaatgaaccattctttaaggttaaatgccaaaaagataatgttctcattattctttcttgatttttagcaataggtgtttccattgatgttttttaagtttattcaaaaattaaaggaaaaaagtataatgacaaaaagaaagaataatgccctgtattaatatttaagatagtataatcctttggctatctttaattccattctgaaaatattaatattttagtaggaaaacaataacttaagatgtagaattattttttgtgtcagatgtagcattatattttctttttacatctcaacttatttttatgctagatgagaactttaaaaaatataacaggtgtactgttatttttgaggacttctaaataaatctcaagaaaagccctggggcagagatgaataataagggataataacgtttagcactgtagagaatatatcataagctactattggatgatattctactgtcatcctttttatatatccacacagaagactttaatggttttcaaactaacctggatttatggtcatttcta

SEQ ID NO: 124442 - DNA, 2184 bp, Homo sapiens
aaaagaaatgttatatgtttttctcagtgaacaaggtaattgaatgggactattataaacaggaaagagaacccctagttgtcggtgcagaggaaactgctggctggaggaaaaggatgcggtgttagtatttgggagtgtgaagattgtgtttgtgttagagttgagcttctgcaggaaacaatttaaaaactgtatcctatagtgctagaaattatggtgccataaattttctaatattcgtatgtccctaagaggcaatattgttaaattctctctctaaagataaatgccttttcccccccaccgcttaatagaactctatggagaactctttggtattttggaagtaacatatgctaattcaatttatccaagtgctgaactcaactttaaattaatatttatgcgctactccatcttattccaaactataaaatttatgaggcaaataatgaaaaagctgtcttcgagaatcatataaataattctctaagacattgcaacagctttagttggctccttggaaaatgcactgagtggagacagtggatcaggttctggccccaactcttccatgtacataagctccagatgggcagggatcgttctgctttgatctccactgtcttaccaatgctagaatggaattcctgacctcagccaagtggtttgacatctcagtgccttatctgaaggttagcttagggactgggcttacatccatggttttcaaagtattccattccgcgtggatgccacttgtaagttacaaagtaaaaaaacacgcacttaattattaaaacgttaataaacacaactgcatctcgaatgcatcatatgttgtctttaaacatactggagacaatcagtgcttgctaacttgttctgcccgattgtgcaatacttggaacaaagctccacctgctagaaagtgacctccatgaaatttgcctgatttagtgcttgctgcatccctattgactagtaccagacctggtatatttggcaaacaaataaatgaatgattctctgtaggtttaaacctttttcttttgagacggagtttcgctgttgttgcccagtctggagtgcgatggtgtgatctcggctgactggctgactgtaacctctgtctcctgggttcaagtgattctcctgcctcagcctaccgagtagctgggattacaggcgcctgccaccatgcctggctaatttttgtatttttagtacagacggggtttcaccatgttggccaggctggtttcgaacacctgacctcaggtgattcgcccgccttggcttcccaaagtgctgggattacaggcatgagccaccatacctggcttaaacctttttaaaatgtatgattcagagagcttgtagctctgtactagttcttttttatttcctttaattcaattttgtatggtccacttctgtaaagttgtgttggggaatccagtcccatgtcatcagcgtgccctagactaggcttggcatttctatccagttcatgctctcattatgtaataagcatgcatatggaaagtaactttgtgtgtgtgtgtgtgtgtgtgtagcccttcaaataaagcttcacctgctagacaggcttgggcaggtccccttctgggaggatgggagtttcttggttgagagaactagtaagtgagccaatatttggactcatgcccaccaccacctttgagcttcctgaaggtccactattacgatttttaagcaattgctccaaaacagaattctctcactgtctaccagtctaggccttacttttctttttatttcttttttttctgaagattttattttcctcttttccatgattaaaaatcctctgaagagaggcaaacacttcaacactcttttactttaataacttgtcttctgacttcccactggagtaatagtcaccaacactcccatcagttttgtgtctgtcttaaactaacttgctctctggcattgccactccacttcttgctgattttcatctcctggttctcctcacctcagttagcaaggccagtgttgtgtgtgctgtccatagctcctttcctctaggtggaaagtaaatctcatataaaatcatctttctcctctactatgtaaagctcaacatgtatttaggtatcttccagtgaaaaagcacttttctggagg

SEQ ID NO: 124443 - DNA, 1131 bp, Homo sapiens
ttagttattagatttgaaaatacattgtagggcagtgtactaacagcctttgacattggcctaatagaactgtctttgttatcttcctaggttgaagcgagcagtttcttattcaaagtgtccttgcttctcttaggccagggcttttataagggcttagtgagtaccttataaaggctgacccttactggagcagattatagtgtagcatgaagagctaaatttagagggaagtggggcctctgctccaaatagtaacagctaaaggatagacactcttggagagcagaatatctttatttagtctgtcaccaccagtgggtgagtttttgtttgtttgtgttaattttgggtgttataccaaagtctttgcatacatttttatgtttacatgttatcatgtgtttctccacatggaatgtatcgagggtatgaaaagtaagcccacatacctgggttataaagaaacaaacttttatgcttagaaaggaagtaagtataaaagctaaacatttgaaaatagagtaattctttcatatgctgtgtttggtggtacttctccattaacagaaaaaagaaaaacaaggtgcaaagagttaattagggaattccatgagtttgtgttctaaaccccaaaacaaaacttttaggaaggactcacactttagaatttttgaaattacaaattaaaaaccatttttagcctggcacagtggtgtgcgcctgtaatcctagttactcaagaggctgagatgagagaattgcttgagtccaggagtttgaagtcaccctggtcaacatagtaacaccctcatctctaaggaggtagagagagagaaaaaaggaaggaaggaaggagagagaaagaaaaagaaaggacggaaagaaagaagaaaaacatctttggcagagaagtctgctggagagatttctgtccagttgagctacattctttttgcatcttggtacaagacccaacacccaaattcttgacacatatttttctttgctaacacaaatatattttgtataatatttgtgtttgggagatatggagacaataatatgtatatcatcatcacttttgcaacaataaagtattggctgattcagagtgaatctgtttataat

SEQ ID NO: 124444 - DNA, 1290 bp, Homo sapiens
tttctgctagactgtcctctaataaaatgcaaactacatttactgtactttcagatgaaaaagactctttagttccaaagttgtcttgtttctcaagttttcattagtgttcttgccattttcttatatgggaattttctagtccttttgatggtcactttgttttagcagctgggagcttttttcagcctgcaaaacaattattagtcctttcggtccatcataagtttttaagatttccaagctgtaagtaatcattttgacctaccacccttattgctcactgttgaaatatccttggctgtagtatgctatcttcctttttctgtttgctggtaattcttttggaatgggaggatgaagatctttttacaaacaagtttttaagttgtgtcttacattgaaaacaaagtcctctgcattgattcttggcataatctgggtttttcctcatttatccatttacatttcccaatgcctccatttgtaattttcaaatcatcaaaatctgttctaccacctgaatcaacatccaaccatgtggtagggcctttgtgggaatgactttatttgattttggaaactggtcacaagacttaatataacagcatgtagttgttttatttccacctttctcatattataggaaagaaaatatcttttttcaacaaggaaggagaattgcctgttggctagaccctgagtgggaggtgaagttttctgtgcttttcagtgggttccttttgtgtagaaacccagttatcccctcctcccactccacctaatgtattcctctagaattcctatgcgttttcctccccctctacacaacaagaccctaattatattttttctgcagtcaccatttgcatgttcttgactgcataatgttttgcttacagcatcaaaaggactttttatctcttgttcatgatgaatattgtcccagttaatttatgtgtgtctttatggtatctcacgctgcgtgactctgactggtactgggaatgccattcttctctggttctcatgcttatgtgactagtgttaaccacttacaacccagcccttctgttagaccacttacaagcagtacaaactaggcagttgctatatggttttaaaatgtagtttttaattttatcaaagttatgcatgcacatagtatggctagttcttgattttttctgttggagatagtagatatgccttttctactatggaaaatgatgattcagctctctttcattgcttgcttccccccatccccatacttcctgtccttctcta

SEQ ID NO: 124445 - DNA, 1035 bp, Homo sapiens
tccacctcctgggttcaagtgattctcctgcctcagcctcccagtagctgggattacaggcacccaccaccatgcccagctaattttttatatttttaatagagacggagtttcattgttttggcgaggctggtctcgaattcctgacctctggtgatccacctgccttggcctcccaaagtgctgggattacaggcgtgagccaccgcgcccggcctacagtaacttattttaaaagagacatcccttcttattcccctatgccatctttatttgtttgtttatatttgtatattctcgtacattctttggcgatgctctgtggatttttttttcctatcttagataaaatagaattaaagttttgattgttatactctcagtatttatttatttatttgactgttattttgaattgttttattttagatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttggtaaaccatgcattatcgcttcttgtagtatatttatatatttttaattctgttgaagtatttccttataagatagagtctttataagtttatgtttattagagttaataaaaatacaaatggaagcctataattttacctggtttaggatttggaatggtattaatgcagatgtgaaatgattattggttaatagaagcatagaatggaggactttggttgacgttacaacaaagttggccactttgcttctcctaaaagccgcctttctcatatgtccctaatctttcagtgtttttggtggggccataaaaggggtaatttctgcaaaatactataacttagtgtataaatttccaaggtttaattaatgccatttcatccataaataaagcatataagaaatatagtttaaacctggtttttgaa

SEQ ID NO: 124446 - DNA, 1002 bp, Homo sapiens
aaggaacattatatttaatattttatcaaaaattatgagttcctatttacatacacctttaacaatgttagctacctaatttcatcagttctctagatctctgtcaattaggtaagggatgagtattttcattttaaaactttaatagtggagttgaatatttcctaatatattattgacttctagtatttcgttaattatgatatatttttatcagagtgatcttcagcgagttttggttcttgccaaagtcacatgactgtagtagtcacttatatggacccttttcagactgagtgacctctaggcagcactgttggcccttttgtcattcttgaactcttttattttcttcccttacacgagaccacttagacctccttctacctctctgcatgccacttcttacattactcctggcttccatcgttaaccacctccccatataaaattatctgtataatttgtgttgagtttcttaaagtttcctttaccatgatcagcagatttatctctgtagcccagatttctttttttttttttttttggcagttgcaagatttaatggagtgaaaacagagctcccatacaaagggaggggacccaaagagggtagccattgctggcttgaatgcctgggtttatatcccagtcattatccttcccactgtgctctcaggcaatagatgattggctatttctttgcctcctgtttttgcctaattagcattttagtgagctctctttactacctgattggtcgggtgtgagctaagttgcaaaccccatgtttaaaggtggatgtggtcaccttcccagctaggcttagggattcttagtcaccctaggaaatccagctagtcctgtctcttagtaccccctctcaacaggaaaacctaagtgctgttggcgaggttggccaacgaccgctctaacttcttcctgctgaattgaggtgtagtaggggttgtgtagttgagatttcctcgggaggggtgcctt

SEQ ID NO: 124447 - DNA, 1224 bp, Homo sapiens
tttttactcttggactccatcttgattacattaggaaacgaatacaccaagagttgtaagtaggaatatagcctgtgtgtaggagaaaaaggaactagattaagaaatcatttccacagttattaaaataaccaatatttacaaaatcctcatttacataaaaacatcattccacttagaaaactgtctagaatcttactaatacagttgcaaactttgcttcagagttctaacaggactgtaggggccagtcatcctttattgccagtaaattataacacgttttgctcatctgctagaaacatgtttgttgtccacctagagtagaatctgtcctgcactttgctctcctccccatcacatcgttgtctaagtggttatatctttaacaccttcatttccgtgatttttagtctctgcatctcacagtttaaaaatcacatttattttattttcgtcgaatttttttttctacctgctatattcttgaatgaatttgttttatcttacgtgtacattttgatcatatttgttcccctaggtcatgatagcatctttgaaatgcttatagttcttatattacagtgtgagcctgtttaactatacacttttattattatagatctatggtgtcattatagtgagtttctattacctacttctgtgtctttttggttgacctaatatttaatggttgttttttttttaggtcttcaataaactcatcaggagatataagtatttggagaaggcatttgaagatgaaatgaaaaaggtaaaaattcaaatataatgcctatctgttttatagtaatgacatgggggtggataaaaattttataagtggccggacacggtggctcacgcctgtaatcccagcactttgggaggccgagacgggtgggtcacaaggtcaggagtttaagaccagcctggccaagatgctgaaaccctgtctctactaaaaacacaaaaattacccgggcatggtggcatgcacctgtaatcccagctaactgggaggctgaggcaggagaattgcttgaacctgggcagcagaggcttcagtaagccgagatcactccactgcactccagcctgggcaacagagcaagactccatctcaaaaaataaaataaaataaaattttacatgtacaatgatattgcagaagtgccatatatgtaataacatgtatgtgaaacacatagtgagtttttaata

SEQ ID NO: 124448 - DNA, 1114 bp, Homo sapiens
tgtagtcaaagcacaaagcagaggagagtcaggagagagaagggcatcccacagggctgactactcttagaatttaatacaggaagtgggtttttcgttttatttgctttgagcttacattcaaattttctagggttgctacttttttagttccctgcctctggggcaagagaatctaaaagtttaccaaaaaaacatcaagaacctagaaaacccctttctccctcaacagtcttgttttgaagactgttgtattccgtgagctcagaaaagtatatattaaatgtcaaaagcttaacttcgactctttcctgttttttttttttgtttgtgtggggcttttttttgtttctatgtttttgccgtacaaattctattcagagaaaatgggtacatgtagcaggggaagaggtagtcgcccaaggaagtggaaaaacttgaaaaacaatacatttcagaaaacatgtccatcatgtatacttaactctcttgcatgcacatagtcaaacataaatccatctgtttacatatcatccaaatatctcttttcctttccatgaatgttatctacagctgtgagtaaattaactgagaagaaaggaactctgcctgctcaagtcactttccacagcatccagtttatcatgaaatgaattactatgctttgcatatgaccttctgtttgtgtgccacgtagccatggatgttcacagtttatcttcccacttcagtcctttgcttcatagacatggttcctttttttttctttttctttttctttttttttttttttttttgacccacagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggtaacgaggctcctgttttctcgcctgtcagacaacaaaagaaaaataaagtcacagatagttagaaaaatgccagtggctctttttggtgtcctctattactcattcttcatttaagagaatatctttgtatgggtgtatattgcctttcaaataataaaaggagtggact

SEQ ID NO: 124449 - DNA, 1036 bp, Homo sapiens
ctttattagcaaattacttgataaaggtgacattacagttttgtgtctcctaatttactttcttgtgcctcaagatcactgttataaagatgaaatacatatgaaccagagggtgaaataaaggcaataacaccaaagatactgggtgtgaaatatgtttttgaccaaggtaaaataaaataaacttgcagttagaccaggttggattcaaggagtccaaatttgaaaaatattttaatttattttccttttcctgaaaatgttctagtttgagtaatgagaagaggagaatttgcctagaggtctattgacttttcatttgtaccaaaattagtcttttagttatttacacatttcaggaaacctggttgctttgcacaccatcacaattggttttgctcgtaaaaggaatgaaattctcttttgtttttcaacaggcattgcggcctcatttgctgtcaagcttttcaaagcatggatggcagaaaaagatgccaactctgttacctcgtctttgagaaaagccaacttagacaagaggctgcttgtaagtgttttctggttaaagagttgtatgtatgatgcctttcttggagcttaagcaatgcctgcaatgtagtatatgagtaagatccctggatctgtgttgacttggagcactgttccttttatttctgtgtaattggtagtagaagctaatttcattttaatctttattttgtgaacaaatggcacaataaaattaaagaattgtgaagaatatagacttccaaatttgtaagtttgttgacatagtattaacatttcatcagaattaagactttgttttatagccataacttttttactttttttttttttgagacagagtctggctctgtcacccaggctggagtgcaatggcacaatctcgctcactgcaacctctgcctccggagttcaaacaattctcctgcctcagcctcccgagtaggtgggattacaggtgctctccaccacacccagctaatttttggattttttttaatagagacgg

SEQ ID NO: 124450 - DNA, 1940 bp, Homo sapiens
ataagtattgacttgggggcacacagctctgttcttaaatatttttggtggcataaattgggtcaagctgcttaaccttgttgaaacttggtttaccgtctagaaaaatgtctgctttacacagttattatgaggaaagtgccagtacattttgattcatagaagaaactcaataaaaatacattagttcccttccctgcagatttggaagatgtggagcagtagaggaaatatcagtgacgcagtttcagtgtggtataaaatgtttgctttattatgaatgcgtgtttgatagctgctcccaccagctctcttctgacatttttgaaacatatgactcaacaggggaaattaataggatgatagaacattgaaatttgaatcctgacataggagccctccagctgtgttcctataggtggtggcaaacccattgcagatctactgaggctctttctggaaccacatagccattggccatatatatgcaagtctaaccaatacaaaagcttggatatattttttagaccctgcagcagtctgaaaaatgtgagaactttgaaaatcatcttaatttcatagatgggagttgaactcacccaggattagatcatgactaagtgttactgagattctgccaaactgtgtagggtaaaatggaaatgaggtgaaaatatgagagcagctatggtatattgctctttttgaaaatttccatcagaattatgtaataaactagagttggtagggtaggtgtcttagaccttttctattacttataacagaatacctgaaactgggttatttatacagaaaaggaacttatttcttaacagttatggaggctaagtcccatgtcaaggggctgcatctggtgagggccttcttgctggtggggactctgcagtgtcccaggaaggctcagagtatcacatggcgagggggctgagtgtgctagctcaggtctcccctcctcttttttaaagccaccaggtcccctcccaacataacccactaatccatgaatggattaatccattcatgagggcagagcccttataatccagtaactctttaaaagcctcatctctcagtattgccacagtagggtccaagtttatctcaattgcttaccctttttttctttttctttgtgaaactgcctgatttcagaagatgtttagctcagtaaatataccagagatttgttgttttgtaaaacagtctttattcttttcttccaaatgtgagatattctaagtgaaatgaagacttttgtcctttatgcttgctgaaatttgaatggcttgttttatagcagtcttttttccctttttcaggaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtgggagaccacgggcagacatcacctcaatacacatgaatgagaggaattacatgggctgtgtagcaaaggctttccttaacaagtctgtcctatgcttattgctgtaaactttgtccacttattcctaccatttaaattaactcagcttcaaagtattgatttagaatcctccatttttgttaacactctaggatggtccagaaattaatagtgatttccacacaactgacttattttaccaggctgctatgattttcaaaatatttcatctgtcaaagagatttgaccatccactatcagtatagcccattatatggtagttttaaaattttgttgcaggttatctaacctgattaagcatttgtctagtgtttggaattaacactggattttttgttcatcactctgtatgaatatgtaacaggc

SEQ ID NO: 124451 - DNA, 1467 bp, Homo sapiens
tacactccaggccagaagtcaagaaagcaatgtgtttccagcaaaaaagaaaagggagggaaaaaaaaggtgttactactactcacaaagtagtatgctggagatatacgatgactttcaatcacttctgaggcccaaacctctatttattattttattttaaaaggaaaaagcctttcaaataaattttaggcaagcctatattccatactctcagggttgagtataaatttgcatatttatacataattcaaaggagaaaataagttgctgaatactgctgaattgatgtatatgaaatttaaaaattgcctttgcacttacaatttatttacaaattaacttttcactgagatggggcataaggatcatcaaaagtaatcattgaagaataaattgtggagaatggacctgtacaaacccaagatggtatccatcaagaggttttaaagtttagggatgggataaaagttcacaacgctgttgccttctttaaatctccaaaaagtcaaactggctcaagtatccctactctactagactcaaaggggtttctctatgaggaaacaaaaatcctctcttactccacattatccagcagctcctggccagagctaagcctattaattttgggactaaaaataaatttgctttgagaacaaatcattatagtttttctccctcttccagtctgagaatgcagacaaggaaaggagaagctaagcagattgtttcttagctgccccaaaaccttgattgactgggcagctagcggggagatgggagccctccatctgcctgttactttctgaccccatttccatgtaatgtaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaaggtaacagcccttagcaaggaactgacccagccaagggcaaactgcagctttttttgtttgtttgtttgtttgtttgagagtgcagtggcacgatctgcgctcactgcaactttgaactcctgggctcaagccaccctccctcctcagcctcccaggtagctaggactacaggcgcgtgccaccacgtctggctaatttcttcattttttggtagagatgtagtctcgctgtgttgcccaggctggtcttgaactcctgcattcaagctatcctcctgccttggcctcccaaagtgttggattgcaggcatgagccaccacgccgggcccaaatttgtcttaattgagagtatgacaaatgggttccaactacaattaccctagactcagactaaacatatacttcctaatttttttccaagtttgcacccagcgttcatgagaacatagcagtgagtaaactgtccatgttactttgatcagggaag

SEQ ID NO: 124452 - DNA, 1004 bp, Homo sapiens
gttcaggaatactgctacgacaacatccatttcatgaaagcctttcagaagattgtggttctcttttataaaggtatccatccacgtgccactgctgtgcttctgtgttttgctgaagctctttgagaggcagagcaggcaatgaggcagaggaggtcatggggctctgtttagagagggacagcaagatgctaatttgtgaaagttttattgaggcaaccataccatgtagagagaggaggcatacacgccatatatgcgttgccttggaaaccctgcttaggcccctgggcacttctcattggtagatgaactggtaattgtttcttggggttggtggaaaaaaaatgtaattatataaaattgagcctgtttttgaattgtaaggattagctctaataacaatgattatcaaaatagtatatatattatgttcagactcttttaggtaccataaatctgactttaaaattactgaagtaattagcctttttactttgtattttagttacttggcccagccattctcctgttttccaagggaatggctatttttaggttttcacatttactgtcttttcattgtatttataaggattaggttgctatgacaactggcactaaaatatgaatgctaaaggttttaaccgatcccaatctgtatacctacagcatacagaaatgtcctaggctattttttgggcctacatttatgtagttttgtgagggagaaaaaggaacacttaagaagtggtacattttgaacattataacatgtttattttatgttattatgttcataaatatcatatcagaaaagttaaaataataccagccaaatgtttattttccctttcatgtgttcctaaatttgtctcttttgaattatatcttgggaatttggaaaataaaggttttagataaataatagctcttttaaaaatgcttaatagcatttcacaatgaatttttattggccacgtagattcctcaaatgaatgaat

SEQ ID NO: 124453 - DNA, 1046 bp, Homo sapiens
cccccttggcaaatctaattacttaattgaatatcattattgaaagatttataaatcttttacataaataacagtggaataaaagcaaataaactaaataatgctagtcagcaaagaaaaaagtggtgatgggtcattttgcaaagactctctgtattaaaatctagatttgcatatttttaaggtagtaagaaacagtaaatccattgctaactttcaagcatcacattattgacttttaaaaataattttctcttcttttttccctgaagataagtcccatagactcagcatggtctaaaatgtgtaaaactaccttgtcaagtactgttattatctctatcatgggttttcttgtttgcagaaattttttaggttaaattctatcctgcatgcaaatttttctaaaaggagttttttattctagttctaaaaaagggtgagtgcccttctcagcatatattcccagcattcttagggtaaattatttttgacttgtgtccctatgtgacattcctaataaaaaaatttctgaatttcaagagtttcaagtgacatagtttcagactaagtttctaaataactaacatgatctaaaatttagcagttctcaagccacttttacagtattgtctcttcgatcctcatgaatacattagaactctacaaattgagaaatatttattttttctcatcaagttaacaaatttattccttaaacgtgtgttgaatcgatactatagggcaggtctttcattaaatgctggaaatgagatgaacaaaatatagtccctgacttcctgaatttcaggatgtagaagaaaacaaagaattacactcaccatgtcaattgctgaaataagcctcacacagagggtgtcagaagggataggaccacagagggagggcacctaacttgttaaaggtaatttggagggggagaagtgaaggctctcaaggtacatgtatctcaccagacattatgaagaagttggccagatagaaggggaaaacatatattccagtctctatgtgccatcatacaa

SEQ ID NO: 124454 - DNA, 1428 bp, Homo sapiens
atttatgaaatatcccaccaaaaatggtttctcagttttaattaactcttttccctactttatccttagtgagggaaaaaattgtctgaattctttgtccctcaaggagttccttccttttcagacctttcctttcactaaatagaagtttaatttcttcttaaactcttcgatgttcatactttgcctcatatggtgctctgtgtagatacttcagtagcttttaattaataattctctggtactagaagtttgatctttcagcaagtagttgttactaccctgggttcttctaagaactccacattgcgccgttaatatgtagacttattttaaattctccttcctattcttaacattaaatattctcaattaatggtaacttaagaatatcaaggcacaagatttgcaataaacaatgcatttgataggttttacctatcatttagtgtgcttttcacaagcactgacattgacaagcattttagtagttgcatggtctccttcagcctctgtgaggcaataaaacacaggaatgtgctctcaaccttcaaaaggaaagctcagacaaatagtatcactaaactgcagtctacatcagctttccaacctgtactttgtatcatcctcaattcattaaggtgtggagaaaaaaaacaattctcctttccatgtttgtcacagtttaaaattatattgtttgtgcagaacattaataatgatagtttaatagtgcatgaatataatttataaactcaaaaatatacatatgttgggtgtatatgctcaaaattatcctacaggcaggaagacatgatccaaacagtttgataattactgatctaatcataagcatcttaaagataatttacaagttatataaaagggtcttttaaaatccctgttaatgttctttaaaagtctctgcaaggcagtcttacacaataacaggtcacttcctcgggacacaactgcctgctcctcagctctatgacaattaggctctgatggctggtagaaatttcttttatctcagtggagagctggaaacaaagagctaaaataactagaagctaagaataagtctacaggacccctgattgtagctcttacatccaggctctataagtaaatccagacttcttgcttcctttgcaaaatgtaatgtttttagtgatgataataaacatgtttttttaaaaaaccttttattttcataaacaaatcatgttcattttagtcagctcagcctcttcaatttaattcaagaacattttccaagagccaataattctttaaaaataaaaaaagccaatgtttttgttatgaaactaccagtgatgttttaaatgaaaacaatattaaattgtttctgtcattttcataagttgaaattatattttaactgaaaagatatcattaaagtaa

SEQ ID NO: 124455 - DNA, 1159 bp, Homo sapiens
agccaagatcacagcactgcactccaggctgggcaacagagtgagactccatctcaaaaaaaaaaaaaaaaaagaataaaaagtttatcttaggtgatccaaagaagaaaagttatattgtttaattttatatatattcaaatttttatataatttatatgtataaatttaatatatataaaatgtattcatttataggtatttgtatatgtatgcatgttgcatttttagacaggcaaaatttacgtgaaagcagaaaagagcaagagtttgctatctgccctcatgtgactattttaccttataatgggtgcctagggtaaaagtatgctggtgcaatggcagggttctgggttggtgactgtagtaacttttgaccttaattagaggaatctgggaggaaatatctcacttctttcttctctcctagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctgggcttatattgtcagagcttttatttctttcctgtacgtgacttcttacacagatagtattttggtgttttttctctttccatccacaatactgaatggttatatttcttgtcatctattaaaaactattctgctcacacctgtaatcccagcactttgggaggccaacgcgggaagatcatgaggccaggagatcgagaccatcctggctaacacagtgaaaccccatctctactaaaaatacaaaaaattagccgggtgtggtgg

SEQ ID NO: 124456 - DNA, 1037 bp, Homo sapiens
cttgggaggctgaggcaggagaatagcctgaacccggaaggcagaagttgcagtgagccaagatagagccattgtactccactctgggtgatagagccagactctgtctcaaaataaaaaaataaaatgaaataaaataaaacacttttaaagtattttaagaggcacaggagagtgggaaatgtctcaattcaaatagtcttgatttttttattattattattttttagtccccagggaagaagcagtccttgatgttttacaaccaactaaatcctttgaggaatcttagaccttttcgtagcattatcttttctttttagcaggaaatcctcatggttttctgagtgtagtctccagactggcagcattgatattccctgggggctagctggacatgaagactgtcaggatccccccaagacatgcaaaatcagaaactctgggggtggactgagcaatctattttgacaagccctcctggtgatttggatgcaagcttgggcttaggaacactgacctaacccaaacttcaggtgtcaaaacatcttggaacacattcccaaggggacataagggcaagcagacaagaactgaggcaggaccaggctttggcacaggataagggattagtgagatggtagatttcatttttcctgaaagctgattaaaactggcaaatatctctggagaaagatgtcctggcatccttcagtgggttttacctgatgtaagaggatagaagatgttagtgccctatagccgtatgacagctaatctgaactcattcccaagtgtgtgggaacacagtgaaaagtatagtcctaaaactggtctttcttgatttttttatcttagtgagcaataaagtgaaaatgtatttgttttttttttcttttttccagtgtgctcaccaacaattacaaccaaacaacaatttttgttgtagtaccaaaaaacaacttttctaaatacaaggaaatctaagagatgactatttacaacatatctaaaactttcagagaatagagagtaac

SEQ ID NO: 124457 - DNA, 1053 bp, Homo sapiens
tctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccgtgagtatccccagtccgttcctgctcgcttgggggctttgcacctgcttgggagctctttggcttccctgcctggtcagcgactcactcgttgcatcccgcgcccccttcccggcttcccacgtctgcgcgcccccggcctcaccatccgtccccgccggggaccgggcgccggcgcttgtcgcagtctcttcctttcgttcattgtgaagccgcggtctctcaggctcgctggccgcgtctctgccacattgctccaccccgccccctcacccaccgccttgtttttcaaacattcaaccggacctctccgctttcccaccccgtacccttctgccgctcgctcctgacatccagacgcatctgggccaggcgtggaggcgcgagagccgtcagggcttgcggacagttttgcggaatggcgtggcctgaaactgacgaggcggcatatggctggtgtgcctctgggttagctcttggtaccctcgggattttaattgaggccactgagtaggttcacaggatgtccgctgcttccgaagtttgtttcgtgctcacagtaaagggatgtctttttgtttttgttgttgtcagttttgctagtacttggtgctttttctgtgtgtcttgtccatgatcaatatcctaactccattttaaaccaagtcctccaggaaataagcgagcccccacccaagtcgtttctttccctgccaaccagcttgggcctcttagttttaacgctgcaggctctctttgtgattttttgaggcgcaattctgggtgaacaggaggatgggcaggacagatcgacatttattgaatgcctatcacgtcccaggttttacatacacaatgctcgttcatcattctgac

SEQ ID NO: 124458 - DNA, 1520 bp, Homo sapiens
catgactgcaagctttgaaggcaagacagaaacaggcattgagtacgcttttatggctagttagtaagaatctggtcaacatggtcattaatagtagacttgggaaaaaaattttagaacacctggtgatacagttccttggagatacatgtcaagtttcagatcaaaattcatctgtatcaccctgaggtatgcttatcaccctggctgtttattaagtaaatgctgaccagttctctagggtttttttttttttttttaaatcagtgtgagtggcctgcttggaactttaaattccttattttgtgacctgagttctgttttttttctgccaatgatttagtcatctgtttgccagacacttagtcttacagtgcctgcttacacagagtggaatgtctactttgcatacttacttcactgaagggtctatatcaatgtataatcttttttaaaaaggcaagttattttaaaatgaagttccttgctttctagacatcatttttagttgtatttagagtatatcaggaaagtgaggcgaaagaaaggtgattctaaagggacatattaagactatttaatatctattctaaattattgaccttcaaagtgtgtgttctattgattttaatagctatgcagtaaaacttaatgaattggaaattcacgggacaataaaaatggctagcccttttaaatcatagactttttagacaaagggacatttcttaaaatgaattagtggctgcttgcttcttttacattgtaaataggcttaaataactgcagcagtttaaagtggaggcaagtgacaggtaaaagttggatcaagtcttagatagatgctgaaaatgtgccatggccattatttagcttctatttctcccctgatctctttctcaacattttaagatgaaaaaaatgtgaggcagttggggatgggattgagcatgaagacttgggagacatttctctataagtcatgaatagaaacattctttgtaggttctaatcccaccctggtcactgcctctaaaatgtgctcaacgctacaggattacatttgaggtcatttctaaaagtgttggttaaaccaggattgcatatgggaacggcagatgcctgaaacatcatcattgctgtgttgaagcattttactgaggaacttaggactgtatcagctgaactgtccacatgctctggtggcttgctgatgagcctgagattcgtgccacattcatgatcagctcagaaagcatgtcactaaaaacaagttggaagtcccaaacaaggaaatttgatcactaggcaaaatgttaacagttgatttttcttgttgtttatggcttgattattttagttaataggatcgccagtactggacaagcttaaattagtgtagtatgtgttaacagtttgtaaatatagaagaaaagggggaagctacattcctgaattcaccttcacagtattctaagagaatgacttgcctcagagcttcctgcatttaaagaaacttt

SEQ ID NO: 124459 - DNA, 1047 bp, Homo sapiens
tatatggcttttgagttaagaatatattatagatggcacaggtgggagcattgagactagttacaaggctattgctataatttgcacatgagatgatggaggcttggattagtatggtggcaacagaattaaaagaaatagattctgagagtgttttggaggtagggcgacctgatttactgaaagggacaagtcacagattactatgatttgtggctcaggctcaaggaattggcaggatagatttgccgttaactaggatggagaagatggcaggtggagcagactttgggatgaatgagaggattcagtattggacgtgatgctaaagaaacccaagtggaaatgtcaggtagcacttacagtaaccacactgttattcaggggagaggacttgccaacaagttagtgagggtagatggagaagggcagtggtccatggattgaagtagtgcatttcaaacattaagagattcaggagatgaggaacattcagcaagggagcctgaaaaggaatggccagtcaggtaggaggaaaattgcagagaggttggtgtctcagaagtcaagtgcaaaccatttcaaggagatggggaccgagagttggttctcgaatttgtcagtgaagaagtcgttgaaaagagcagttacccttttatttttcttataatcctctgaacaataaaggcaatgtcgcagtcattctggctttcctgtgtgcccggcacagccctggcatgtggttggcatttagttaattgaatgcaggaatcagtacagggttcttctgcccatacttcatttcttgtctcccagaaatgctccaaagaaggaagtggtagagtggggttggaactttgttggcagctgtggatgtcacctcaaactggttacccttggaaaatgacaagtggaggtcccttactttcaatcacctttatataatttccatatactttgtatttttttgcctagtaagtataaaagcagtggcatcacggagagccataatgaagaaaaatattcgcaagagcacttcaggccttc

SEQ ID NO: 124460 - DNA, 1026 bp, Homo sapiens
aaatttgcttgccttccactaccatcataacttctctgttgcgttagtgctaacaaaacatttttgaataatttacaacatctaatctgtctttttgaaatgttttaaattctttcatcctcaaagcaattcacttaccttggaagaattttggtactaaaaaaaaaggtagttgttttcacaatattaaaatctgtcttttcatcttgttcttgaaatgtggtggatatttgatgaaagattgaaggttatgtagacagagaataatatggaacatcattaggctgactttcttcccctccaaatattgtatagattggagaattagcgtttccttgtcctgaaagggtaatgagcaatatcatgtgctctttgattcagcagtgtgttttgagcacctcttaatgcttcacactcttagccaggtgctaggaatgtaagataacatgggccttgattgtctggtgcttaaagtgtagaaggcccatcagaattccaagtatggctgggaggaggaatggtggctaatgaataacctcgggcgataatccaggcccttcccatcttgggatttgtcagcctgggagtatggactttttctcgagatcagaaacaaaggacagccagcatagaaatgacctgatctgattggctttaaaaccaagaccacaatgttaggaatagagtttagccggaagtaatagaaacccagctatcactgcttaaaatggtaagttttattattttcacggaaaaagaagtcaagacccaggtaacccagggcatgtgcataattcaagcatattgtcatgggcccagtctccatctgctttcctgcccaactatccttggcatgccaccaaattacatataaaactctaggtaccatgaattgttccaggccaggcagaagatggtctaaaatgtctttccttgtaaagccttgtcttttggggggaaacagatctattgaaatattatcgacacagtaaggtgaatatacttaaagtataacattttataagt

SEQ ID NO: 124461 - DNA, 2591 bp, Homo sapiens
cagtgcatttgggctttgaaggaaagataggtgatgtccatttgaagagatcaatatgttggaccgagcttggcatctggaagtttttgtgtatgtgatttcttcaaaatcttcagtagcatgcatttaggctcttagtaaacagatgacttctgaggctctgtgagaattttgcgtattatcagtctttttttttcttttgcaagaataaagcacgcctggggattaatgtaatttgttaaaacaatactgcctattgagatcttgtgtgtattcttgtattaagttttagtgcttatttgtaagagactacgtaggtgcctgaaggatattgttgatatttaattaactggcattttccccattctctctcctctctctcgtcctctacccctgccccctgggtgtttttgcagttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctattttttgtatcctttttaaaaatcaagattttactcttgatgactattttgatggttacaactaatttaatattatcactaggaaatttattgccagaaagcaactccaagcaagccttatgcatatttgttcaagaactattagaaacatttcttagggtaatgttattgtacgttttcatattctcaccctgtccttgtgacaccctgaagaatatattctgcaagttcagtgtagtcctatttatgtattgtaaattcagagttaaattgaattgatttggtgacttctaggcccttttttacacattaatgtttggttgagaatttcagtgttttttttagacttaatattaaaaaagcttacatgtatttatctatacctatgtctgttttgtaaatgtaagaatttttattttattctgaatgaaattctaatctagttttagttatgtaattatgactaatatttttctttataaatttgatgcaactatgtattaccaaaataataatatgtgtatcctttttgaactttctctaagtgccatctgttctgtattctgggttaattacttcttgtgcattctaaagttgtcagtacctctgtacctctgttttatgccattctaagaatatttagaagtatccttaacttctaactctcagtatatgattattctgttacttgtatttattgttcagttttctgtatcttgcgcttgtttagccctgaaccaggagcaacaggtaagctaagacttttttcttctactttattataccacatagcatgagtatgaaaaaaaggagggtaatgattagaatataaaataatttcgtcttgcacagaatgccaccttcactctggatagcaaaactctcttgttccctttgcattagtgcagcaggttggagccggacaccatcaggtgttgccattttcggtatcttttaaatcggattttgctttcactgggttaaaaagtgctatggctaaaagatgttcccccaatcttttcccactattatgcaatgaaacatttgctccagaatgcttgtggttccagtctagcaatgactgttttcaagctctaattcgtagacaaatccaggtttctgtcatggagcaacagaacttttgccttgttaacactccgagaattatgcctttgaaccaagtgcttcttttaaattgcatgtaaattcttttaaatgcatgtaaaaaattaggagtttttcaatcttgggatagaaatagtgccttaatttttgctgcaaactgaggaataagcctttgaaaagttttaaggatttttaaaataaaaattattttaggtacacttagtactaaaagttacaggctccagctttatacattttctgcagggatgacacattttatatattaaacacatttactagggtcagcttctggaggttggttggaacaatacggcaagtgctcgaaatgacatccagagaaatctaaactgctgtgggttccgaagtgttaacccaaatgacacctgtctggctgtaagtacattgtataatatatgtttttggaaatgtattacagataaataatgattaatgtggaagaaatggactttctgatgctgaattgtattttcaggattattttatgtatatatttacattatatttccatgtcctctgttatatcatttgcctgttctcaaatacccactccagagagtgttgagaatttcaaggccctattggacacagatgctaatggtttattgtccctaatttcttcccatccttctcttcctagaacaagttgtgaaagaaataatagtacgtcagttcatgtgttcatattttggggaaactcctgttatcacatctctgagccctaagctgaatatttcctcagtgaggcttcttttgtgagattatctccttgtagggggtctgtgttatgtttctgttgctgcgtaacacattattacacagcaatagaaacacactggctttaaatat

SEQ ID NO: 124462 - DNA, 1035 bp, Homo sapiens
tcagtctttgtggctgtgggaccacccctgtttttttgctgcctgttggctggaggtctctctctgcaactagaagctgctctcaggtcctatgttactctttcacaatgtggcagcatcaaagtcactgtgagaatctctccattctgttaagatggagtcttttgtaatgcgtaatggagtcttatctgatgtaaggtaacatggaagtgactgtcctatcatattcacaagttccacgcatactcaagagcagtgattgtatagggtgtgtacaccattgagaggggagggtgggagtcttgggggctgtgttagagatttgcacactaaaaaaccaaggcctcaaattggatataatactcttagacactaattttgtgtgtatgcagtttttatgggctttttataaatgtattttgaaataaaggtttttttactttaattggtgcagagctgtgttaaaagtgaccactcgtgctcgccatgtgctccaatcataggagaatatgctggagaggttttgagatttgttggtggcattggcctgttcttcagttttacagaggtatgtgcaaataacaatatttttcctcctttgtcacagagattcctgttttgcatgacaaagggccttgattcttgttatcagtgagcattttcattgagaactagcactgtaaaaagaggaaacttggtttagaatcagaagatcttacaagtctattaatagcaccaactttaggaccgggtgaaaggcttgatctgtctcttcttatgtaaaatttaatgaactaatgagtgagattagattgaattatctctagggtctcttctatttctacagttgtgtgatgaattataattttaaatttaatttggaaaaggtaggacattcacattgtttaatatgtatgttaatgtctataatacacagacatacatatataaaaagattatatatctttttatatatatcttgaaaaattgccttcctacaccatttttcattcccctgttcctagccttctaaaa

SEQ ID NO: 124463 - DNA, 1394 bp, Homo sapiens
ccttcagggccagtcattcagtttaccacagtgttcgttttaattttttctcagcgcccgtcatttggtttacttcatttcaaaaagaaaaaaaatctctccccgttgaacaaaagatgcaaagcgattgagagggtccaaagttattttattgatcaactgaataaatatacataaatgttactttctttttctttactttatttttttttccccattccagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaattaagtgaggtggaattcttttctttctgctttagcttctctctgttggac

SEQ ID NO: 124464 - DNA, 1027 bp, Homo sapiens
cacatttattgagtcttaggcaaaattaagaagtagcaatttatattttataataccttgatgaattttttaaccaaaacacttctattttagtcttcgaagaaactcttttcttcttttccaagataatcatgattaacttacaaaaatgggtatacatcttcaaaacatttcccttaataggaaacttagctttacaggatctaaacactaaaaggcaaaaaaaaaaaaaatctattttcttttcattacaagacaaaacagaatccagcataagtcaaggaaacacattcatacctcaggtcctcctcctccatgaaccaacattattatattatttccgtttagcaaaatctgatctaatttagtattctttcttctggtgggatttcaaactcagtgatatcttgcagtaccatattgacaaagttatcaaatcctagaagagtatcaacaatttccttatcagttttcatcacaatgagaatttttgattcttacatttgtctacaagctctagcagtagcagctgtaaggagctggtactagtgttagccgccataactgtgatggaaatggccttggttaacatttttttttttggacagagtcttgctctgttgcccaggttggaatgcagcggtgccatcttggctcactgcaacctccgtctcccagattctaacgattctcctgcctcagcctcctgagtagctgggattacaggtgtgcaacaccatgcccagctaatttttgtatttttaatagagactgggttttgccatgttggccaggctagtctcgaactcctgacctcaggtgactcgcccgcctcagcctcccaaagtgctgggattacaggcgtgagcccaccacgcccggccttgattaacatttttaattttaataacaagcaaataattctacaagcttctagacaagaaaaaaagataggtcacacaataacgacagatggtcctcaaacctttcttccataccaaatagaagatggtgtacactaaacagt

SEQ ID NO: 124465 - DNA, 1045 bp, Homo sapiens
gcttgttattaaaattaaaaatgttaatcaaggccgggcgtggtgggctcacgcctgtaatcccagcactttgggaggctgaggcgggcgagtcacctgaggtcaggagttcgagactagcctggccaacatggcaaaacccagtctctattaaaaatacaaaaattagctgggcatggtgttgcacacctgtaatcccagctactcaggaggctgaggcaggagaatcgttagaatctgggagacggaggttgcagtgagccaagatggcaccgctgcattccaacctgggcaacagagcaagactctgtccaaaaaaaaaaatgttaaccaaggccatttccatcacagttatggcggctaacactagtaccagctccttacagctgctactgctagagcttgtagacaaatgtaagaatcaaaaattctcattgtgatgaaaactgataaggaaattgttgatactcttctaggatttgataactttgtcaatatggtactgcaagatatcactgagtttgaaatcccaccagaagaaagaatactaaattagatcagattttgctaaacggaaataatataataatgttggttcatggaggaggaggacctgaggtatgaatgtgtttccttgacttatgctggattctgttttgtcttgtaatgaaaagaaaatagattttttttttttttgccttttagtgtttagatcctgtaaagctaagtttcctattaagggaaatgttttgaagatgtatacccatttttgtaagttaatcatgattatcttggaaaagaagaaaagagtttcttcgaagactaaaatagaagtgttttggttaaaaaattcatcaaggtattataaaatataaattgctacttcttaattttgcctaagactcaataaatgtgtctaattataaacacccaaggctgtgttcagtttctagaagtgtttcttcttatcatctagctggttattgattttcattatgatcaactctttatttctgtaaaacttgttttccagatttgagatgtt

SEQ ID NO: 124466 - DNA, 1035 bp, Homo sapiens
ggattaggtccattcccggcactgcccgtggaatcgaggtttggaggccggctgggagacagaggacttggattctcccgttttcaatgattgcattttaaaaattgtcctcccacccatcctcttcccccgcaccagtgcatacacaccctctcacatttgcaactttgttctttctgatttggtcctgatttgttgacagctctgatctgccttgggctaatggattagttagtataaacctgtcttgaaatctccttccacttttcatatccgcatgggttaggttagaggacggtcttaattctcattcttcgtagagtttggtaaggcgagatgttttaaagagctaaacacatgctgacttttacgaaggggctgagtgcctctaaaggtactttttggtccccaccaactggctttgtgttgcgctcatatttacttatttggcagcaattttgtagcgctcatcgtgaccatatcggtaaagtggatagaagtggtagcaggtgggagtggatgcaacggacaggatacggtggaggatttgtattcttcagacatctttttcggaagcttgcttatcacttttggggtggctttagggtctgtaaaataaaagatttagaactgcatttgagagaggttttcattcttaacatctacctctaattcttttccccttcaaagttttcttctagttgagtgagtacaaacttgcttttgtcgttgtcggttgattttggtggaatatttgtgtgagatggccaattttttgtgtgtgtcagaaaaaactatccgtgctcaaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagt

SEQ ID NO: 124467 - DNA, 1050 bp, Homo sapiens
tagtacatatttgagatgtactaatttaacaattaactaccacttaaaatttttttggtaatgttttagtgattctggtaaggcagatacattttatgcgggttcgagggggaataaaaatgtgtgtttgcgtagaagaagggggaggggaaacaatgagttttccaggattatggaactagtagtggtttctaggccatatttcattttcctgatcttccctgctaatgtcttgtgctagaaactatgctgtttatatctcatcatctctcctcaggtatagcaaacaaaagggaaaggaaagaactcatcacaattatagggcagcagcaggagggtggcagaagacttctgactcattaaaagtggcttccagccagaattctcagaagtttttgtagatgtttttgactcatatagggaaataaaatatccagctgtgttcagcctgacaatgaagttggggtctatttgtgctatgtgtcacctccattacattaagcacatagtttatgattgtaaatatttgaaatttatattcagagataaatacggatgcactgaagctgggggaaggaaatgaagaatgaatggggttaagagttgggctttattgggtgtaggtagtatggtagggggattttattgaggaatacttcagatttcctagctgttagatggagagtagcaccatagtgctgagaagcgggtgcccaactccaggggaatgttgaatggaagggcacagggtcaggtacagggactggaaataaagataaacaagttatgggtaagtagaccaacgcagtaagagtagattaaatcaccccgaggaaaaatccgatagagcaaactcagtactgtgagaggcaatctcttgttaaaaaacgtcactttgatctcataggattactgaaaccatatctttgcatgtcattttgaggttttataatgaatattatataaaacagttatatttatgagtaaacttggttaattttttcagctttgcttcaaacactggctacaaatgatgaacctcatagactt

SEQ ID NO: 124468 - DNA, 1151 bp, Homo sapiens
cacagagaatgaaattataagggtgacccttatgaactgaaaaaatggtagatgcaaacgaagagatttgaaacatgctaacaatgattaggatttttgtgtgcagttggacccactcttccactattagggaaacagtatagcgaagcgaagggaagctcaaagtgaataacaggatgcaaacagggggtgtgtaaattcctgcggaaagaacaatataaacgagtaatcatacaatcttgttagaaaggaaactcaagttttactgtaacaatagatatttttccaagaaaatacatctatttattgcaagtttaaataatccaacttggatggatcttcttaaagtttggaaccatgactatactgctgctgctgtctgaaaagcaacactataaagttttaagtactacattaatatttatccatttctaattaattaaaacatattgaaatataactttaaaatacttgaacaaggcttagcaatttttcagttataaagtcgaaaatagtttctttgacatgatttaagcattacatttaaatatattatctctgagatggagggtattttaaaaatttaaataacaatggttacaatcaataatagtttattaatagagactaggatttgggtggttacaatctaatctttgaaactggttgatgtgaagagaaaggattgtttcctcctatatcatgtctctcaaaattgttaaacagtgtacactgggcttgttgatcaatctaatcagcattgtaatgtttcattcctaatttcagcatatctttaatacaatttttaatgagatttccttactattttttgaaatgcccattattatgtaaatattttgttcaaattattctgtttttatacagctgccccaaaattgagaattcgggaatgactacttttgttttctgtttacatacaaacacctaatgagcctgacaaaatggagcttagggatccgagtttctgatttcaaagtcttgcatttgcagctgtcatagggaatagtagtattctagttatttttaaaacaaggtaatgttagggaaaatctaagtcttgaatcattatacatgcttaaaataatcaccattttataaaatgtagaattatttacatgttaaaatatttt

SEQ ID NO: 124469 - DNA, 2144 bp, Homo sapiens
aaagcatgtgatatgaagagatgtggcatttagggagtaggggaaatctgagcttagatgtctaaggaaggaaagtaccgtattaggaaacatggatatggttaaatgcatgtgggaataaaacttgagtcatctgtggtatgaccatttgataatgctgtgatgtatttgcactctaaattccatcatttgttagattaaattcttatttgtattgtacgactccttcatagatctttcaatgaggaaatagtggaaatattttggtggtttactatcttaacattctactgaatgttcagagtctgattctcacactttggaaagtggtacatatcctcactgatggggaagattttaacaaatgcccattacggtacagcagatacttcccagctggtgacctattttcagatactacattttgtttctgtggactgtcataaatttaattccagtggtgtaatatttaaagtgtcgttatgcatataatttatgtaacaatttacagttttgaagtatagttgacccttgaacaatgcattaataacatgaacagccgattaatgtgtcttttgtatatgtattatatactgtattcttaaagtaggccagagaaaagaaaatgttattaagaaaatcataaggaagagaaaatatatttactgttcattaagtggagtggatcatcatacaggtcttcatcctcattgtcttcatgttgagtaggctgaggaagggttggtcttgctggcttgggagtggcagaggcatgtaagtggacttgcatagttcaaacccatgttgttcaagggtcagctgtactttcaaatgtgtcatatagttaccatagtaatcctattagatactaattactgctttccacttaaagatgataaaaatactcagttacctccttaggggcactttaattgtaagtttctcatcatggtttgagggtgtataaagtcagcatagacttcgttacctctgtccttgattgtcagtgattgattccaggcattaccctggtattgtacatgttattttaatcctcacaagaatttgtctcaagaggtagcattgtcctcatttaaagatgaggaaactaaaggtcaaaggtagttagcaaagtgggcggtggctaataatagctcacacactgaggtctggctacctgagtttttgtctaagctctgccacttaaatctctatgactctgaacattttctcaatctccttaagtctcacctttctaatatattgaaataacagtgtcagtctcatagaactattatgaagattaaataggatataatacgtggaaagtgctaggtgtacagtgtgtgcccaatatcacatatgagtactaagtaaggtcactccaatggtaggaagcagctcttgtgacagtgtctcatgtcactttcttactcattgttttctttctaatcagcacaagcaatatatacatgaaaatgagtagtattgatagagcctctagtaatttactaagttagaggtagtaggcatgagagcaagaaatagaagaaaaacttcatgcaggggtagacattacatagtttaggctgaaaggccatgacataaaatgtttcctgaaaaagcacagcagtgtttttttaaatgattttaaaagtccacccttctcagactcatctttgcacaatatttacttcaattatttaccagtgattaaccttaaacacaagagcaacagaaatatttgcatatttgtttttggtagaaacctccagtgatcattccgccaaatgaacttgtcacttttcctacttatgtagtagttacacatattatctatcatccttccaacatttggaattataagcattgttgtttagaaagaatttgttctttttattttttctctacttcaagttcctgtaatactttaattaaaccctattctggtacttagtatttttgacattgttttctagttatttccatagcttatatcccctacttaaagacagggtctgactcaagtgtctaattacattggctaatactcccagtacaagcccaagaacaaattataaattactctaagatgaatggtctctttcattgcttagtcatcttctcagtgatcaagtagttat

SEQ ID NO: 124470 - DNA, 1048 bp, Homo sapiens
ttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaagggcaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaacttttggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccataga

SEQ ID NO: 124471 - DNA, 1216 bp, Homo sapiens
accatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaagtaagtgagactttttcacttttattttattggatgtacattatgtttcagtaagtctctcttagcatgtaaaacatacagtgtatgtaatattgtttattattagattggctattatcgtacattcttccagtgtagccttttacagtaaaataatttaatcaggctcacaaatcatctttttaatttttgcaatacttgtctcaaatgatgatgttc

SEQ ID NO: 124472 - DNA, 1133 bp, Homo sapiens
ctatattgatttgggggtttgataatttaattttttaattttattttagtgattaagactggagaaagtggcatgatagttttccggcttcttacaaaaaacaaccgatggacttgggtccagtctaatgcacgcctgctttataaaaatggaagaccagattatatcattgtaactcagagaccactaacgtaagcacaaataatgtttcctgttttaacagttttgttttcataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacacatgaaaagctagtgtcattggtaaaaaagaagaaaaatataacaatgctttatttagaatatattctctaaacccagcagtgattttaagagtttcttacacatgctgcagatgagtcctttatcaaatatttgtattgcaaatgtttcctcccactctggagaattgatttttgtctgtagcttgaggtaaggattgattccccccagccattatacgtatacccaattgaccagtaacattgaaaagatgatttaccgagaaggtcattgtttcccggctgcgctgtattttgatcaggggattttgtctgtggttctctgtctggattgtgttgttctattaatagctccattagtgcagttgtctattttgtctagcattacactgtcttagttattctatctttattatatatttctatgtcagagtgtgtcattttgtttgttttgccttttttgttctccttcaagattgccttggttcttctttgccctctataattccatatacattttagaaagcagttgtctgaaaatctgttgagattttgagtgcaattaccttgaaactgtagatcatttggggagaattaacatctttttaatactgaatctttgagcccatgaacatgatgaatgtatgtatgtgtataagtacccatggaagtacatgagtatgtgtgtacca

SEQ ID NO: 124473 - DNA, 1114 bp, Homo sapiens
tgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaaggtaagggtgttatcaaactgaattaaatctttcagtgattctttttaccttatagacatgttacacattttttatgtcagctgattttaatcggttatctacagcattcatggagacagcattttttattatatctgtgactaccttttttttttttacaagcctgtactttttccagtatgttactaatatatcattcacctgattcatgagggagaaagatatcaaggaatgaagcaacatgaatgtgtc

SEQ ID NO: 124474 - DNA, 1024 bp, Homo sapiens
atttttactatagattttatatatgttttggaggatctgtgaagtaattaacattttgattactgaagccagttatgtaggctttacaaaggtagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaatcatacctgtggtgtaatattttaggaatatttagaaacatttagaaaatcagaagctgccttttttggaaaagttttgcattccagtgtaagattcctgaatataatcaattcattgatacctataacttcaaacctggtcaaagcaaacctacttatgatagagaatatttaactgtaatttgtgacttgtgctgtttgacccatcaattcctacctgacccaaaggcaatctgaaatgagacagctgcatcactcatctgtaccatgttcaaaatttcctgtcaaattaatggaaaaacaggttataaatgcaactaatacataatatgtcctcagtatgtcttcactgtgtgaaagatttaaaatttagcaacagtaaaggaacttgaagtttacaactctcaggggtaagattttaaaaatacatgttaatgttatttactggcttaagatacttggaagatctattccaataagttgcatcaccatttttgttttcagtttcagaatggagttttaaatgaaacatatccagctgaattaaataacataaataacactcagactaccacacatcttcagccacttcatcatccgtcagaagccagaccttttcctgatttgacat

SEQ ID NO: 124475 - DNA, 1036 bp, Homo sapiens
gaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaa

SEQ ID NO: 124476 - DNA, 1056 bp, Homo sapiens
aaaatccaaaatcctattttaatattttaagaatatttctgaagaaattcgaaataacccttgttagctgtattttgtgcttagtttagaaaaaccattgcccaaacttagtatttctgtttaataagtataaatgatacagaagcctttggccttaaattcataactgttgaacattcatggaaaaccctgcaattagaattgattgaagaagaattcctgagaaaatgttttcattcttgtgacagttatttttctattagttttatatttgttctttacaattaggcatttttctcaactagcatatcataagttagcatcatacttaattctgaacattttagactaatcctgagtctttaagaattacataaaatatttagttttaactatttgatctgaaaaaaatcaagtaaaaatcctgataacctgagtgcatctctgcttgcgcttaggtgatttctgtcaccatgaatgactctagcttgtccaatttcaccagctctaccaaacaccgacccagggatgttggccactgacagggctggatgacatctctcatttctttcactgtctgcagatgaccttgcttccgtttttactaataaaatcaaggatatcatcctaagtttgtaccttcacctcagcaattcctctatccttggacttacctccagtatgtgaggaggagagtttcctgaactccagggttagcccccgtcctctctcgttctcatgcacacagcttcgacacctgctttctgagaggctctccttctctgtaggatttcctgtgaataggtcctcctccatcctggaaaaaaattacttgaacctgcactttcttctctattaaattacttctttaccttcttcctttgtaacaacagttttgatctcctgagatctggttttgttttccatccttccattatattgcagtgttgcggttcactaaacttcttaccataggctcattttctatggccctgcaaccaaactgattacactttcaatgaacttttttcttcccttccatgacattagttgtcc

SEQ ID NO: 124477 - DNA, 4769 bp, Homo sapiens
atgctttgttattctagttactgcttatttgctcattcatgttcttttcaccaaggctaatccttcatctcattgcacctatcaaaatcctgcccaagtagaaagtctcctttacctgccacttccttaaagggaacttttctttgttatcgcatctgaaagtctccccactaccaatattcttatacttttagcatttttatggtatagttactatgccaggggtttttgtagatcagggattaatttttttttttcctgtgttccaatgaaactttattcaccatcatggattagtttgtttccttacagcatttgtcactattcattaggcctactaagaatatttgtataatattacaaagtttacagatcactttttacattatttcattaaagacttataaatccttataaggatgttattataaatcctccttttcagatgagaaaagagagtcagggtggtgggtaagtatcacatgggtattaagggacatgtttgtaatcatagtttgggatctttgagactgttttttattttttatctcttacacctgtgctatattgtctcccagtagcttttgcattaagtgcgtaaatagatgcatgcatgcaaagatgcatattaagtttcagctatagtacatagctgaaatgcattaactggttacctactgttcatcagttactctgctgtgtaccttaatttaagaacatttaagagtttaggccttgtgtttcctttgaataattatgtgtgttttcctccacttcatttagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaacatttttgttgagttcatttaatagtaatgtatttttgttacttttaagatgcttgctcagtagtcttatttttagtatctgtttgtattttcttttcttttagatatcaaccaattcaagttccaggttgatagatgagtgcttgagtgattactgacttaaatggactgaatttaactttttcttttatggggcaaataatttacaccacagtgttaaagaaactttatacttcctcatcgtatcaaattataaagtattttcccacagatgaaaagatttataattagtaatccattttatttgatctcattttaaattcatattttggctaatattttagattttgccattctaaaagtagattggtcataatatttgcatctttcttggagctgtatcaacagacttctaaggcctcagatgtgataacttctagcccatcagggattggc

SEQ ID NO: 124478 - DNA, 1950 bp, Homo sapiens
gtaagtctctctggctatgttgtaattttttattaaatattggaacctctacaaggaacaaaaattaagtaggtaccctacttcatatttctttctacaaaaaatactgagcgcctcctctgtgcctagcactcagcccattgctgagataagatgcagtcccttgaggaaagtacagatagtagagaaataaacctcttttctgaaagtgaagataagcaatgcgtaaaaattcatggcatcatgtattttgaagggaaggaaaggaagcaagaagggaactatcagtattgaacactaagttcttggcactgtgcacagtactttatgtatgctttctgattttatgccatttttcgaggtaggtatttttgtctctattttgttataaggaaattgaggattagagaagttgaataggctctcaggctacaaagtggggaatctggtttctctaatctgaagctaagtttcttcccactgtaccatactgtttccaaaacttggactagctgccctggcatgttcattttatttcagggtaggtaaatgatgttcctctggagtggtgattatcagctttggctgttcattggaatcacctctagagctttaaaaattactaatgcctagatcccatgtccagggagtctgacttaattaatccaatgaaaggcctgaacatgaagagcctgtaaagctctcaggtgcttctaatgtgtaaagttaagaacagctgctctggggagtcttgcccttacaccaaattcccagatgaaagcttagtttttgtgctcagtccctgccttcagaccaagaattagggaacaggagtaaagcacactgaaagttaagaagaatgggttgttttacttgtgaaaggaccattatagtcaatccatctgtaagttgtgggcttagaatttagtattatgtaggcttaattataagaggagtgggatggcataactgaaggagatagctattaaactctaaggcattgagattcaagatattgtagggttgcatttggatgagatgttcaatcagcagatgcccactttgagtttaaatggctgtgatatagtcatgtacatattccattttgctgtcttcattagtgtttatgaactgcattggtgcagactttatctggtatttttcttgtgttcgttttttttgaacccctaaaattgaaccctacacttagttgatctttcttgaatatcattatagctatatgttattattcagaaacttttctttctgttcacatttgtattttctgtagaaatttgaaataattttatcaacttgtatcattagaaaatgaaaatgtttacaaaatgtatttaatcttctcaaatagagatgcattttggccaaatggcattttagcagaggctgttccatgcagagataaaagtattcgaatgagaacaagagtagcaggaaaaacgaaattacttgcaattatgccaggtgagtgagcatgtatagttaaaaatctttataatttgtcattcttctgagtttttagcattcatcatgccagtgtaactgccttttgattataacaactaccttttgatggcttaatacatatcaggcactgtactaggcatttctcatatgttcttaatcagtcctcatgacagtactgtaaagctaaggactgttaacatcaccgctttatatgtgaggaaacggaagctcagagaggttaaataacctatccaaggtttatagctactaagcaacagttggtattctgacttggctttaagtgatgtgaaagcttatgcttttagccacttcgctctgctgccttgaaacatattgggagttaagttaaataaataaaatacatgacaggtgaaagggctaataaaatataaagtatgaatttttcaggaagaatatttgttgtacttaggaaaacaagttatt

SEQ ID NO: 124479 - DNA, 1064 bp, Homo sapiens
gctcctaggctactaacctttacagtatgctactgtactgaatactgtaggcattttaacacaatggtacacaaatgtgtatctaaatatatcgacacagaaaaaatgcagtaaaaatgtagtattacaatcttatgggaccactgtggtattgttgaacaaaacgtcattatgcgatgcatgactttttggctttcaagtcatttgacctttcttagctttgaattcttctaaaaaatatgggagtttgactgactaatttttatttctaactcaaaagtcatttattttgtaaaggagaaaacccttttagtaatgaaataattaccctttatatttggttccaaattttagattgttaaatttggcttatatattgtaccaaaagtcagatcaaatgctgatactcatttaggtttatgattgtgttgtgttctttcactgtctgctttagtgtgtttactttgtggatttggttttatttttaggtgcctcctttaattcctaagactgattcagaccctgaacatcgccgagtttcggctcaacttgacgataatgtgagttaattttattcttggtagtatttagtttaagtcatacttggcatatctttttaactttttaatgaagtgttctatgtatcattaatgtgcacatattataagtgttaagcttgatgaattcttacaaactgaacatgcccatgtaattaacactctaatcaaaaaataagattatcactactccagaaaagcccttcatcctctgttcctgttaggaccttcgcctccaccaaggaccatcactatcctaacttctactctgcttttatactttgtatatatgaaactgtaaggtacgtattccatgaagtctgacttttttttgctcaacattgtgatgttcttccatgtggttttgtatgattttagttccttcattcttgtggctttatagtattccattttgtaaatatagtacaatctatttgttatatcatgaataatacttctatgaacattcgtacatgtctgtacatgtttctattggatctatactta

SEQ ID NO: 124480 - DNA, 1044 bp, Homo sapiens
aactcctgagatcaaatcatcctcttgcctcaccttccccagtagctaggaccacaggtgtgtaccaacattaccaatatacctggctttttttttttttttttttttagagatggggtctcactgtgttgcccaggctggtctcaaactcctggattcaagtgatcctcctgctacagcctgccgaagtgctgcaattataggcatgagctactgtgcccagctgaaaatacgtttttaagacacactgaagacaacatttctgtacttttaaaatgtaacgacataatatagaccagaaaattactgcatctttccagtgttgcactctatattttccaaggcttgtcatttggataacaactctggtacaataaagtcatggtataatatcttttttccctttagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtaagaagacattttcagtaatgtctaaagcaaactatttttaagtcaataagatgtattgaattctggttggatttaccttagtcccttaaccttatttcttttccaaacattgctagacacatagtctcataaagaataaagaactaaagagaaaaattcttaccagaaatgagtatagtaaaatccacttgcttgttagtctctgctgtggtagggttttaaaattcatttaaaacaaaaactgaaaattagtaaagttaacattctttatcttgttttatttcattatgccatttttatcatgaagtactattaaatttagtagcaaacaaattctgtcgtgcagatgagttatactagtattcactcaggaagcataaagtcttatttctcctgatttacatgatagaatgattaccagatcaaagagaagaaaagttcatcattaccatcaatctctgggctcatacg

SEQ ID NO: 124481 - DNA, 1028 bp, Homo sapiens
tgcgaaaatgctttgaaaaaaaaaaatccccagaataaaccgcacttgtgaactactgaacgtatcaaagaaaaagaaaattgccagaagataaatgttatcccgtggctgttgctgtttagttgaaaagattttaattgtaatacaactgaagagtgaaggctagtacaaaacatcattttgtttattttttctatattaaatttaagaaattctaattttactctctaaggtaacattagatgtagcaatgtaatgatgtagtgatgtagtaacagaaagctctttggaagagagaattgtaataggtaccgctttgtgattgatagtgtcatactgaacttagtttattttgtaatttagccattatatgtaataccttatggatgtgaatatggaggatgggaatctatcctttgctgacatccttctgtctcagtctgtcatttcagattcttcttcatttcatattatcttttttgttttcttcatcttcctccttttttgtgtctttcgttcctcttcattttgttttaaatgattagtatatgctgactatgacccatatgctgtggcaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacaggtaatgaagttttaaaaacttgtgtactttatgttgtttcttgatttgattttgattataaatctgaggatgcccagatagagtgattaattaaaaaaataaggtaagaatttttggtataatcaccataaatcttagaattaatctgagcatttaaccagtaaatcaaatgttgaacacttcctcagtcctaaccatcatggactagtgacagactatcaagagtataccttggaaaattaaagtgaatacatgtttctgattttaaaatttgcgtgtgtgtattgtgcttttcaaagttttttgggct

SEQ ID NO: 124482 - DNA, 1507 bp, Homo sapiens
tggaattgtttttgaaaactaatcatttaaaatctatcatagtctatggattcacctcatttaataaataatcagaataatagctaacagttgttatattaggcagttttctaaatgtcttacatgtcttatttaatctccacataattctctgacttaggtagtattctcattttatagataaggaatctgaattaaatttaaaaattatttctatattaacaaaagtattaagctaaaaactacagagctggttctagtatatttcaatgtaaatgttaacataatatgtctacttatttttatctagattttcttgccatataaggatcataattgaaaagtagcaagttacagtagatggacaagcaattaagggagaaataatctaatatattaagtttattactaaattttttgttattgtttcttaatctttgctttttttctgttagcctaaatggaaaatattattgtgtatggaggggatggagggtatacaaataatatatagtttacatgcagggaaatgagtaattgtaatgcatatatgatgtagaattctttactcttttttttccctataaaattttaaaaatttgtttcctgatttttttttctcagtctttagatgacctttcaaatgtttcttctgatgactcagtacaacttcatgcctacatttcagacacaggtaagagagtttgaagtataattattgcattaaaactatgtattattatatccctaaataattttccacacttaatttttactaaccatttttttgttctctagtcatagttttgttactttttttctgcagcatgtccttcattaaattctgctatatttatttgcttatgtatttgatctctctaagattgtcactatcaacatttgaaaatgcttatattctaagtgttctactatttctaataaactctaaaaccattcttttcctctttgttcttgggtctagctgatagttgtctgtataattctcgttaaatcttttctggagagatcttagttcaggattagttttcatatatacaaagtcaggctagataactggggtaaatgaagccccaggtataggggtttgcagaacttcaagaagtgcttgaataatgaggtgagaaacctctaaaactttgtgatcattcagcatatgtgaagaattgttagtaaattcggaaaaataaccagttttcatcattgctattgagttattagataacactaatgagtattaaataatgatagttttcttatctgacctcttactgttcttagattgtagaagtgtgtttgtcatattacatactgaagtataaacatactgaggtatataccttaattcagtttcatgcttacattttagacactgaagagattttatagtctagtctagtctagtctagtctagtctagtctagtctagtctagtctagtttaatctagtttagaagacattaacttgtatctttttaaaatagatctt

SEQ ID NO: 124483 - DNA, 1053 bp, Homo sapiens
acttactctattgaaaaatgttcttttatagagatgctatgaaatttgcaatagcagctctgtcaactaaccatcctaaaatgactattataaaagtttttgttgtttatactaattttatctattttagaaatttcttcgtatttgtgaagtggatttgctaggtgactcagaaagagagaagacaaagtcataaccaaataattgtgtgggcttctaagtaatgtgtaatttaaactggtgatagtagcaatatattctgtggaagtaatttttgatcctgtaacttaagaatgcttccagtcctttaaatggatttctagcttccattcatatctttctagccagtctgtcttcttcagtacagctattggaagcaaactataagcagtctcaaacttcctaaaatcatacactgtacttttttaaaacacgaagtacattaaaaaatttttttttggaactggttttgatctgaagtaaatatgcttctcttatatatcagttattgagtaacccctcacatttgaatcattgattgtagtttgagattatatacttatgtatcttattgtctttctaggacattgctctctaatattttgtttcctaattgatgagttttatactgtgaaattacctatcccttttttgaaaccattcaaaaaaagtatatggagtgatgggtataatatgaaacattactatttaaagtaactgtcagctttgttgtctttgtcagtgtttaggttttaggccactggtttacctttctcaactagtaatgcttctgatatacttctttttatatgattatttaatcaaaaataggcctttccactttttttgttataaattagttttctgacttttaaaattaagctgctgagcactacatgcattttttagatattctgaaattttgaccaccttttagacattctgaaataattatctaacctagggattaatgtacagctgatttttttaaagtagtctacatttgagcctaaaattaaaggaccaagtcatatcatatggtatagtactgta

SEQ ID NO: 124484 - DNA, 2643 bp, Homo sapiens
cagtcatattaatacacatctagtactactgaatactaaacactgactcctaatgacagtgtttcctatgtgccagacactatggtatatatcttatatagatcttttttaatccttacaataatcctaaataaccttatatagtattatctccattttacagatggggtaaatgaagcttactgagagataacttgctaggcaaaagttgagatttaaatccgtgtttgtttgccagcctgctatgaggaagagtacatgaggaagagaagggtttagtcctgtttcatccttcttaaacatcaaggtgtcgtttacaaaccaatgattcttacctgccagttattttcaataatatgattccattattatcatactatcaagtatcatcttgtattaagaaattacagagatcattactattatttttctctgttaggcatctccaagagttactgttgatgactatttagtagcaaaattagcagatactttgaatcatgaagatccaacccctgaaatctttgatgacattcaaagaaaggtattattatgtacagcatttatcattttatcttttttgagaaaaaatacttttatgtaatgtaattagtttttaaaaactttctaaaagtagagtggtattaaaaagataaactatggcaattatacttctcaattccagaaatgtaaaccagtatttttgtttatttcgttaattttctgaggaaaatccttaagttgggttgttttatttgaatttgattgtagggctagatattgtagtctcagaatttgatgaattgatgccatataaataacatgtctttcaaattcattttaacatgagccttgaacctttacatgtacttgtttcttagaaaacaattcctagaatgtgctgtctgtgacttgtgttgcagtaggatttttttcaatataatttagttactggagggatcagaggaaatcattagttgtgaaatagtcttattgctgacagcttgtaactatgatacattatggcaagacctcagtgtgtcttttggtgaaattgtgttttgtaaaaatcaccacacacctgtattaattgttgaatatcttgatttatttcaccaaggtatatgaattgatgctacgagatgaaagattttatccttccttcagacagaatgcactttatgtgcgcatgttagctgagcttgacatgttaaaagatcctagtttcagaggatccgatgatggggatggaggtaaggtggcacccattttacacataatatgcatatatatttatatatattctgcttaccaaaagagcttttgtataagttaaaaatgttgttggagtccaaatataaactgtaatatattaaaaaatctacaaatgaatgacaaagtttagtgactatactaaattaaaatgctgaaaatttaatagtggattagaatgtaactatagaagccttgaattcttaaagaagaagaatgttttcttcaggtgagtcactgaaatatttttatggcagtttcccttttgggagtaagtaacaatattcatgattaacaatagaattattgagaagatttaatatgcaataagtaatgactcagagtatatcataaactataaagcattattaaaaaactacagttttaaatatctttaattgtacacttttccaaattctacacagtgtgagagacttttgagctagaaaaagccgcaagagtcatttatcccaaccttcagttttttccagtgaggataatgagttctatttacatgttatagtgaaaaaaatggtttaagagtcagaatatttcgattttactcccattctatcacttactacctgtgtgaagttgtccaactgcttaaattcttcaagcctcatttttctgagttggtaaatctggaataatatcctcataatatcttacgttagtcattgttagatttaaatggaattatgcatttgaaaatgatttataaagtaaaacacaagtatcaatttttattagtaaatagtgagttatataagaatagtgggagggatagcctttagaacacaagcttccaaattcttaggcccaatgatcattaacttgtgattcaattcagaagtatttattaagctctaattaaatatctagggttggatgatctttctggtatgttctaccaagtgaatgaagtcaataaaaagtaaatgggaaagatttaagtattttaagaaagtgcttcagttatgactgtttacttatgaataggttttatggcaagcacacttgagaatggagataaaatagagctgttaggtagtgagcactgctttaaaaaatacctttattatggaagtctcccagcctcccctctcctccacctcctatccctgtgtctacactagtgagattttgttttttaaataatctaagaaatctagttactgaagtttacatttgaaatttagtaacttttctttgattatttatctgatgccttgggtttttaaattaatactctataagtttacttatgtgtacaattggaataatgtattaactgattttgattgcataattaaggaagattttttaaaaaaacagagttcttctctgagttgaatggtaaaattttat

SEQ ID NO: 124485 - DNA, 1011 bp, Homo sapiens
tgagggattttgtttttataccattttaatatatactttttaatttagatcttattgctattacgttaggattgcttttatctggaggacattttcagcaaacctctatacattttcatttttgtgataaaaatataaatatatggtttgaagagtcatttttaaaaatgtctagaaatattcatattataacaatctttattgagaacaaatgttgaatgttttatgtaacaaatttattcactagagattttattatgaaaagtgggattgaaaaaattctgaaatacacgacttcacttttgtttttaacataactggttttttagcgtaactaatttacaactatattttcacctcagggatttgctaaaacattttcaaaatgtggagttttaaacacttgaaactttaatccttctttacttgtcataaaactacatggaccccaaattgtgtgacactaatatttatgttattatggatttttgattgctagattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggtgaggctgtattttgattactgttttcttctttagcagtattattaataatttttgtaatccattgcttatgccaggctgactacctcgaaaacattgtctcctttaatcgataacaatcttcctgtctgtctgtatcctcgtttaagtgaagattctgatgtttagccagtcaaattatcatggccacagtcatgcaaatactaaatgatagaataagattcaaggtcacacattagattcaccacaggctgaaagtaaaaggatagaaaaagataaaccatgcaaaagtaaacaaaagagagtacgtatatatat

SEQ ID NO: 124486 - DNA, 1012 bp, Homo sapiens
tattttgttttcctagtagtaaatagactttatacatgaaaatgttgagtttttaaaattcttgcgtatattaaccatttccttcacccttttagcctttggaatgttcattttcatttggaatatatagagatagagaataattgaaaatatagtgatttctatttattttatattgaaacagttgaatgctattatttttaatgtgttaatatttttaatttgctaagcaactcttaactaggaatttaaattcacacaatgtatatctattgggaaacaacatgcatgagaagggaaaaacttcatctttactccgttttagcttgatttttttccttatatttatgtacacatctttaacaatgaatgattagataaaatattaacttatattcacttttgcctgtaggaaataaatactgtgaaacttgcagcaaactttgggaaactttgcacagtccccctggacagcattcttgtagacaatgttgcactacaattttttatgggtaggtagatcaattctatttaaatgatacagccattgaatttctttttcgattttttattgtaaaatacacataaaatttagtatctcaactatttttaagtgtatagttcagtgatattaaatgtattcatgatgttgtacagagtctccagaactgtttttatcttccaaaactgaaactctactcattaaacaccaactctctccattcctcacactctcaacccctgcaaccatcattctgctttctgtctctataattttgactactcttaagtacctcacgtaggtggaattgtacagtatttgcctttttgtgactggcttactcacttaacgtggatatgccctcaggttttatccgtgttatagcatatgtgagaatttccttcctttttaatgctgaataatattcgtgtgtgtgtgtgtgtgtgtgtgtacacacacgcacacacttgcttctccccttacctcttctcccctccctccacttttcct

SEQ ID NO: 124487 - DNA, 1026 bp, Homo sapiens
aagaattacagtatcttagatctctagatacagctggtgatggtaagtaatgtatttaatttaagatatatttttttgaagtattattttatcttcaaaactttgattaatttacctaaatgtcattttctgatattaatgttttcaccttaattaaatcttccttattaggttaacatgtgcttagttaaagtaaaagcattattttcagaatgtgagaatgtgattattgtaattatccctaaagtggaggtaattggcatggtttacttttaattaaataatttcactgtataatttcagatggtttcttttattgactaaaacagttgctgtattattggttattttgttaaattacagtaagtgcatgtttaaagtatttcataaataacactaccactttctagttcatgatttctttgcttttagatatcaacactatcaaaaatcaaataaatagcttactattcgtaaagaaggtatgtgactcaagaatacagcgattgcagtcaggcaaagtaagtaaagtagttttgaattaacgtttagttataaatactatactatagggattaaaaatgcacagtaaaggacaaaaagcaggacgtttaccagtgcagcactttacaagaggactttaaaaagagttttctcttctacaatgtgatataaatatttgttaaaacatgccaaaaaggttaactaaaatgcttcctgaaaaatgttaaagtaattgaagattttattttattccttgatttatttatacatttacttgtgtatcatttgtttattcaaaacttacatttattcagttttgtgagttgggtactttttagaagagccaagcagacagactcttttcgtggagtttacattttagttgcagagtcaggaaataaaccaataagcaaattgacgcgtaatatcaggtggtgatatctactgcaaaaaacagtaataaagcaaagtagcgtatagagaatgtcttggactggtttagataggttccaagaggttcga

SEQ ID NO: 124488 - DNA, 1112 bp, Homo sapiens
atagttttaataaagataaatgaatccataaacactgttagtcttatattttgtctttttaaaattgacatcaatgctaacatactagaggtatcatcttgctttatttcactccacagttgttactgtggagatgtgtccaagttgatacaggtaactgtatctcatttatctaaactgaggcatagtagttcatctttttataagactgtgttgcttatcaagtcctagttacatgtatatcatacttttcttaagtaacagcattgtgttagaatatttacattatgctgttgatttcagaaatagattaaatttgtttttgttatttacttttttttcaggaaatccttgcacgaggaattcttcttccattaataaatcaactcagtgatcctgattatattaatcagtatgtcatatggatggtaggtgccttttaaaattacaactctgttttagaaataatttttgaaatgtaaaaatatagttgggagatagggtgtttaagcagtaatttattaaagaaattaagtaaaaatgtttctgaagtaatctctgtgtttccaatatttttatttgcttatattttgaatgtgttggccaaattctctttaagaattttgttgattatcttccttgcggttatggtgctactactatttctttaaaaaaatagaatattttactacctgtgtctatagatgatgagtatttttaatggctactatttgatttttaaatacaacttgggatttgaactacttgacatgtaactcacattttatactgtataatggggaaaatatggaggacagaatagtagaatgagaaccagaagatctggattctagatgtttctgtaagttgcctagtgtctgtagtagttaactcaatagttttcttctgtcagacatatcaaagacttagttattactaagtccacaagccctatttttttttctttataatgtatccttttccttaataaactcatggtcaaggaagaattgtaaatgggccaccttctgggaatactttgatacctacttctagatctttgatttattttcttaaatctgggatttctactctacatttgtcttccttta

SEQ ID NO: 124489 - DNA, 1031 bp, Homo sapiens
gccgttactatgttttattcctttaaagatatggcttcaatgattttgtatcttttaggccccatgtttgacaaacattgctgtcttctaaaaattggaggtcttaaagtaggaattatgtggaagtgcctacttgcttggaatatttagagctctcactaggaccttgagtcatatgactagcccttgactaaccaaaccctttaatgtgacagattagaagttttctaatacaaatcgactcattgcaccaactaataagaaacacaaaatttaatcaaaaattttccccaggtgtttttttctccttttgaaaagaagcattggaaaaagtgtgtgtgtgtgtgtgtgtgtgtctgtgtgtgtgtgagtaaattttctcctaacaaagtgcattttaaaatttgaacatgtggccagagacataatttgaaggaaggaattacatacgtaaatacaattttgaagaagtaggagactaaaactaaccttgaaagaagcaattttttgtcatttcagactgcaaagtgtctccaaagacatttcaaaaaaattactggtgcctccattagtgctttttggaaatactgattcatcatgggggtaatagttggcagagacttgtacagcttacaaaagagacttgtacagtttactaaaaataaagaccaccttctgtgatcctttacttagaaaaattatacatcctgttaagcttattgttatttaacctcccccaatattcttaagaaattagggttcataaatttatatattactggcactaaagggtaataccaggtgaaatcattgtatttatagaatctactaaattcttagtttctttttttctactcatttatcaaatgcctgccatgtttaaaacaatgaccttgagaagatgggatgaggaaggtaaatatttttgagaataaataattcagtagataagttgaccaattccactcatatggaggtttcctagatagttgcctctattagaaaaatataagacttataattacagagaa

SEQ ID NO: 124490 - DNA, 1205 bp, Homo sapiens
aaacaattgattaacacatagactagtatctgcatatattttatgcattcatggcatacctttttgtgaatttttttgatatttctaggctatgcggttcatctcttgagttttttaaattgtcacaaatctctaaaaaattttccaatatatttactgaaaaaaatccacatataagtggacctgagcagttcagactctttgttcaagggtcaatttatattacagtaacttagaatgtaacacatagatatactgatgtgcaatacttttatgtaagttgagctctcttaaatcagcagaatagaagagcatactctttttttcctttgttatagcctgctgagatgatggaggtgttttcttgaaagaagaattacagctatgtttttatatgtgtgaataacttttaagtatggaaagctaattaacgtgtggtagaattacagagtacctggtccatctaaaactattttgggaaaaaagacttgtaacgaaatttttttatgattcaaaaaactggttaaaacagcaaaattaaaaaaaattaagttgattaatgaatagttactacttggagaataatgaaggaatttttaatgaatactgatgtgtactaattactaaaataagccattgtaaccagggaactggttatttctgcctttttaaatgtatcttatatatcaagaggaagtgtagactttatattttctaatgttatgatagctactttttctacttttaggattcctaagggatttgtgtgaggtcttactatatttattgctacctcctggagatttccagaacaagatcatgcgatactttgtcagggtaagcttaaactcataccatatcatacctgcaaaaaaatgtagagcagtagttttcaaaatttttgtcttaagaccctgttacactcttaaaaattattgaagactccaaagagcttttgtttatgtgagttttctttaaaatatttacacaagtgaagactaagaaatttttaaaacatgaaaatatgcaagcatgtatttcattacctaatagctcgataccatcatagcattatgtaactttgtaaaggtcactgtgtgtacatgaaagaacaagagtgaaaagttaaataatgtcttagcattattatgaaaatggtgttgaaagggtcacctgaaacccaagcttcgggggaacttcaggtt

SEQ ID NO: 124491 - DNA, 1695 bp, Homo sapiens
tgaggtctgttgcttttgagatagagtactaggtgacttcttaaaattagtaatcacctttttcatgagtattctaaaggcttttatatgtgtgatattttatatcattctttataccatttccttgtaattagttatttctaatggttaaggcttttttttttttttttgatgagatagctctgttcccaggctcgaatgcagtggtgtggtcacagctcactgcagcgttgacctcctgggctcaggtgatcctcccacttcagcttccctagcagctgggactataggtgcatgccaccatgcctggctaattttttgtaatttttgtagagacagtttcaccatgtcgactaggctggtcttgaacttctggactcaagtgatcctcctgcctcagcctcccaaagtgttgggattataggcgtgagccactgtgcctggccatggccaagtttttaagtgctagtgtattcaaacagaacgttcagaacatgtgttgcatagctaaaaagatgaatgtggagaattcagaaagagttcagaagaaaccaagaaatgtttgaaatgctcttttaaagcaaacaaaactattcagaattccttatgtattcttatgttggggctgagaaattacatgatatactgttgtcagattcacttcaaatttaactggaaaaaattaatttctttttctattttaaacctttagatagtagttttaagctttggcacataaaataattcaagtaatattgttagaagacttagtgaagtagatttgatttactttgaatcttgtgaaacagtactaacaggtaataatgaatgaaaatctcaatttaaatttacagtctcagataatcatgttgtttgtcagtagtcattaaaatgaatttatattttctgataaagcatttatataatccttttatgtaatgtgttttttataaggtcaaaagaaatagactggcaaccttattttactacacgcattgtagatgactttggcacacacttacgagtattcagaaaggctcaacagaaaataacagagaaagatgatcaagtgaaaggtaatatctttattccatttgaaaactaggatttgaaaatctgttttcctttcatcattttatatatcttgaattgtttttctttaggtacagcagaagatcttgtagataccttctttgaagttgaagttgaaatggagaaggaggtttgccgtgatctagtgtgcacttcccccaaagatgaagaaggttttcttttaatttaacttttttgacaatagtagctggctagagtcaagttagcagaaccagtgaaaaaatctaagggtaaaattattcttacttagggcaggtagcatagtaaagatgctattcattttattttattttgtaactcttaaaagtagtttccagattctgttttcttctttaaaggtcatctttaataattaactggtcctggctgggtgcagtggctcatgcctgtaatcccatcattttgggaggccgaagggcctggattgcttgagtccaggagttcaagaccagcctaggcaacatggcgaaaccctgtctctactaaaagtacgaaacatcagctggctgaggtgggagaatcaccggagcctgggaagtcaaggctgcagtgacctgtgatcatgctattgcactccagcct

SEQ ID NO: 124492 - DNA, 1059 bp, Homo sapiens
atcatgtcatgattttagaaagtacttcactgtcatcaaagtattttccaattttgttaagacaaacattattagaaattgttagtatatatcctaatttataaatgggaagaagtgtgctattgttcttcctaatctagaaagttcttttgagatttatattaagtttgcatgaagtcagtggaaataagtcaagcagaaggaaaataacctcagaaagagataagatatcggtactgtttttcctatttttcctaccctcaacatatttctgtattgaaaatagaaatctgtacatcaaatttaaaataattttgtatgtatttgcattgcttgataattttattcgtttaaaatgtcattacatcctctataatgaatcaagatggatttaaaatgtcttctaaattggtaaaatttattttgtttgaaagtttcagtaaattaaataaacagcattgtagcatgaaacaggacagatgtaacttgaaatattatatattctgctttcttctaaatttgtcaaaatgaaccttttatggattaaatgagctatggcctatactaagtaaattttgtttttataaaattttcagtatggatgattttgaataaatattcatgtaaagatttttgaaagatgcttacacagattgtgatttatttttttaaataagaaaaaagagtttctagagactgctaggtttaagtttttattttaggtttatgttgagactgaatattgttaccaagtttagttatatgcttatatgcatggctcttatattctaaataatgttaattaattcatcctcggattactgagcttagggatccacctttttatgttaatttgttttcgtgttcatatacttacggctttctctttagtttcatgtatacaacaaaccttagtgttaataacttatttttttacttgaaaacagccatttatttttcaacatcatactgactctttaaggctttttttttttttttttttttttcaaaaagtaacagtaattaagtcagcatcttcactagcctttttattgtatg

SEQ ID NO: 124493 - DNA, 1953 bp, Homo sapiens
aatacttaaacttttttataatctgaaacctttctctcctttaggactcatattaatatgtatttttttttttttacttataagtcttaggaaattaacctttccttttttgaaccatttcttagctatttatagtgtacttcatttgagtggcatatacagagaataggaaatattttaagaattaagatccttaacagtaataaattatattcaagaatggttaagtctttataatccatttttaatagatagtataaaacaatgggttttatttgctatttctaaaatatgatttctaagtatgtcttatgaaaaaatatccgtggtttcatattataactttgaagcatgtatttttaatatagatatctatgtctatatctgtatctatgtttatatatatttatggtttgtttttttaagaatctcccactaccttttccccaattttcaggccactgatctttctgaacacaaaaaagtagagaagtacattttcttaagttgccaaaactatccctacataaaatccgtttaaaaattaattattttgcagctggtatactgttttgggctgggaaaggggaggggcaagagggagagtgtccagtaaagacagtttgactcacatgaaacactaattttatagttgtagagtttcattgaaatatggcagcagcatacctgtacatttgcagttttcccacattctaaataatttttgctgattaaatttttgaggataatcatttttttgggagtgtctaattttgttaacttgagaaatagtgtttggcttatagagtagcacctcaaataaggttatttatttacttgaggataatgaagggatgttacattgagtattcaactggaattaaactggagagattttacatcagaaaactactcagtaagatattttgatttcctttaagtgcttagaagaaatgaaacgggaagccaggactattaagattgatagaagattgacgggtgccaatataattgatgaacctctccagcaagtgagtttcagcgtgtggtatttgaattctatatattgtgttctaggtatatttcttttgaagataccaggaaatactttttgctctttaaataatatcctggaatttcttaatgttatccttgaattttatacttgaagatgcttccttatttattaactcacttctaatgaggtggtttactttatgtaaaagcctttcgattgaatttggatttagaaaaaaagttgttattgacatttgatagtgtttcttaaaattttacagttaaagtgttactctttcgttgatgaacaagcttagtggtgtggtaaatcagactttttttcctacttgttaccttttaaaaaatggaaaagaaatatccgatgcaaaaacattaaaaaattagagataggtaaaaaaactatgccccctgaaatatttttcattgatgtttgattatatgattataaaaatgtgtactttagaattttaacatttattattattactaatatttagtttatctgatttgtaaaaattatacattgagttgtattatgtactatttattgtctgaatactgttggcagtatcaaaggtattagtagaaataagtgaactcctgtatcatttttataattagactgcaatggatctgatgatataatctttaaaaaaactttttttgtggaattatagtctctattattttacatctcattccattaaactgattgatattatttattagattatagcatggaaagtttcttttttttctgcaaaccctgtctttacctggatttatgtgggacttggccatagatagtgttttattttatttttttttttaaatctaggcagtaggtaagttgggataccagaataatttaaaaatgtttgaaatggtttttagtatgttgatgtttttgtaatg

SEQ ID NO: 124494 - DNA, 1083 bp, Homo sapiens
gtggcgtgatctcagttcactgcaatctctgcctcccaggttccagcgattctcctgcctcagcctcccaagtagctgggactacaggtgcaagccaccaccctggctaatttttgtatttttagtagagacggggtttcaccatgttggtcaagctggtctcgaactcctgaccttgtgatcctcctgtcttggcctcccaaagtgctgggattacaggcatgagccaccacacctggccttgtcacaagattctttaggaaatatattggattaaaactttaaaaagtattattgtataattcacaaaatgttcatagttgttttaaacttcagaacctaatacaatctgtcaatttcttgctttgccaaagtcacaaattgactttttagtaaatgataagccatctgtgaactctggaaaatatacttggtagtagattcattaaattataaggaaattttgtttttatatttgtgattaaatttttctttctaggggtttagtggttactctcctgtttggaaaaacaaactcagagaagtacctagaacagtgtgaacactcatttcttcctccaacatcacctggggttcctaaggtaaatcgtttgagggaatataaaacctcaaagtccagttctttgcaatgataatagagtaatcatctgtatatatagcgtgacaaattttcgtatagtttactaatgctcactgggaatttatgtgagattgtctaattatacttagaaaatatattttaaaaggccatcttaaaaactttcttagtgttagatttaaaaagtgggaatacaaacttgagaaaacgatagaaattggttagtttattttgggtatttttcctgctgtcttatcatagtatttcaaagcatcatgcatatgatttttaacaatgtcaatgagtattctggtttgaatgaaataaattgcagaggaatcagaggaaaaaatggatacttttcattactttgaaaaatacagcttgtaattagattatgcagtatctataattttaataattcaggcctaatttttatcatcttgaatggtgctattattttt

SEQ ID NO: 124495 - DNA, 1027 bp, Homo sapiens
tgaaatactaattctaagtaagtataactttgtagcctacttatccttttgtatatgcatttgcaaatataaatgtacagatgtttttgtacatactttgttgtatttctcatgctaggatttcatttaacagtttgtataactatttctgtcctgtacctttgcattgccactaggattttttaaaaaagtaattgcagatgctctgtaaatctctctatacatataaattttgtatattgttttgtggagataaattttcaagtatacacttcacattttcaaaagttactgaaataataccatgaatgtttacaagaagaaatttaaaactatgtaaaagttttgttggttcttttctaattcatgtggagaattatttactaatttacttatattttttctgtatttcaggccagtctatccatatggggatggggaagccttggcattgtcctttttctgataacctttggaccctttgtaatattttatttgacattttatatcctctgctttgtgggtgggtaagtatactcaattataattttataattcatgtgtcatatcttgttaaaatggaaacaaatgactgagaaacgggagtatgatttatttgtgaatgccatttttaataaattgcttttactaaagttaaaaaaataaggatacccataaaaataaaaacagtgattgtcattatttgtatcagaaatatgggtagtccttcaataataagatgtccatttccaaaggtatgaactttttttggtgataatgtgtaaagtttaaaaaatttttcaaattccttttggtggtgtttctcctttaaagttgaaattttcttttgcattatgttaataagtaagttaaattgagactgcacatgaagttttacattatagaaattgtgattagacttcaaacaaatgttaattttttcctttaatgaatgttgtcatttcggtctagaaaattcaaatacctgattttgcagttttctcttcatagttatttggtgtacgtt

SEQ ID NO: 124496 - DNA, 2938 bp, Homo sapiens
gagtacagaagtgggttatgtaaatgagggtgtgtggtcttgtagtgtctaaagtgaagttgtagtgaatgttggtggaggtgaaatgcttatgatattaaaagtagcatatttgatggattatccacatgtatgttaaaataactgaaggttattcagcattcctgatagagaagaatgtttatggattagtagtgcatacatcggtggttctcaaaagtaactgcatattgcaatcatctggggaacttcacaaactaacaatgctcttatatcagctttcctgaacattggaaattctgatgcatggctcacatacctagctattttgatttaatttgtatgtggcgtaagctgggtagtgggattttaaaatccccctacttccccaggtaatgctaatgggcaggaattatacaggaacaacaggggcttttacaggaaatgggctgggagttatggttttgatcgtgaccctacattctgaagttgggtacatgattaatgaaagaataagcagcctttgtttgagagagctgcaggagaagcagcttttacttgaagcaaaaatagtgaagttgtcggggatatggaagtgtttgttttgactttggaacagagtgatcctagagggaaagtttaggagggatggaatcactgggaaattgtataagggaggaaaaagcaagaacagtacagtggtcagagtgtaggagagaatcgataactgaatgtatttatctctctatgatgaacaaggataacaaggcttagtgggttcattattagtctagagaacacatccagcagtcctgtagtgcccaataattgggaattgggtaaacagttcttaggagtcagtccagaccttgatagactgaatttcataggaagtcctatccttgtatcctctggtaaggggtttggattgattgtgcaagatctaaggagagccctagagtttggggctgttgtcccacaggctcctgatagtggttggagtcttttctaacactggcgggggaggctgtgaagtcttaaggtttggtcagatttgttcttctcactccagtgcgctgcttggctgagtacacgctgctgcaccaaatgatggcaaagcctttactatttctttacttttatacttcatacttttcaggaacactttaaattgtccagttctagatttgtgagcaactatttataggtttcactttttcaacatacaagaaatgatatagacttagagtgaaaaagggccttatatattatctaggcaaactcttcttatttatgcattagaatttttatgcatagagaatcaaagtgaaattcacaaagaaccctcttacttagattaaagtataaacggtatatggggctggaaatttataattgctgcactgattcaaagtttttgtaagaataaatgggttaactgcaactcattttattaatttgacacgtaacttgatttctgtattttttcactgttaaactttgaaatataagagcatcagacatcaccgcccacagagtgcttcaaatttatttttcttttacaattaaagaaagcttttaaaagtacagtgtatgtgtaggctttaagagctactctagttatgcaagagaactatgaaattgcttttgaatgaagagttcattcaaaccttctcaaaaatattcaaatatatttttggtcagaataaggtaagtagtaaaatggtaaatttggtaacagtttgttttagaaataagaaaattgctaagtgaaaacaagactttcacataattatagtatatcatgttaactagtaattaaaacccatgtgcttttactaagcgaaatagatatcatgattaaagcttttatacttttaaacattagtctattttgcgtatagcgatcttatttcacctgtgtttgaattgtgaaacgcaaggtaactttttgaggctatgacaccagatagatgaagcctgttttaagtcatggggatttaggccacatcaaaaggatacttttttttctttttaaaattttattctttactcattcattaatttaattaatttatttagagatgggggtcttacactgttgcctaggctggttttgaactcctggcctcaaatgatcctactgccttggcctcccaaagtcctgggattacaggtgtgagctaccctgtccagcccaaaagtaaacttttagtagctgagtgacatacatttttataatgtatcttttgtattcatgttttagatgttttagatgtgcaagataaaaactgaagagcaattacgttaaatgatgcttgtttcgctttcctcctcctgagttgctttcattgacttatctgatgtttaggtggatatgaatagtatcaatttttctaaaactcgggtatttgttatagaactctgcacattagatcaattgtctgtcatctaggggtacatttctaagttgtgttttatagatacagtttcagactatttgtaggaatgctattaagatttttctttggctatggtaggtgacatcatttggctgagaatttctaaccaaaattatttctactgaactgtatggtatgaaattctggtaactcaggacaacattagttatgttggaatatattcgaagctgctttctgaggaaaattttggcttttatttgactttgctatagtatgtcaccttataatagggtggtgagaacactaagtaggttatttagtatttatggcttttctgatttttaggtgtatatggaccaactatttttgtttttcaaattattttaagttcaggggataaatgtgcaggtttgttacatgggtattttgtgcattgctgaggtttggacttctattgactccatcagccaaatagtgaacacagcactaaataagtagtttttcaacccttggct

SEQ ID NO: 124497 - DNA, 2231 bp, Homo sapiens
ctttttttttttttttttttttgagacggagtcttgccctgttgcccaggctggagtgcagtggcgcgatcttggctcactgcaacctccgccttccaggttcaaactattctcgtgcttcagcctcccaagcagctgggattacaggcgtgagccactgcaccgggccaaaaatatatctctaattgaaaccttttcagaaatgagaagccacacaagtgatcaattaaggaccattttatattaagctaaaatggaatatcactcagttgagcaaactaatatgtacattgaactttgagcctatgaaatatagattaatgtaaattgaaagtatagctcccatatagttctcgatgtaaactttttggcttcaatttatattattttatcttaaatacaatggaattatttagaaaacttgctagtcatatttatgtatgtattttttttttttttgcattttacatacagggatgagctgtatgtaacgtctagctagtttttttttttttattttattttattttttttaatgttagtttttttccccttctgttgtccttgctcctgttaggacttcctgcttctaatgtgactcctgctatacttggcaaaaaatttgtcatagtgtacatgaaagttacttgtttaatattcactcctcactctccctctatcccttctttttttttctttttttttttcttttcccctaacagtaaacttcatatatcgaaattagagcatgggatgtttgtttacctgagaatttgttttaattaatccgagttttcacaacattagaagataatgaaatatttatcagtgaatttttatcaaacacacttttaaacttttcttgataccaggagcaattaggattataattctgagcatttattattacagaaaactaaaggtaagaaatgtgggaaaatgtgctgaatacattccagtgttgtggcatactttggaggttgtttttgcatggaaaccagttatcaacgtgttgtcacttgtcctgtgttttaaaaaataataaacagtgtagctatttaaagctattagttgtttgagttgtctgtaaatatgaatcattaagtgactattaaataaaaatagtttctatttgtgttgttacttccatccagatttgttgctttttcaatattaacactgattctcagagttaacagatctgatataaatgggaaaaggcaaaaaatgcagcactttgagaagttccaggttaatagttgttaagtaaaaggttttgtagttgaaataaatttggaggatatttgcctaaagaaagttaataggtttcttctctggatgacttaacatagttagtttttgataggtgatttattttcaaagaagatgatagaatttacagcatattgcagagtcatttaaccatggaggtgaatacactttcttgtatttcacttagggaaatcctggagtgatgagttacgtatcaagaaaggctccctgaacatccaggggtccttttgaacacacacatgcacatacatcatacatccacgctcacacacagttgtcttgcccataagtgcttagtaaaatattatgacttggttttgttgattaatatatttgtaatagaaatactcttggggcacattaatctttaagctatataagctatttcttcaattattaatgacactgcaagagctactaaccaaagcaagaagaccataggtccactggcattcagaggtgtcaagaggtaggaaagggattttataacgggagtggaaggacatcagtatctaaaatgagtttggcttgccactctacacacagccttacttggcatcttttgacaaaccaagaggaatattgataaacattcttaaagaattttttctttttaaatattattttaattgacagtcatttttatgcatttatggggtacagggtgatattttgaaatgtgtgtacaatgtggaatgattaagtgcagctgaataacatatcaccttgattattttctatggtgagacaattgaaatttagttatttaaaaaataaaatacatgattgttgacagttgtttaattgatctaaaaatttcttccttctatctatctgaaactttgtactctgagcagtatatccccattgctccctcttctccaggctctggtatctgtcattctgctgtctacttctgtgagtttgacttcttaaat

SEQ ID NO: 124498 - DNA, 1762 bp, Homo sapiens
gcccgaccggtttgtttcccaccctctactttgactgcttcatgaagtggacttttttatctcaagctgcacatgtatggctcagttgggtcatccccctcccccacatccatcaccttttcggttaaatcgtggtcatcacaaagttcagtttagcatctgccaccttgatttgcgtgtggcccccttgttactccctatggaatagtttttttctttggacctgaaatggaagtagggcaactatgacgaaccaatcaatttcccttttctagtgcctaatgggcattgcaaaaagccgactttttgaagaagtagagtttgcctttactagcaacactttaaggggaagaactaaatcggtgcaactaggtacttgacccaggttagcccagttatgtgttgtagtatctgcaggtgtaggtgtcactgaacataaaatactgaaccttgtgatttgatgaaatacctttttcgaagcctttcactttaagtactgtgaggatcctgacgtgaggaactgaccggattgggcatttttatgggctgaactgaataggaaacagttttagtgggcaatgggaagtattcctacatgggccaaaaaggaaatacaaacatttgtaggtgagtggcttttattttgtgaaaagtgatggtaaagcacgtacttgcctgaaatttcaggtccttggaacgtgactaactttgaggaactttatactttgctgtttgtacttaatctaagcacagagcctggcatatgataaatacttactggttgattgtaacttctacagtacgtatttttagttgtttgaagttcattttatatttctaaattctacagatttttcattcttggagttaattgagattatggttatagcataagtttgtgttgtgattagcagtaatagattagaaaaaagagttataagtagcagaagtttcatttttaccttaagtgtgatattttagtgggaacagttagccttataataagtgtttagtgttgtctctaatgtgtaatattatatgatatgatcttttccttaaacttagcttatgttaacatgtttcagagttttaatactttcaaatgaactacttgtgtgtctgccagtaaaatgatttggaaagatggagctttctcagcttctgtattttaatgcaattttgcgttttagggaaatattttaaacagtaaatcaatgataatattaagtaaactgtactttagtactttttgtgtgaacactgcacaacttataagtggcagaagcaggattccaaccttggcagttgccacctagcccattctgttaacttttctagattgcctcgccaaagtaagacccagattaaattgtactaaagtcttccctatagttttcagtagtcgtttatagattaggaaactgaagccagagactcttgtccaaggtcaattattaaatattagtgacagtcgaaactggaatctcatctcctaactctcagtagagagctctgaccgttttgctcagctgcctctcaagtagttttcagctctcttgatagattttaaaacatgctattgtacttccttgtctgaatattgtcagtaaactgaaaatgattattacttaaaaaagactttctgctttaccttagctttttttccttttcattttttaaacaaggcttctaagcctcgtaaactagtcctattttgagatattttagatataaaatttcactcaatattggctactacaaa

SEQ ID NO: 124499 - DNA, 1041 bp, Homo sapiens
tgagcagccattgggatcttgagaggaagcaacaagtacagtaaatgcttcttgagaggaggaagattgatctgtcaccatctatttggacactatctatcttggattctcagttatacctgttccttttgatttagctttacctccacccatcttgaccttttcattgctaaatatcctactgggccccaaatggtcagggtaccatagtcttctggaaggcaaacccactttttgctatgtaatctctaatatttatattagttatttttgctgtaacttaatcttccttagtttattaccaccattgtagtagatgttaggtgacattgtagtgacttttgttaaatttaaacatttaatttttatctcccttccttgtattttgttggcccctcaaatgacctcagatttatatttttaaaatgttgttattgtcctttttagggaaaaccaataaaatatctgcatatatgtgtggggtggagaggggtggtgcagagcaccatacctagatttatcatgtgaaatttctgatctccaagaaaaaatcactaagaatttctaaagagtaaaacaaaaacaagaaagttttaaagaaacaatattcagattgctttaaatttttcatttgaacgcttgggctgtaagcaaaatggaataatttcctcacagttctaaaggaatattatttttcacctaaatttctgtgcttagccaaactatcattgacatatgaagacaatattaagggactcagaaactactaccactagtgtttcctgaaagtacttcttggagatactgaaaacaaaaaatatatacagccaagaagaacacatagaataaaagagatggtggtaagcaaaaaaagaagtgacactgacagaaaaataatttttatgaagttactgtaaagattatggccgttattaaggtaaaactcacataaaattgggccacatcatgaagcaattttgaggctgggaggagttagggttagtgtaaatttattaaggatcttgtctagttttggatgga

SEQ ID NO: 124500 - DNA, 1048 bp, Homo sapiens
ttgccaagggtcgttcagctaggggtggcattaggatttgaatccaggtctgattccagagcctgaagtcttgtagtacacatcccatactcacaagcagtaagtgaagtttccagggggaaagcctgttactcacattgaagtggatgtcagtgctacaattgctgttgggttccatcattcagcttgagagaactggatactgcaagatgagggttaaagagaggagtgagagagtgtgctgtatcatgccttcttttattttctcagcaggaagtacatattataggtctctcttagatctaaaagtaagaatggggagtagaggctgtgcatttttatttctacttatcattttggttaaaatcaaaagcactgtgtctcctttctttcctatatgtagatttctactattaaattaaatcaggtaacattatgaattctcattgcctctttggccatagggttctttctatagctttttcagtagatgccactgttttgatcttgaaaagtctattgagacattcttcctttgttcttctattactcagtccctctttctactctgtggtgcctctgaaatctattcatagatattctacttttttcttctgttttatgtacttaaatatcttctttaaatggatctagttccattgatcagaatcattggcccagatccccttgctgctccactgtacccaggaagtcttatctattttctgttaattttactgagttttactctacatcccagcacagtatgaggaagcctttaagatttccctgggtatctgagcctaaatgtaaacatttaaaactgaatacctcaaggaagagtatgattggattgtgttagatcaggtgcacacctatggactactccactgtggccaggcaaagggagttttattattgctccatctgggttcaggtgtccacccttctagaatactactgttctcaaagaaggaaattgtgagccagccccagcttgactggggtcaacagtactaatctattctagagcacactgtagctcagg

SEQ ID NO: 124501 - DNA, 1049 bp, Homo sapiens
agtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttca

SEQ ID NO: 124502 - DNA, 1118 bp, Homo sapiens
agtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgatttttttttttttttt

SEQ ID NO: 124503 - DNA, 1053 bp, Homo sapiens
tacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatat

SEQ ID NO: 124504 - DNA, 1032 bp, Homo sapiens
ggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggca

SEQ ID NO: 124505 - DNA, 1763 bp, Homo sapiens
ttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtagg

SEQ ID NO: 124506 - DNA, 1758 bp, Homo sapiens
acctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaacta

SEQ ID NO: 124507 - DNA, 1141 bp, Homo sapiens
agactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttc

SEQ ID NO: 124508 - DNA, 1483 bp, Homo sapiens
gaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccc

SEQ ID NO: 124509 - DNA, 1067 bp, Homo sapiens
ggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatc

SEQ ID NO: 124510 - DNA, 1051 bp, Homo sapiens
tgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggca

SEQ ID NO: 124511 - DNA, 1003 bp, Homo sapiens
taatgttatcttttccagtttctcagaaggaaaaagaattaaatgaacctcacatgtgatttgaaaacagagatagtatccattccaggcctctgttttattttgctcttcccctctccttgacactttacttttgggcagatgtgcctgaggaagacttagtgtaagatgacacaaggtggaacagagcttagtttgtgagtctgagaagacttagtctaagatgatacaaggtggaacaaagcttagtttgtgagtctgaagcagaatcaggcagtgataagcagtgtgtttcctggaggatgataaactttctatatgatgaccttgttttatcgtggtattagtgagcatcaaaactattcactgacttatattcatatattttctcaagaggaggaaaatactgcatgggttttgcagccagtcttcctgttcagatttactctgcttaagtacttaatttaagagagagagagaggttgacaaaggattccgtaacttctagtcttcaaatgatcaaaactgaggacctggtgaaggtttcaggaaaccacttctttaattgattctctttccatgtaaaatgtatttcaaaggataatagcctacgatttgactccaaagcttcagcgtagaagaggaattcttctggctgaactatatagctaatgctcaattaccttagcttctattgaaccgtattctaaacaccttcctttgtaaccatcaccttgtgcagaagtctgtatttttagcctttaagcagagctcaagtgctgtatttagacatctgacttgaagactaaaatttgctcagtgagcagaacaaatgttcagaaaataacatttcaaggttagagttagtgtcctgaataaaatcccttttcttctttttctccgtattgaatataacataaataatgtaccctgactgacttttaagattaaaaatcagagaatacagtgaacttggaaagggaagagaacataattaaaaatt

SEQ ID NO: 124512 - DNA, 1066 bp, Homo sapiens
gaaacattcagctgcagaattaaatgatttgctcaaaaggaaacaggaataaatggcagaatcaaccacctaatactttggatttttggaaagtattaaaaataaacaaatcagaacaacaaagttctccatttctttgtttgtggagtattctcccctctggccccagcaaaagaaaaagttagaaaggagatcctctggaagttaaaccaatgtgtttaaggttaaaccctgcctcatgtcacttgtacaatttacacaacattcatttccttaagtgctaccataattttgtgaatgttaacataaagaagtccaggaggccaccaaattgttcccattggcttttttgtgtagtgtaggataatgaggcaatttttgctttgtctatatatattttgtgtattacttgattttatgatcatatattgtttgtgtgactttacctttaaagtcaatagaattataaatttaatttggtatttacaacacacatatgcacacacatatgtatatattttttcatcaaacattaggcaaatgatggttacatgaaacatgaaactctgggactacttctgtttcacaggttcagatcctgtgtcctgacttttggttgagaaaatataggctcagttaatgtattcagttgtgtgcttttacccaattttccattatctcctatttcatcttccaccaaagtaacttcagacaagaaaagtgtgtttgaagactaccacgggttaactgcctgtattccattataaaatctttgtatatcgtgttagtctttggttttgtggtcaggatcgactataatgaattctggttcttgatttaccaaatgtgagaacttggccgatttatctaatctttgggtaaattagtctccccatgtgtaaattaggaatgagaaaacttaacctttagggttgttgtgagaactaaaagagctccagtttgtccagtgcttggttttatagggactagatacaggtagatttctttcttcttcatttgatttaaatccaacactcactcttactgttgtcccaggtaaaatttt

SEQ ID NO: 124513 - DNA, 1053 bp, Homo sapiens
agatttagttcacaaactgtataatcttctgattctgcagaattgaaatgaataaacttgaacacatatttaagaactcaagctctagtcagcatataacttaagagggaaaaggttgaatttcctttcaaaataagcaccgtgcatgaccatgcttcctaagaaaaaaagaaaaggtaatatctctaaaaattgtatcatcattattttcataccagttaccatggttcaattagtccctctctatccagtctagtggtacatttttctaaattgtgaaaattcaataataattacatatatagtaatatgtatttatataatattatataatatgtaaaataataattatagtttatataaatgtgtgttttaagtggtcttattatgtatgatatttcaaggtgtaagcttatttttcaggatattgtgttttggtacctaggaggatcagctttgaatcatttctagttacatatttctaatttgggggaaaatcagtttttataggaataaaatgtggtccaagtctttagcagagtgaaggataagactgaattataaaaagagaggtttaataaagtattttttaagccttagaggaagttaataaaataattttattgaattccatcatgactcatcttctaatattaattttgtaaataggaaaaaggtaattaaattactaaagcaccttcattttaaaggttaactttattattattgctcataggaaagtttattttttaccacttttagaacactaggtctttttaaattgatgcacaattcatttgggtgctttctatgacacgcagtcagacttgcctccttcctgtgtgggctctgactatctaataaaagagataatgtaatgacttacatatctagaacacaaggtaatgattccattaccaggcatatccctgttctgatttgcagacagtttaatttttacatctgatctttaactagtgcttcagatgaagcagaactgggtatttgaaaggaatttaatttgttttgcccattttaatggtagttttttct

SEQ ID NO: 124514 - DNA, 1010 bp, Homo sapiens
ctgacttttccaaggaatgacaggggttaagatccgtttttaattggttccactcctggtggaaggctttcttctatacatgtcaggttttctttgacttatcaataccttcatgaagaaacaatgaagtgaaggacattttaaaagcaggttgtataagccactaaaaaattttgaataatgcctagtctctgcatataagtaaaaaaaaaaagcagtttaacaatatgttaattatatgtagacattatttttatcacaataaaattaagacatactacaagaacagattgacttagtttttcagtttgcaattatcttcccagttaaatataagtaaagatcttaataaatgtaacattaaagttcttgaactatataccacacaccattccacataaacagaccggttatattaaaactagcaaagccgtattttgtctgtgcttgctagaaaataaattttgcatatattctagaagacaaagatgattttgtatatgtaattgacaaaaaatacttctaggaaaaatataattattgtattaaaggttatgaaatggcagttgaaacccctaaagtcatggattctagttaatacagtataataagggagagctcacactattcctcatgaatcatgctgagaaaactcctgtcaaataaagaattattaagttgagttaaagaaattaatttgtttcttcaaaactgaagttaagaaatgcaaacatttttttctctggatgaaaacactgtttttttttcccgcaatgcaattttataaataaaaggtttattgcaaatgtattttgatgaccttattatactcattttgtgtgaaattatttaaaaaataatattccctcaagttaaattgctcaattgaaacttctcgcttctcaatataagcatcagaataatactttaaggtcataatatcagaagctattgactaagtgatttaaagatagaatgtctgtattctcagatggagcaaattaatttaa

SEQ ID NO: 124515 - DNA, 1009 bp, Homo sapiens
gctattaagttttcagagatggcaaatgggtagttatggaataagactcttttttttttgagacggagtcttgctctgtcgcccaggcaggagtttagtggcgcgatctcggctcactgcaagctccgcctcccgggttcctgcctcagccttccgagtggctgggactacaggcacccaccgccacgcccagccaatttgtgtgtgtgtgtgtgtgtgtgtgtgtgtgtgtgtgtgtgtgtgtgtgtttttagtagagatggggtttcaccgtgttagccaggatggtctcgatatcctgaccttgtgatctgcccacctcgggctcccaaagtgctgggattaaaggcttgaaccaccgcgcccggccggaatgagactcttacatttacgttgaaaagcataggtgctggagtccatggtaagattattagctgactaccaaatttcattccttctttttccatggaaacagtgcctaagcacgtggctggccagctaggcactatgacttccagttcccatttgagataggtgtggccatgtggctgagttcttatgaatagaatgtgagtgatttggcaatttgtgtcacttctggatctgtgctttaagatgttagttaggctccatgttccttccccgttctgctggctggaacctcacatggttttggtccagtgtcaaccttctgctgtagcagtgttctagaaatgtcagggcagcaaggtggaaagaaccttggttgctgaggtcctgccaacctgaagtgttacacaagaaagaaacttctctgttgtttacaacactgtattaattggtttctttgttacagcagcttagtataaaccctgcttgatagagagtcccatagaatttcgttgacctgggctctgcccagcattagcaaagtgttttgaatctccaagccccaggttcctcctgtgttacatggtactattgtgagattatactatataagagtttaaaagttcagcatttaaatata

SEQ ID NO: 124516 - DNA, 1053 bp, Homo sapiens
gaggagttgaaataaatcatttcaaggacaatgaaatgttcagcccaaggtacactcgtccttggtttaaacacccatttcctttaaggactttctaatgagaccttgtggattttccaaaaaatataccgtgccagtggcagcttattcaccttacttacatagttcgaggaactgcttgtttaaatttagatactgtctctgatgaaatgttttgacaaagtaataccagcttgatactatttaaaatattttgacagatgggaaaattgtttcagtctgagttgagcaatactttattgcagtattttgtgagttagaaaaaaaatggtaaaggtagcctcactgttccccaaaataacatccttccattctccctgaggagagaaaggcctctattcagtcatagattacagtatgtgtgctgagtatgttaagaattcacacagtttaaacaagagggaacatttggggactgtttccaaacagggaacatttattgttctataagcaaaccgaacctaaagaactttcgggaacatttgttgtggtagcatgttatcagagccttctcatgccgtgatgagattgttctcaattaataaaactaaatcactagattttaaaactgacttggatgaaaaaaaaagctcaaatttacctacttcaatatctagagttttaaaaaatatgctattataataaaaaatatttaaatatttcacattagttgcaaaggatgaaatccaggtggtccttgtttgtgatattaaacaaatgtgttgaagcaatgtggtagggcagtggtcctcaaagtgtgattcctggaccattagaaatgcaaattctaggctttctggttcagacactggtgcagcccagccatctagatttttaactcgtgttcctgatcattcagatgcacactttagcttgataagtgcccagatagtgtagagactttcaagctatcccaaggcctgccagattggaaagagggaggactgtggtgggggggtggggttggggggaatgatcaggaatggttcccag

SEQ ID NO: 124517 - DNA, 1049 bp, Homo sapiens
aggagagccatacagtgaaaaatctatttctccatcttttccttggttgtctctcttttctctctctttcctagaaacaatcactgttgtctctttcttgtgtagccttccagaatgctatgctgtgtgtgtctgtgtgagtatctgtagtaaacattaaaatattactacacattttctgtgccttgaatttattcctcttattttatgtttcagattttgttccacatgtggaagtgccttgtgcctcctttttcactgctacatagtagttcattgtgtgggttttccaaaattaatttaacagatcctctgttagaagacattaggtaatttataatctcttgcaagcctgattattttaaatttaaattacacctagggttctgagtcctctatatggtcttttattcttagcagaagcttcacaactctctgggtcttcagcagggactgataaagatcaaattgttgaattaggtcaggtttgtgtcaggaagttgcttgatctcagttttcttagatggctatttttagcttgtgaacagtaatcatggtaagaaatctttgtatcttgccctagacaatcttctcttggaaaattaaagtggccccctttaaaagatttaagaaatgcaatttgctaacagtttaatgggtttattagggactttgagggtatatttctagaaggagaaatatttttgtttctctgaaagttctagctactttattctccatagcccttaaaaacttttcagatttgtcttcctataattcgtagagatttggaaaattagacataaggcacctgttttcttaaatgcatggttacctattcctttgtcctatcctttcaagacaattctgggaacagtttgttcagctttacgaagaaaacatttcttcatcacctgagttttcggtcacccatgaattctaagaatattttagctgatttcagggaaaaagtattcaatattagtgattgataattatatgaaaaatagaccagtaaagcaatcaagtggaaacttggtagaaatgta

SEQ ID NO: 124518 - DNA, 1602 bp, Homo sapiens
ttatgacctgacactgagaattattaaggctcagatccaaatacttagttcattttctcttgctcagcatttagtaaagatgtggaacacactagtcagatactggttagtcaagctcggaattcaggatttcatatccttgtcaccatgtgtgaactttggaatatttggattttaatatatgcaaatgcttttataatgtgtgatgtgttaggtgaaaattattgcacacactaacaatttaatttaaaatgctactcttgaatattttataaaccactggaataataacatagccttaatgaatataaaactgtttcttcttcctttgttaaatcatgtgggctgcattctacttaatacactgcctcaatttatccttttgtgctaagattttaagttaaaatagaaaataaacaataaatcaagttggactgcaatcatgttcacttgggaaatttcacttagagacatttgatatatttttggagggatttcagggatctacattggttaagttgaatctgtaatttggttatacataaaattaaagttaatctaagtggacagaatcaatactcttgtgagtttaattagatggccagcttccaagcaagagattattctttttactatcctcctatcctctttccttaggcagcaaaataattcctttgccaaagtatgttggacagttccctggtgacaagttctatagaaactcatagctatgctgttagcaatgtgagacagaagggagggatatgtgggtgaggaggccattgtattctagagatagtaataagcctgccttatctccagatcatagcccagccaaagggatagtgtcccatttgcagaggatctgcagtcactgtttctaaaccaaacctataaaacaggatggtgtttctttcaggctgaaaaatcccaagacagaaaaacaggaaaagtcggggagataaattataaattagactggacttgcagtgtgagaatcctgctattaatagttacgtttgatatgagatgcctggaaatgtggcagtaaattggagtgaggttttatttcaggtaataactttccttttatctctgttggtgcattggcaagaaaatctagaagagttttaggaggactggatgctataaccttcattgttcttatatgttcagtgtcatacgcaggcttttacttattgaagagtaagttatttacagtgttttaagagtgagattttattctagctccgtgaaacaaaacaactgggttgagttgtcatggttgatattacagaaattatttgatgagtagatgcatttttagcaataaatttaaaataggtttagtaatatttaagctacatgattgtatttctaactttgtggctgtcttttaaataaatgaagtttgaaattcgtgttttatatttcagatttttattcttcatgttgcaccatcacaaataaatatgtgttaagtagttaatatgagcaaggaacagtgagaaataaagatcagtaagaaaggttctgtcttcaatggttcgcagcaacgtggttgaaaaaccttggcaagagtacatgaactaaataatatta

SEQ ID NO: 124519 - DNA, 1099 bp, Homo sapiens
cagatccttgtgatgatgacttctgtcacagatcacaagagagccagtcacaaactgggtgtctgcactgaagagagtcctttagagactgagtgtctgatggacctgtgtttgcaattgtctttttctatttatgtgacttcggaaagttactactgagttttatttcttcttctccttaaaatggtaatgataaaagtgaaaatacctagctcatagggtggttgtgagaatgaaatctgaaaacatctataagcaccctagctgcataagagctataccagtttttctcaaaatgttaagtacctgtgaagtcatctggagatctttttaaaatgcagacactgattcattttatttagttgatctagggtgaggcctgagattttgcatttctaacaagctctgaaatgatactgtgctggttcaagggccacactttgagtcacaaggtcctgcacaatatgcatagaagaaatgttcctattaataggagctgttaaagtttgtattaacagaatatttctgttgataactttgcactcagtttggggttgtctgctgaaatatgtacatataatgtataagtattgagaaatatggcatttagaatcttttcattgggaaataatgcattctataatggttttgtgctgcattgtgacaaaaaataaatttggagtcctctttggaataagattccattaaaaattcacccatgttgccaggtacggtggctcatacccataatctccgtacttgggaggccaaggcacatggattgcttgagcccaggagtctgagaccagcctgggcaacatggcgaaaccagatctctccaaaaaaaaaaaaaaaaaaattggctgggtgtcatggcgcacacccagctactcaggtggtgtattctcagctactcaggaagctgaagcaggaggatcgcttgagcccaggagttggaggttgtggcgagccaagattgtgccattgtattccagcctgggtgacagagcaagcctctgtctcaaaaataaaaaataagaaaataaatccagcactttgggaggccgaggcaggcagatcacgaggtcaggagatcgag

SEQ ID NO: 124520 - DNA, 1150 bp, Homo sapiens
aaaattattttttctagtcccatactttaggatatgaatgtgagcatcacaatttgaattacttggcctgtttctttttcataatcacaaactttgggcataagagaaagatttttggatgttgagaaagggatattgagtgtaactgtcatggttctaagctatcacagagtaactaatttttgtggattaccatatcagatatcacagaatccattttacctccaagagtatagttagatacatctttgatttgtcagtgagaataactttcaaggcttacttaatgggaacgtatcattttgatataccgcgtcccttatcttctacttagcaagagattattatttccatattgaaaggatctaattctatagacagacgcagaatgttttttgtttgtttccacctctacagtatgctggtgaggatcatgctgattgccgattggcaggggcatccaaggtggttttcttgttaggtgcacaggagaagaaagcagacagtcatggataatagtaagccgacattcgagaacaggattgaaggcaaagtgtggggtcactgtaggagagagaaaaataacagttagtttcaagatgaagaaagaagcaagaataatgtccccttgggagaaaaatacctccaataagcatatgggaaatgagaaaggattcatgaggggaaaggaggattctgggaagggctgggaagttggcttggggaagaaaaggtgcctggtttagagaagggtgtcaggatggagaaagtatgacagggaaaagaactccattactaaagggtggatgccattttaaataatgtcaacctcaaggatggttggcccacttctggaatgaatagcatcaaaggtttatgtgttatttatcctttcttaaggcctcctcatgttagaaagtagcaaacctactcttctagatgctcaggcccataaccttggagttatctttgaacccgttcagtctcccagactccatatccactgatttccagttctttcttattggctctactagggaaaatatatctagacccacgactatttctcaccacctccattgctacctccctggtccaaagctctattctctctgtcagattattacagtagcctctgacttgttggccc

SEQ ID NO: 124521 - DNA, 1044 bp, Homo sapiens
aattcttaacacagttataacatatttgacagagtttaatggaaacaatattaggcatatttcaaatcatcatagaattcagattatctacagaaaatgttgcctagtgtatggtgtgttcagctctgctgtgtctctacagaatattgagaaagggaagaaggagcgattttttaaactcaaaattaaaacagaaatttaagcatatttttatattaaagaatactttgcttaatgtacatttttaaaaacagcaaaatataaaacatagaaataaatttctaccttggatctaactagagagctcttttgccttctctacttttcttggattcagtaaaaataacaaccatttccgcatagattttatgggtactgaactgcattttctcaagaaaacattattttcttagtaaattcgcctttatatatgtatttacttctaacaaaaagaatcatagtattgttttatcaaaaagtaagcatagatgatatttattttaggatacccactaaagtaatacatagcctagtctagtctagtatagttcagaaatagtttagtaaacccttatttttccaataacccaactgtattgggtcaggaccaagtcatatctgccttctttacaatttcttctgtgttgagcaattcaatagaaatatcactttttagggtcttaatgagtaattgtcttgggggagtggcctttgacagaaaatattcagtttcttagcacatgtaatgtgaaaaattagggtatttcagattataagtaaaagctggaaatgtcttttcaaaaattatttttgttttgcaaatgctatgactagtgtcttgaacccagtagatgaaaatatctaataagatatcagaggtattatttgttgattatgtactatgtggtaggaactagatcaagcactttacggatattatttcaatgacttcttccaacaagcttataaggtattattatcctcatttcacagataaggaaactgaggttgaatggttaagaatattggccaagtagcacagaa

SEQ ID NO: 124522 - DNA, 1031 bp, Homo sapiens
gttccaaacacagcagaaacgacatgagtttaaaggtaggtattttaagttttcaggaactcatttttctcaattttttctagagagactaaagtagaccaatgctaatttagaaaatatagaaacaacattctgaatttttgaatgctaaatgtaattggtttaattacagatcattttgctaaagaaaagttatgttatggcccataatgaagaaagtttctttctccttcctaggatagcagtaattgtgctgcaaaaaacccaaaatgtttctattttaaaaatgtcttatgaattataaaacctttgaaattgatggcttgatgttgcagataaattgaactagatttcaaagtacagttaacttgacagtgctttgaaacaagggtcactcattgtcattacatctttatgactatttttatgagagaatttggataatttaactctcaaaaattgtcacatgctgttttagcttttgtagttttgcttttgttagatgtcacaaccgctattaacacaacttgcattttttcctttcatttatgttgaactaaaagatatatgtgaatattttctgggaattatttaccttagattgaagaggagagttgcagtttttacattgttcttttgctgtcattaaaagaaaaaaaatcatctgaccaggaaatagtatttttagtaaatatactctcagaatcttctccttcccatctgaaaataagatgtttttgctttttgataaggtaatggtcaatgggatcgaaagacacttttttcttccacaattacaatagacactggtatggtttattgatgattctcatcagttatatttcaccaaaatctcatagcaacaggagaaaatttcccattgtttggttgggagccagaagctgagagtgcaggtcatttttcttcatctgaggaaagtggaatagccaatccaccactttgttttctaggtctaaaatgatctgttcagtctttcctaattcatgggtgtggcattcataggagaggct

SEQ ID NO: 124523 - DNA, 1077 bp, Homo sapiens
aattgatgacattatttgctgtatcttgggtatcaacagcatataaatgaaaaacacagcagaatgcctggcctgtgttaccacattgacctacacatttggatctgaaagatctcgagctattttctgcctaagcagactttgcacctttgtgttttatagtgaagtagcaggtacacaactttttaaaatcatgaactcctagcattggattaccaccacctggtgtaagggataggttttatagaaacacaaagagcatggacttattcttttcatttttgttcttctttgccaattttaatgttatcttcacaatctgaacagtgtgacctgtttcaccttcttttattttgaatgttagtgtatgcacattctaagccaagggtggctttaccctttaagttaaattaaaccatttgggacttagcaaattctgggttgtatgttttaaggtgaaaaaaaagcactaaaaagaaaatttaaaagaaattttatcatcatatagggtgtggatgaatgattcaaatagaaaacctattttaaatcagccctactgaatgaactatactaaaaggacatttatttacctagttagggaaaaaagtcactttaaatatggtctctagttacttttcttcccatttattacatttgccacttcattgtgaccttactatgaccttgtagtttatgggctaaaggtaaccattatgcaataatgaaaatatgcaggccagtctttaccaccttgaaaaaattggtttcttatattttgtttaaattaacacactttgctatttataaagctctgctctacggtgcttgaaagaggagagaagaattaatcgcaactaatgtgcagatttaggcttttagagactgtgtttagtggaggtgagtcagcaggccttgttatattaattatagtggtttgattctctactggttttgattcacagagatatgcgctgtacgtaagaattaaagcatcaattgcttaggagaaaaaggaacttaaaaatcaaaccattaatacctatctttgctttcttcttttgtctaatttgttttatt

SEQ ID NO: 124524 - DNA, 1027 bp, Homo sapiens
gaggaacagactacagtgacattccccttcaaaaactggagattgaatcctgcaaaccacgtctgcattttgtgaaacttactttcctcttaggttttctttaatggattgaggcctgagtgtttagattgagctatcagaagctaaataaacagtagtgtaatttgcataagctagtctcagatgccttagttgtggtataaaaacgcttgggaaactcatctaaatttaatcttttgtaggctgtttatgggctttctggagaaaataagtcttcctactttttgttcagctttcattacttttaatcattttggtcatggcatgtcaaaggttttctctttgaaaagtgcttttagttggtatttttaatgaagtgttatccacttaaagtgtgatataattgtgatattacagctagcagggaacaaaacagcttgatagtcacttccagggctccttgagaaaaacttatactcaaggaaaggtcagctcctctctactctgtatacatcttttgggctcacttttgcacagctgctttgcatgattctatggctgtttgcctcatttgaagatgcagttgggaagaggagcaaagagtggctatgctggtggttggggtggccatattctgcaaaacaccgcattcttctgggagctttgcactttgcatgataagacttaatctgtccctttcaatcataaagtggcagagctagggtatactgtggtgatcatcatggtggtgatcatggtattcatgatggagaataacctcaatgcctcagcagaactggataggtaattttctcttgttataattgtgctcaacaacctgcattggtttttgcctcagttacatcatgtatagagtaaacttaaatgcatgagctttcaaaaaaacccatgctctagtcctagcctcgtttttatttttcttccatattctgctacgtacagctctcttggccagagttactactcatagttcacaatctggtgttacctgcctctggtatttttt

SEQ ID NO: 124525 - DNA, 1052 bp, Homo sapiens
ggatagagaagccattaacttctcactatcaatgtagtataaagtaaaagactgagtgaggtgggtggtgagctgggagtgtaaaacagggaccagttcatggagggttttgattgccaagctaaggagctggacttttatcatgaatgtatcggagtgccctcagaaggtttcaggcaagtgagaggcatgataagatttctgggttggagaactcactctggtagcagtgtgaataatgaacatagaggtgagagactggttcatatgtggtattgctgatggttgggatgaattttgtatgtaaaacagttgaatgaaaggttgctttcaggcacttctttactggctaggcacctcttttaagaacagactcaataaaaagccatatacattatattacccttcagagaaaattttgggtggcatagcaaatctaaaaaaaatccacaggaaatctgatgttctaaacagagcgattatataaaacgctggctgtggcttaagcaaacgcaatcacagaattgcctagctgtgagtcagagtcggcttgatcctgaaaagtcccttgcttgatagtaaattagtggcttagggaaatatgtttacatttcatttcatattgtacatctgattgcatgttttgagaattggatataaaatatctttatttacagatttggagctgggaattatattgactgtgtgtacatacagacttaaatttcccagttaagtgtataaatacagtgaggtatatacttacatagcaagataatgctaatttgccattttatctcaaatagaaacatatccaagatataataatggaattcagtgactcttacggtaaagtcatcattactatagaatggcatactaggtcttatgatttgatcaatactaatttattgggggaaggcagaacaggtttaactatttttaactatttctttccatgtacttccatatttctttctatcataaaatcgaaacacgctgttgcacttgttattttcctgggtcttttttctatattcaaaaatacacct

SEQ ID NO: 124526 - DNA, 1048 bp, Homo sapiens
ctccatttattttccagatgatataaagaggacatattctcacatctggaagttaatgccttggttctagtttattctccctccaagcacactaaagactttttcatttcctagcatcggtcttctagtggccaataaaatggcaagaaaagagttgggaaattcttccctttctcctcagtttccccttattttgttgcttcatttaatcctattctatttcagtaaaggaaacacggtctagttattgcaagggagaaagactagaaaggagaagatattggcaactagcaatcagccaagcaatagcaacaagagattcaatattgtcaggtgaggtagcctggttggagaatgcatatgccaattacaaatcgatcataaacaaatacttatacgcatgcagaaaatcctaatctattccactttgcccagtttctgtccatggactaatagtggtggtctctaaagagcactctattaggcaagaatgaggcattgattttataaaacagaatcttcaaaggagggggaagccaggcctgtggggaaagaaagcagaagtctggcaataggtcatgggaaaggaaggaatcactgtggggtttggacttggagagaaaaagtagcagcaggtcacaggccaacctgtcattagctttaagacacacacacgcgcacacacacacacacacacacacacacacacacacagccactgcttacctcagaatggattgggttaaaggttatttttttcccctctcaagactggtttcctatcttaagtttatgttaataattttactgcttctttacagtcctaagtttgcatatggagaggttaggtctcaaaactttcaatctcatagtccaaggtatgcccttaaagtgtaatgtggaaagggttctctttggctacacatgcatcagttttctatcaaaagttattttatagcagactgctattgggtaattgagatgcactttactaaaaatataacaggtttaaactagtggattttattaatacttgtttttgttttta

SEQ ID NO: 124527 - DNA, 1050 bp, Homo sapiens
gaatgatgaaatattggcaatgtatgcacttgcttctctgtaggagctcaactctttgatccttcatacaattaacttcattgcctagctggtattaaccggctggagagtaacaaccaattgttgcaggcacaacaacaccctaatatgctttgcctttaatgactgactgtttcaaattgaaagctctgttctctctattcctaaattcctgttgaagtaagttaagtccttaaataagtataggtactcattcacacctacagccttatcttttttgtggcaccttacccagtccccaattgccagagaatacttggtcattagcaggggtaagatgtattctgggttctctagacgtaaacatttgaatgttaggtctccttgcttgcttttatttctttattttttttttacctccttacttatttagtcattcattcattttagaatttgacttccatatgtctaaacacaagcagcctcccttgactcctcttccctctcccaatccacaatcaatctatctttgaatcctatctgctccacctctaccataatcctgctgatcctggcctccaccatggctcttggattattacagtaaccttctcattgatctccttggttttgtccttaatccccttcccctccacctctcatcgcccaccctggacacagtttctttcttcttctttttttttttttaaatattttcttttattgtggcaagaacacttaagagggtgagacccaccctcttaacagatttttaaatgtataatactgtattgttatctgtaggaataatgttgtacagcagctcttttagaaattattcaccgtgcataactgaaattttatacccattgattagcaactccccatgctctcccctagatcctggaatcactattctgttctttgcttttgtgagtttgactgttttagttacctcatgtaagtggaatcatgcagtatgtgtccttctgtgactagtttatttcacttagcataatgtcctcaagttccattcattttgtcgcatat

SEQ ID NO: 124528 - DNA, 1051 bp, Homo sapiens
aaatatagtcaaatttaatactcaatattgaacagttttccagggtgattgtgccaatgtatagtcctactggtactgtatgagagtgctggtcactccaattccttgtccatacttggtgtccacagttttgtaattttagctatgccactgggtatatagtttcagttttaattaaaatttttcttgaagagtcctataactgaaataaattgaactcatccttaacttatttctggatttatttcttacatttgtttaggattttagtctctatgtttacgaatgagattagtttgtaattttcctatcttgaaattctcttattagagttggcgccaagatatacccacataatgagttattcagtattttctcttttctggaagaacgtggtgttatttcttccttaaagttttgcaacagtttactgataaaattgtctgtgcctgcaggtgtgtgtgtggggcaaggggaggttttaaattatgggttagatttgttaaaaattgttttatgactattcaaatactctatttacttatatgtcagttgtgtatgtttggctagtcccttgtatctaaattttccatttttatttttataatggagaatcctattatatttgaagtctcctttaatattcctgcattatttgtttgaatttactgaacctctttgttctgcatattttttctatttaaataatttctgcagttacctttttaaaaaatttccttcagtttaacttttatttctttttctaagttttgaagtggttggttgcttattgattttgttttcctttatatattgaaaactgtagtttttcctctcagcatattatgctttagtttttcccagttttattatcatccaaataaaataattttttgttttccatttgattccctttttgacttatgagtgtaatacttgtcaaacccacagatgttatctgtttattatttattatgaatttctggattaattccactgggggtataggacatactcagattttaatacttggaaatttgttgagactcct

SEQ ID NO: 124529 - DNA, 1046 bp, Homo sapiens
cagattttaggtttagaaacccattcacttctagcttatttaaacgttattgcttattttgaagcttatgccatgtctgactttggcttagaatgtgttgccttttcacaaaagtgttgtggtctgttatagacctgtttacaaagaactatcactaattgttatgacttatctagcttagtttgatacctcaaaacaatctgagtcaatctttctttttctgtggtgtgtatatgcgttgtatgtgtatatgcatatacaatgtatgtattacaactgtaattgaactatttcatatttttctctgtagcaagttatgtcattcttctaatagaagtagaaagaaatagatggaaaatttgactatatgccaaatttcttatagcttagaactatttattaccatcttagtaatgaagattattatttgattgtttatcagaaatataaagttgtatcgttagtgttcatgtttttcttccaatctctttgcccagtgactacatttgaattttctaggtcaatttaaaattgtatttcacttttaaaaattcggacttattttgggctaaaatagaaatttcagttaagcacaataacagagatgattgtaaaaatgcagaaattccagttaaatattaacacttaatataattaattgctgcaggtcagctgcttaataagtaaataattgtttccagctatcttttttccccagtttattttaatcaaaataattttcttggctgtgtgctgtggcccatgcctataaacctcaggatttggaaggctaaggtgggaggatagcttgaggccaggagtttgagactatccagggcaacatagtgagaccctgtctctacaaaaataaaaacgaaaaataattagctggctgttgtggtgtgtgcctgtagtcctagctactccggaggctgaggtgggagggttgcttgagtccaggaatttgagtttgaagtgagctatgatcatgccgctgcactctagcctggatgacacataagaccctgtctctaaagataataaga

SEQ ID NO: 124530 - DNA, 1054 bp, Homo sapiens
aataattactaattatttgataaatttaattttggagcaaatgtgttgacagctgaaaaaacatgtaatgacttggatagagaccagatataacactagaacaaataatattggcgacttaaaaaaatagtaactgatgaaaaaaatctaattgcgttaaatattttaaagtacctaaaaataccaaggattttgtatcttttgtccttttctacttgaaatttcttaatcattttggtgatcatacaagataaatctttaaaattactgtgtgagtattcttaaaataaatataattctttggttaaactatacttctctaaattacatgcagtcttaataaaataattcctatggatgttaatgttcattctaaacaattttgctcaatccatatttttgtaaactgcattgctttgctttttttaaaagctactgtttatatagtcctagttcccagtttttcatatatactgtattgtgtctttaaaattagaaatgctgctgaaacatagaatatattaatccttgatgaaatgggacctctctttgagtataggactgttgcctgtacaactaagtctagtctttcagaacagaataggatgctgtatatctgttccctggaacttagatcctttggccttggttctacctgactttgagaaattacaatccctagtttttgtacatgtttcacttactttctgcatacgatttctggcttacttgactcttaagttcttgctgccagtcttgcctctgcagcagtccacattctctcaccaccaaagacataatgtcttgtggcttccccacttttatctctttgcctgctactcaacatttgttctgcaccagatgaaagtcactgttttaggtactttttaggggtacataaataattatttccttcaagaagccagcaatctgcataggaaaggttcacaaagcaattttgaaataatttaataagtctgcataatggattatcacatgagctttgtaatttatactattttgttggaattgtatagcaatatttataagttgt

SEQ ID NO: 124531 - DNA, 1014 bp, Homo sapiens
cattatattcaaagacaatatgagaaatttttataacatggcaaaatagttgtattgtagtattcagtgaaaagagcaagatgaaaacctttttacataggttggtctacactccaaaagtagatctcacagtgatttttttctacatggtaaaatcttgggattttctttttattttcttgaattatttttctttagtaaatatatctttttaattggaaaaataaatatatcatcaaaaattctgttaaaaatgttcatgcttcaaaagtttcaggttattgttggaggcagttcaaaaatgttatagctgtgaatcatggctgtatttaaatacaggtagcacttcgtgttagaaatatgtgttgggaggggtttatattgtgtgtttatgtaaagatagggtaagatttcacaaacttcttatagacaaaaacagttacaaagatttgtgtcattttagcataaaggtgagttccttaatattactttttattaaatcatttattcattccttcattcaataattatccattgagcaagggcttgggtgcccaagattcagaaataagaaatgtagtaggaaacaacacctaaaattgacttttctctcaccttttgggcaaaaattggaagacagttaaattcttttacgatagcagtatcctatgtgatcaaaaattcaaagcgtctttactatctaaataatgtctattgaattttcagatgttctctcagctctttaattaagttcactaatttctgtctcaatccagtgttgaagtcagcagccaaatgccacatatggaaaaatgttcctctggaagtaaattgaatattttaaaaattactgtcacttatcttaatatttaactcaataaaacttctgtttctcagtgtttccccacacattttcatgtgtctgttaaattgttggtaatgctgcatacataattccttggaaaactaaatggattctctatcatttagaagagttttgggggtaatgtggta

SEQ ID NO: 124532 - DNA, 2203 bp, Homo sapiens
cactctcttctagctgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcatttt

SEQ ID NO: 124533 - DNA, 2269 bp, Homo sapiens
aatttctaaagttatgtttttggtagtgattaggtacatgtgcctagtgctactgtataagactgaagttctggagagaaagctacttcatcgatccatgttttattttagtggtgtaaaataattcacaatgttaaagtaatactatcttagtatcagctaagtagaacaatggactattatttgaaacaagattaaaatagtagactggaaactccattgctttgataaataccagatcatattttctattagatgtcagtggtttggttaataagcctaggtattgtggtgtttaatgttcagtgaccaaatttttctgaaacaacccaaaacttggaagacatgttttgacaagatttttatgtcatttttatgtgtggaaacagtctgggagaagttattcataaagaaagaatttaacatttaatgttaaatttaacatttttcaatttaacattcagcagcccatacatattttagtgggttgagggataacaggatagaatatttggaatttatgccatggttatgtgtcttgtactggagtcattatttagaaaatcttagcctgttgggatatcttgatctcaatttgttctttgttttttgcttattgttctgttaatttttttaactgttaatttatagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgtt

SEQ ID NO: 124534 - DNA, 1077 bp, Homo sapiens
tataaaacgcatatgaggtctttttagaagttatatggggtttgcttggtttcaatgtagctaaagagtaatactgtcctccctaaggaatcctgcagtggggagttgagatggttttttttcttggacagggtggcgggggcaggttagtttatccagttagaaagttaatgtgcccagttagacagttaatgtgcaattacttatataataaagtttgagctttctcaaaacccagtggtattctaaagtgatgttttggcatgacatgtggtaagttttaattgaggtaaactttttccatattaaattagaccattaatttgatgtttgttctttgaagattatttgaagcttgtaaagtttggttcaccttttaactttgtggatgtgttctttatgttacgctctttcttccttcttcttcccagggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaaggttagtttatcattacgtaattatcactaggtacttaatttctatttaattctgaattttaaagagaattttattttaattttaaagagaataagcctctctaaaaatacctgtttataggaatattcatgctttcaaaccataaagtcaatataaacaatactcttaagtaatctgtaacagtgcatcaaataaatattctgaaacacagactagctaactggtctgtattttaatatttaatagttcaattttgctgagtattttctattttgttgttaactttttttttaaagttgacctctaaacttgaaactactgaaagcacaattaccttcctaactattggcctgctttgtttttacacacaaaaaattgtgttgattattgtcttctgtgccagatattttaatttctgtattattctgtatagaaat

SEQ ID NO: 124535 - DNA, 1028 bp, Homo sapiens
tatcagactgtcctgtacatgacagactcttttcttccctggcttctgcaaagtttgtgataaccatgactagtatcacaaatttccacatgtccccccttccaccaggggaccacagccctccttccccttgagaatcactctgatacttgagagacaaggctttgattagcggaaataaagtcttgataatttgtttttctgtctagtatggcagttaatttttcttcctattctctgttttctgtgtccctaacattgtcttagtgataggatgattccagcttaggaatgccacatgcggaaattaaaacctcagaaaattgctttcccgagtaagtctctgagttagggttttcctaatttggtaattcttaaagtgtattttctgtggcttctggctgttttactaaacaacatctgttagggataaattctttcccttattttatgtgaattgttagaagtttgagttcaacaaaaaatattctttgctatcaaaggccttagagtcatgtgtgaaattcaaacatatatacagataggttcaatacaattagattaagaacagtgagaaagttggcctataggagtagaggaatgatttcagctttgcctgggggagtcagggaagttttctccaacaagtagtgggtgtggtaatgaagccaccaggttttgtttgttttgttgttttttgttcctttgtttgagatggagtctccctctgtcgctcaggctggagtgcagtgctgagatctcagctcaccacaccctccgcctcccaccactaggtctttctccttaatagttataattccttaaaagctaagaaataacagtttgaaaaatagttgtcccttaatcatgactgttacatttgtagactaaagtgtcagtcagttcctaaataatgtagttgtattaacatttgcatttactatcaacagttgaagtttgggattttctctattaagtcattgactttaaaattcaggggcttcagctttaaccgtaatgcttccctt

SEQ ID NO: 124536 - DNA, 1052 bp, Homo sapiens
ccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctactccacccagagaagcacactttgtgagaaccaatgggaaggagcctgagctgctggaacctattccctatgaattcatggcataataggtgttaaaaaaaaaaaataaaggacctctgggctacaaaaaataaataaataaataaataaataaataaataaataaatgatcaccttaagtatcagtttcttttgtaaatgaaacaaaatcacagaagatgagtagtgactcagcaaagatgcaatattgtcttattaagggtaatttttcttgattcatggtcttccacaattatcatgacctacttaggaaaattcttgcaagatggttgtaaacatgtactgaggacaggtttatttgcctcaaattatatatataaatttcttcagtcctatgtcaaacaatggttttaacctttccctgcaggtagggtcacatgactcccagtgcagaccaagccacagccaaatgtttaaaactaatcttgccccttgggcaaagggacttgaagaacacaagtccataatcacagggtaagtatcagtccagttttgctgcctgtctgatcctgaatttatttccggtttgccttcttcctaagtcctagtttttgcccaatttttatgac

SEQ ID NO: 124537 - DNA, 1026 bp, Homo sapiens
gcataactttgggtttaatttttaaagcagaatttataggtctcgaacatatagtggacttttaataacaaatatatagtgagcagtgggggatgttattaatcaaatccaaagatttctgatgtagcaaaaattatagcagtttgttttttaactgtctctggtgaagattacccacagctagagaaataatagcactgtaaaatggtcaataaataaccagaaaaacataaagtatatctagtggttaatatttgaagagttaatgtagcaacattgtttccacatttacttattttaaaagattaagaactttcattacctaaatttttatatagcaatataagtgtaacaaatttcagatatcacagtttcttttaaaaaagcggtaactattattgcaatcaaatttcaccttctgtgtattgcaatgaaatttcaccttctgtttattcaagtatcaattatttattattttcaacaacaatcaactagattaacattattttgtgaccatatcattacttcccctcaaagcgttgcatagcataagtgttcccagaattatttatgcttacctaaagtgatcggatatttaaaagaaccaaggtatcattaacaaaaaattcagccttctaaattatttgcataataagctcccaaattaattctatcttgaagcaatggagacactttctgatcaattaaaaatcatacatgtttgccctctaaactgacagcaaagtagctgatatgctttggaaaattcctgtgccccaaaataacttcttctcttgttaccaaattatctgaaatctcactacttaatggattctttttggttaaccatggtattaaccctatgattttttaaagtttttaacatggtataatggaaattttcaaatgcatacagaattagagagaatggtataagggaccactatatactcatcacccagcttcattaaccatcaactcaaagccaacttctttcatctgtgctcctgctggtacccaattcac

SEQ ID NO: 124538 - DNA, 1070 bp, Homo sapiens
agattattgggggttggtgttttcttttgttggaaagtcatggagccttcattttggttttgttgcagcttgaataaagtctaagaggtcaccaggaagcttctcagccctgagacagagtgagttatagcaatttatgtgtatgtacattcttaaccttttacgtcattaaccaacataaaatcagataaatgacaggaaaacactgattcccaaatacatttctaaaaagaaacatgaggctttcaggcttctttagattgttaaggtttataactgcttatttcttcaaatttctcatgtggtgacagccgtgccttcccataatttagttttgactcccagattttttgaatctctggctctattgtctgtgaaatggttcctaatggtgatagtcagaggagctttctttccctgaatgctattagtgacctaacagagaagggcgtgatttaacttgccagctaaatgcataactgtagctgtgtagaacaaatgaagagagcagatgctacaagctggtattcatgcgacctttaacatttcagtgatatatggctgctgtgaatgtaactgaactataaccaagagaaaagaatttatcttctctcttcaaagtatcgtaatcctaaagacattatctcactcaatttgttaacagtaagagctcataacagtaagaacttgcaaaaggacggcagaatgagagttttaatgtattttgccaaagggaaatttaccatctgcctgtcttcatgaatcacatatgctgagaataatattttagaagatactgacaataagacacagtaatttgtaaatgaaaattactgatgctgcccttttcaaagcactctgtggaataaatcagtacagaaaactataggattacaagtcaaagacttgaaataggagaataataaactatattattggttttttatcattgtaataaagatccccaatctttaaagtgttaattactttgattcaaacttcactatttccaaatgtacactttcaatgtgcccctgagataggtaggctaggaaaatacattatcaagc

SEQ ID NO: 124539 - DNA, 1038 bp, Homo sapiens
attataagacagttttagaaaagaaatgttttatgtaattctaacaactatgcatatccccttgtggttggaaataatcctttttgtgaatgattcttctcagaagagaggcattcactttatgtacacgacatcttgtctttggtcttttttttttttttaatgagcctcacaaaaagaccccctagaaatgatcaggagatgccaacttattctccacataaacattctgatttctaagagttaacagccaccgcctttgtgtttacctgaggctatactcattgccaaacttccctgacaagctttttgcccttacttattgttgtgctgatatccggtgtcagagcgttgtagattgtgctggaaacactatgtaattacatgggctttctgatctcaaagttacctcacctatttcatcactatacttttctaacaagggaacggaaacccaagatataagacatcagtgggaaattggcaccatggatattggagagccagtggcactatattaaacttcaaaatgaaagaaggagcctgatggcaaattcacttgcttccacttttgaaggtcaacgagtcacatcccgaaaactagagtgattcttcaagtgatctgtaaatacttcacgtgtttagaaatgagtgttgtaacctaatcattttggtgattataaattctcagacacctgctgtctgtcttccccctcacacctgaggacctgcacaatgtagagagactacaatagatatatggctaaagtagacaacgtgctacttctgcattttcgtattagtaaacattttaacacattttttcatatatgcaaattaaaattatttaaataaaatgcggtttcaaatacaaatctatctttttatttgaaaacaatatttgcccttacaaagtccaataagttgttttcaaccaattcgtgttttattgatagaagagtcaagtgttaaaagaaaaaaagtgagaatggcattaaaaatttaaaacaatctatttttgttatatcaaataaaatt

SEQ ID NO: 124540 - DNA, 1108 bp, Homo sapiens
tgcccaggctagtctcaaactcctgggctcaaatgatctgccgtcctcggcctcccaaagtgctagaattacaggtgtgagccatcgtgctggctgagggcctagagtttcagtagaattggagtacaggcctgagaatttagatttctaaagacttcccaggtgttattgacactggtggttggggcccacattttaagaaccactgctgtagtgcagttaacaaacattgaggatatctagtctacagttttaagttggccaacatccagaaaattccatggttcttcaagattccatcagatatactgaatctccctagaggatctgtggaactccaaacatctcacaaatcttatagccttctagataaagatgggaatatttgaaaaattagggggatggtactcctcaaatttctaggaaagcttaagacccctggagactccactgactcttgagtgcagacaatagagttaatcatgtagcctaactatgtgcttggtctagtgattttgttttgatttatgttccgcagcagagcaggccctgtgacaaactggcttctagcacccaacccttgctcaatgaatcctttgtaaaaacaggtccattttatacactcctaaatttgtagccatttcagtgagttttatgatgattataatttgctttctagtctctctcagagctgatacttttgtttgactaataagctttccttcctttttccttcttctggttttgttttctctgccaacagcagtaggcttatgacttgagtaatgtccttggtcttgctttagaattggagtataacccatcccaagcaaaaaattaatggggtaagttcgtctttaatgtgaactcacaatgctggaaagatatactctggggccaccattaaccatgatctctgcaacaaagagaaagactctctttagcatgataccaaagtttgggctcaggaaatgataccccgaaatatggagatttgacacaccgaaccaaagaagcagtctcaggtctctctgactttccccacttcttaatcctctatctctccgaaagcacagggtgaggctgttctctggatttcttttctacc

SEQ ID NO: 124541 - DNA, 1047 bp, Homo sapiens
taagatcaaattgacaagagaactgaacagcattagtcctcagaaacatctgtgatggaaaagggagagtacacaacatgtttgtagtgggaagaaatattattacaatactcgcatgttaaataatcatttgaaagtaaacaggattatcagttaggtgtcagcatggaatattaatgattaataaagtgtatcagcttatataatctgtatatcttcctgtgtaaggagctgtgtggagtgatgggggctccaaagacaagcaaaaggtgctcctggcttcaagaagcccacagggaagctggagagatgacaaaccatcatcacaggagaagttatacaacccagaaaccataaataaaagttcaattgaagccataattgaagagatgtcacaaggcagtaggtgattaattgcaaaatgaattctccagtcaataactgtaatgggagtttaaggcaaggagcaatccctccaggctggggctgtgagggaaaactttgtcagggagcttgagcttgaattggatcttgaaggatgcccaaaatgtgaatagctgtagggtgggaggggaagggaattccagacagaacagtgtaggtgagccgaggtgtagaagcaggaaaatacggggaaagcacatttgaggtgggaaaaaaaaaacaggaggcctggctggacctgacataactccagggccaacccctcaacccttggagctgctgctgtggaaaacacttcataaggcaccctggtactatccaatctcgaaccatccacctgctgtctgcctgccttcctacttctaggccagggagcccttggtaacacatgcaaccacaagatgggcaaatccttccaaaaatcttgtgttcttcccacactcatgtctgtttctgtttctcatgtgaattccttgagaagtacaatctatccaggcagcctgttaggaatatatcttttggaaagccagaaaattttaccatacttcccatccctgtctttattcttggagactttcttaaaagcaagttcctcctgttaca

SEQ ID NO: 124542 - DNA, 1164 bp, Homo sapiens
agggcgggagggaatcggggagggaaggagggttgtgttttgtcttaatgtctgagagagaacaacctccttctgggtgttgctctggagccgatgggtcgggtttcaaaccacgttttgtgatatccccctcctcccttccctccttctcccccaccccctgccggtgtgcgtggatcgcgggtttatggagattaatgttcggggggaggggggagaagaggagaggaagaagacgaataataataatcctaataacctgttgtcgtgtgtgtgtggtgggggggtttgttgcagatcagaagaaggaggaggaggaggaggcggcagcggcagcggcgatggctacagaaggagggaaaacctctgagccagagaataacaataaaaaacccaaaacctcaggctcccaggtaaaagcaaacaaattaaaaaaattcatcacgacacattaggagagagagggagttatgccctttgaatgtccagaagtaacagaataaaatgtttatccactcaaagcatctttctgagagtgtggaacttaaattgtaaattcatcaagttttcacctctttgagggtataacgctgtttaaaattacatcaggaattcagactataagaaaacggtgtgtgtgttcccaagggcattttgagtttaggaacataacactttacaaagttgtaaagaaatttccttttatttaaacttgatattataggacttgcttccttattcatatagttcttatctacttttgttcgtatttctttttgatttctgctgcttcctaaattgttatgtagagctgtcaaaataagtaaccccctggcaactactggcctccactaaatccgcccactttttttcccccccccctctcctttaccgtcccattttgggtaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagt

SEQ ID NO: 124543 - DNA, 2956 bp, Homo sapiens
ggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtaagttctgacatctttttaagtaccttttaaatagtttttcataacaattattgcttttctctcctaattctaaggtttgacgtagacctctgaagtaaacacacaatcataaggaaccagaaatagcaatattatactaacaaacatagctctgtagtaatcaatgtgacatgttcacttttgtagattttataataatgtgttaaatttgttagttttttaaaaagtattgttttatgggacagagctttctgattagaatcataattgccttctgtaatttagtggtcttatttgagtacattccagctcttcagaaagaaccctagtcgaaatgatatttatctcttctttgagggaaagtagttttaaactgaattggtatatataattgtgagtctgttgaacttttaattctgtggtgtaataaggctaacttttttttagtggaagttatttctcaagcttcagcatcttgtcgcccatgcttttgtgttttattacactggttttaaactagatactgatgcagttgagagataattttaagttgtaaattgtttggttaacttttatgcctacttttatgctactatcaggatttgaatgaataatccttcatttataaaattatatttaattaaatcatggtcattgtgtgatttgtagatgtttaatgtaaggttggtggaaagcaatgaaaaatgttgacagtaaaatgtcactaatttgaattaattgtggtaaagttatttttaaacctattgtaaaagcagttgttatttgttatgcatataaatagctccttctgaagtacttgggaagtagttttaatcttttttggaccagtcttattgtacctaataacttttgttttctagtaattaaacccttttcattgattctgatttgatgaaaacctcgttgtgttttagtgcctttgatacttccagaccttgttagttaaatatttctattttgataatgtgggataaataagtttatcacttttgaatgatctttcttgaaacaagttgcagaaaaattacgctagggttcttcttttatggttaatacctgaagtaggcatatatatgtaaaattgtaaattgccagataaagccttctgattcaggagaaccgagattatattttttatctagataccagtgcttctaggccagcgctatccagcagaactgtctgtgatgttggaaatgtttatgttttctatctacctagctacatgtggctgttaagcagttaaatgtgtgtggggcaactgaggaactgaattttaaattttatttaattttaatttaagtagccacatgtggctagtggcaaggacagtcatctagttagtgtttccattgcggtactttttctcctaaaactattacagcgtaattacataaatgtttctctggattacaatccttaacttgctttatttctactcctttgctaaaaactttgacaataattgtagtatttcagaaaagtgtttttggtgggttgaatgacagtttgcattgtcaaagcagaagttacttcacttccatttcatcttgcttattaagcattagtgagttgtgattaattaagagaattaacttataatttaggttagaagtaatcaatttttctgctctctagttgataacttttgcaatccagaggtttttcccttagccattgtgagggtaaagaaatgttttggccaaccaaacttagattaacttgaatggtgcattaaaataaacacaggatccagtttttggtactgtaagttttgaattgtgggggtcaagggatttgcctttcaaacaaactttccaggt

SEQ ID NO: 124544 - DNA, 1048 bp, Homo sapiens
ataaatactatggcagaggggaaagatactaaccataaactctttgtgttttacccaggtaatatattttgagcattacttctttggatgaactgcctgtaaaacagaaaagtcccaagaatcgtttgatgatcactgtaataagattatactgtttttagatggttagtacactaatacctgattctgtgattgcctttgctcatattttctgctctcatggaagattgctttttaccgttatttcctgttttatccatttaattgttagtggtcctgtttactaactttgtcctcttaccacttctcaactgcatatccatttctttgggacttattccttaaattcctactaagtctaagcacaaggctaagttctgagagcataaaggtagaagcctttgccttccaaaaggttatgttccagttgaggagacagaatattcattaaaataaaaggtaatgcatagaagtaatacaagtggcatatgctaaaagagagatgaatggtaaaagatggtaatactaaaattaagagcaggatgaatcttctgagagccagggcagaaataaaagactccatgaaacctggtaggcttgaactaattctttgagaaaaggagagccctaacaggaataaagaaggaaggcattgtacaaaagatagtgtgtccggaattggtgggttcttggtctcaatgacttccaagaatgaagccacggacccttgcggtgagtgttaacagttcttaaaggcggcatgtccagagtttgttccttctgatgtggggatgtgttcgaagtttcttccttttggtgggtttatggtcttactggctcaggattgaagctgcagaccttcgcgatgagtgttacagctcttaaggcagtgagtctggagtcgttttttcctcccggtgggttcgtggtctcgctggcttcaggagtgaagctgcagaccttcgcggtgagtgttacagctcataaaggcagtgtggacccaaagagtgagcagcagcaagatttattgcgaagagcaaaagaacaa

SEQ ID NO: 124545 - DNA, 1041 bp, Homo sapiens
tgtagagatggggttttgccatgttgcccaagctagttttgttttttaacagacgtaggagaaatggggaagccagtttcgggaccatagtattgactcagatatcagtgatgggaagtctgaacttgagtgtaaagtatgtggttctcaagagtcttaaaaaaataaaaataaaaaagaatttgatgtatgaatggagagaggaaaaatattttaagggtaattctgtagagtttgaatctggatgaccatgaaagtgcttgtgccattgaaagaaatgacttccagaaaatgaaagtgatgaacctgaattttgatatttgttaataagtctgagctaatagtatgttgaaagtgtctagtttgtatctggagattggtcctgagaagagatcagaatcagcagtctagatatgaaagtcttttgcatggagatggtgtagaaattatggcagtgtatgaaattgaggcagacagttttgagtttgaattgcagaattatgagaactgaacttagggttacacctggtctttgggggccaaaagcagaaagttaagaaaagtgagaaccatcagagaaatagaaagagaacagggtagtatgtcagcagctaagaggaatctcagatggtattgaatgttgacttgagagtattgagaaaagttcagcaggttttgtgtttgaatcatttgataagacctaagaactgtgctgttcaatatgaaagccgttggtcacatgtggcttataaacctaaaattaattaaaattaaaaacttatttcctcagttgcattaactacatttaaagtgctaattaccacatgtggcaagaggctatcatattggacagcactgataaataacttttctttttttttttttttgagacagggtctgtcacccaagtgaaagtgcttctaaaatgagattttaaaaaggtgagtcaatgtttggagaaccagtcagatgctgataatagaagggagaataaagatacttttgggtgacttctcagtaaattaggaggcaaaatcatct

SEQ ID NO: 124546 - DNA, 1107 bp, Homo sapiens
tgagtaaagaagtagcctaaaagatgacattttaaggttttcagtgtggataacaaggagaataggggtagcatttactgaaacagggacattagcagaagcaagactggaagatgaaatcattttttatttttaaactttgatttattaagcatatgctattgagtggcactgttattgagttattaggcactgttacggtactagagatacagcagtgaacataataggcaagatccctactttcatggcactttaccttcagaagtgaggtgaagaccaaattataaaaggacaaagtaatttaagacaaataagacaaaactaggtgatgatacagtgatatattgaggggagcttttagatgggatggtcaggaatggcatttctaaagaggagagatttgaactcagaccagaatattacaaaggaatcaactatgcaaagatctgggtgcaaaggcatccccacttagactggagagtatatgcaaagtccctaagaaggaaatgagcttgatttatttgagggccagaagagaggccagtatatcaggtgcagagtgagcaagggagagactaatagagatgagctctgagaagtcaatagaattaaacttaagtggggcctcggaggtcttgctctggagtttggtggcttactgatggcagtggaaataaagcagtatgttgaacttagctgtctgtgaaacatctagatgaagtcaattaacgggcttcaatatacaaactcaaatataatttgcctctgttattcattgaaataactttccaagttgtttaggcattgaacaaagaaatgctcacaatatggaggcttgaggagtgtgtcaaggacatggtcaggggaccagagggatcaggaatctctagcagttcttccccacccctcacccccagacttagctttgacttgaaactcatctagcagttctttaccaaaataaaggtcatcttaaatattattgcgacctttaaagtaatgactgttatataaatgttatgagaaaagtagtcagagaatcacggccaaaaatacctgtgtcttcaggggatgtaaagggtacttaccaacttaaaatacctg

SEQ ID NO: 124547 - DNA, 1794 bp, Homo sapiens
agtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaa

SEQ ID NO: 124548 - DNA, 1075 bp, Homo sapiens
tgaaaccccatctctactaaaaatacaaaaattagccgggcgtggtggcgtgcgcctgtagtcccagctactcgggaggctgaggcagaattgcttgaacccaggaggtggagtttgcagtgagctgagatcacgccactgcactccagcctcggcaacagagcgagtctcttgtctcaaaaaaaaggataatgcaattagaaaatgtcattgtgtttttcaatttttaatatagtttgcttcttgtacttctagaaatttcagccacatgaaaaagacaataataaagaaaaagggataaatcaccttgaaaattgacaaaagctgttggtgtagtaagttaggaaagctgaagcagtgctaaaagcaatactaatagggtgtggtttacaatgccattggtaatgacaacttgaaaatagaaaaatatacagtattgtttattttttaattaaaagttcagatgcttaatttcaggggtgcagagacttcaagtgtcacagcaaacttgaaatactttattcctttgtgaaactgaataatatattgctatatttactgcctgaacagtaatgtctgcttaatatacacacaaccaacttgtaattcggtagcaggacttttaaggcatgtattttccattcttttaagattggctgattagcataaaccttgggctctgttcctcttagtaacaggtggcaatgaaataatttatttttggatacctgagagtaatgtcaagcagaaatagtggaaggaaggaagagagaaaggaaaggaaaaggagcataaaggcctatttataatgcagtgggttgatctccctggttaatagctaagcaccgtgccaaaagagatcaacggagagtctgaggatttcaggctggattcctggttcagccacttagtaggcacacaaccgtgggcaagttattgaacttttaagcacttatttttttctacttcatagaataaaagagcaatgcttattaatgttaagcattatgaataatacataggtctgttaagatcaaacaagaaaactatattgagtaacacatagttgtgttta

SEQ ID NO: 124549 - DNA, 1033 bp, Homo sapiens
gaaagaatgtatagtggggggtcttccagtaactcattgaaggagagttgctctttttgtgggttttctttcccaaatatgaatagaaatgatcatgatatttttctcccagaagcagtgacatttataccctactatccagtttgtttttacatgagttctcataaaactgtgagtttctaagttttggcttttttttttttttcagtgactttgcagggttattgcttctctttgtctaaagcttagtttgaaagcaatggcagaaatatttctcaggatattgtgtctgtttctccaccttctctttcacacactcggtagataaaaatcaagttgtgaagatctgtatatgctggcttttgtatttggtatgtggagcacataaaaaccctttgtcctacttggcaagaagaaggttactcaagctgaatgctttattgtaatctcccaaatcctgtggatagcgcttaaagattaaataagttttcgtaggttatactatcatttttttttctgacttttagaaaaaaaatgatcatttacttgattttttttaagttgtatttttaatttgagaggatttcacatgaactgtaatgtttgtgttttcagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtatgaccaggatgtgttattactgagtaatatttatgctgtttaacagaaaaatatatttccttttgaagcactactaaatccatttctataagatgccagctggtgaaatttacagtttcatgacaccaagaatacactgctactgctttcaaaagcctacaatgggattggccgactcaca

SEQ ID NO: 124550 - DNA, 1721 bp, Homo sapiens
aagaagactcagtttgcagtgtgcatggggcagtgtgatacatgcacacaaaaggaatgagccatcacagagcctgggctaccctataacacactcccattcattgattctcccaaccatccccatttcccagagaggaaatcaagactctgatgtgaatttgctgaggtagacatttgattttaatcataattctgaactcattttagtaggactctgtagcctgtacttccccagggcaccatactttccacagtactgcatcacatcattttatatatgatgtgaatttatatacctgaattttataattataaataatgatatgtgcatttaatgaaaaatgtgtgtgtatataagtaccatgtataggccatatatactaagagtcagaccgatcctaccttcccaggactttgagctactcacagcaaagtctgttgtttaggatccacagaccctgagagctcaatacacagttacctactgagtgaaaggctggagaaagcgggcttttatcgtgcccatctacttcaataaggctggggcaagagggtagacattcaatttagggggaagttttgaacaaaggcaatgtgaatagcaataacaaaccctctaaacattagaatgtagaacttcaaaatgtaacaaaagaatttatgagcctgagtctctgaccagccataaacacagagtcaatcaagtgcttacaattttctaagtaacagtataatctcagatttatttttccctgattgctctttagtttccagggaccattaacccctctgttttaattctcccagtctcttgcaccgtaaatcctgtctgtatgtgcacttaaatgtacagaggaatgttatttttaaactatcatcgaatgtagctattttctacctagattttctgagtcagtttctgaaatgggatttgtctgtaactgtgtatgctacactgtggtcccctcactatcacttggagacaaagtgaatattctttaattcattcagtaatatgtacccaccacccagtacactacaacaaaccttagaagtataagctccatatgacctcgttattaaggaactcagagtctaaagaggacaaagtaagtgtgaatttccacacaatcatgtgtgtaacagtggttttctctttccttcttaaacctgcaatccaggttacttagaaagcctatgtccttaataaggatgctcgactgctttctgcgaattccaagtgcatttaaaacattcgacacagcatttttatttttatttttattttgtaccgggaggattttcaagttatctaatccttcatattgccagaaatggaaatcttgacccgatgaatatgggaaggaagaagttggactatttcaccaccagtatccattggcttggctttatttattcacatttgtatcatttcatgtttatatataagaataatgaaaatttaaatgtcacctggctcagggcgaccaaaataaaatggtacaggagagttaaactcattattattagtctatgatggataaagtagccagaataaaaatatgggcaaaatatgaataagaaaaccaaaacctagaatccacatatcccaactgaacattattccctaaaacaagtagttggtcttctctgtttgtgcttactaggaaattgaaagaaatttcagaagccacagttaatctgtccttaataaatcaa

SEQ ID NO: 124551 - DNA, 1018 bp, Homo sapiens
tgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtcata

SEQ ID NO: 124552 - DNA, 1028 bp, Homo sapiens
ggaggaacccaccctgtcagtgttttgcttacagccctcatgctctgaatggaacccatttctgtcgcgggtatgatggtgcacagttcagtagtaggttgcctgctctctgattttattcatcaaccaatttcttgcacatttaaaggaaattcagagggaactcataatatgaaggggaagcttttcatttttcatgttttttctcataatgctgtcagttgttttaaatgcatgtcttttttgtgggtctgtaacagtgtctttgtgctttttcttgctcttattttattaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatggtgaggcttcacggagggcgtcctgggagttggcaccaggctctggcagcagttgctgggctcccagaaccactttgctcctacagctgctgctgttgctttggcttctgtcaagaaaatatactctgggtattgtgtatccttttacttttccagaacccagagcaactattacatgatcagctctggtttgggaacagaaagagattccccagcaccatttttagcccctacatggtgccataatgctgcttactgttgaccaagctaagttctaagtatatagttgtgttggggatgagaggggctgaacaactagcccgttcccagcagagtaaagcaggggaagtgggat

SEQ ID NO: 124553 - DNA, 1217 bp, Homo sapiens
gctcaaagaagtatataattaaaggcggggaaacgcagtggggtagatacagattccccgccaagtgtggtgttacaaggggtcattgctatatcagagatggggggaagagacgtcagaggaaactggggacagactctagtcttgatgaggtgtggcgggcttgcagggggctggtctcgtgggtctccctttggcctgcagtttgttatttcctctttctttcaagtatactattaagagagttgggtttccatctttgcactatttcaaaagaaaaagtattagaaaatgccttttcttaaagagtcacattgcatctttccttctgctcacttgccacctagccatggttgttcacctctcacctcctgcacgagagaaattcctgggggtgaccttgaatgagctttccatcaggcccccatggtgtctgctcatggagcaagtctaggctctctggtggtgggcggtgggggctgagagaggccccagccttttcctacagagaagctcgctgttggtgaatgggaggcatgctcacccacttggaggagactccggctttgaaaggctgttggaaagggaagccaacacgtgggagggagccaggttttctcctcatatcttctttccatgtgttttggttctatgtgaaagcagacgtgtctggttgccagctttggcaggagaagctgaattccatgagcacttaccagtcacattagaagctgattgagactacacccaatttttaaaaattgtctgtcttgtaggtctgaattttgtaagctttagaaaatgtgtatatatgtaatatatacgtgtacgtatgcgggtttttttgagagagggtctcactctgtcacccggctggagtgcaatggtgtgatcttggctgcaacgcaggctggagtgcattggtgtgcagctcactgcagcctcgacctcccagggttgggtaatcctcccaccttagcctcccaagtagctgggactacaggtacatgccaccagacccagctaatttttgtattttttgcagagatgaggtctcactatgttgctcaggctggtcttgaactcctgagttcaagtgatctgcctgcctcggtctcccaaagtgctgggattacagggtgagccactgtacccggccagtgtttttttttttttgtggtaaaatacacataacatgaagtatatcatttcagctg

SEQ ID NO: 124554 - DNA, 1057 bp, Homo sapiens
agtagctgggattacaggctcccaccaccacgcctggctaatttgtgtgtgtgtgtgtgttttttttttttttttttttttttagtagtgatggggttttgccatattggccaggctggtctcaaactcccgacctcaggtgatctgcccgccttggcctccgaaagtgctggaattagaggcgtgagccactgtacctggcctgctttttgttactgtcacttgttttccctgttcgtgtccctaaatgcagatgttctctaagggtttgtcttcagtcttctcacttagtgaatcttgtctgttgtcctgctttgagctgttactgtattcttttgtggagcttgtcttctctctccagccccaggtggtttctgactaccagttggactggtcctggttgctaagggagatctgaaactcacttctccttcccttggttgtctttctggcttccccctttccccatcttgatttccatcttttgttcttggccttccctcccctcttccatctccttgactcccgtccaggagttgatgaaacttctgctgtgttcctggtgtccatccttcccttccctctgcagctgccgtagccctcgtagctcttacccgaatgctcatcccttcctactaggatctgttataggattgacctccggtcagctcctcccttagccctccatctgagcacagtcaggcggtggggagagcagagcctgttggatccaccttgaggagcatttgagcaaggcagaacatgtctaaagggccgagcacagagcctggcaggcaccgggcattaagaaacagaacagctgcttctgctgctatgatgactccttttgtagtcaggtgtgttctccccagggaggacagtgtgccaactgcttttcatacagatactgcatttaatccacagacctccctgggaagctgcagttttgcaagtgatgaaactgacgttcaggaaggtgtaatgacttgcccaaggccccacatctgggaagtaccaagctgggatgttccaaatccagggccaccacttctcagcc

SEQ ID NO: 124555 - DNA, 1027 bp, Homo sapiens
gtcagttgcaccttgttggaaaacactgagaacagacttgtccaatttgataatcttttagactccagagaaatcttaacattggcttcacatgttctatctgctgacctccctggaggaggaaattacttcacacttcccaagtgatttggttcacttcactcccaggatctctgccaaaattccagttcattaggtactcatctgctgaatagctcttctaagacctgtgtaaatacatatctaaaatgacttcccatttatttcttctcttttaaacataacattgactaccctgtggggctttttattgtggtaagatatacataataaaaggtactatttttaacctttcagtgttactaagtatagtcacaatgttgtgccgccatcactgatctctcatgagctttttcatcattttaaactgaaactctctacctactaaacaattacccctatgacctcttcctccagcccctggttacttctgttttagtttctgtctctgaggatatgactatcctaggtatctcatatgagtggaatcatatggtatttgtccttttgtcactggctcatttcacttaacattgttattaaagtttatccatgttatagtatgtatcagaattttttttcaattatttctcttttgagacagggtctcactctgttgcccaggctggagtgcagtggtgctatcgtggctcactgcgccttgacctcctgggctcaagtgatcctcccactgcaacctcttgagtagctgggactataggtatgtactaccctgcttggctaatttttctttttaaaatttctggtagagatggagtctctgtgttgcccaggttggtcttgaactcctgggctcaagcaatcctcctgtcttggcctcccaaagtgctgggattagaggcataagacactgtgcctgacgtcatttcttttaaagtctgaataatactcttatgtgtacataccatctttatttactcatctatttatgttgtcggttgtttcc

SEQ ID NO: 124556 - DNA, 1110 bp, Homo sapiens
ttatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagacta

SEQ ID NO: 124557 - DNA, 1028 bp, Homo sapiens
ggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatt

SEQ ID NO: 124558 - DNA, 3128 bp, Homo sapiens
tcaaacaggtgggatggtataaactttaacacctagtgtgtttacttgctaaaaccaggaagccttgtttctattaaacctaagaattataagccacccatgtcatacaggtcttaaattatttcctcataaaatacatttgttatagaggagaaaaaagggggtttcaccaagagaaaaaaatgctataagaaaatgctcagcctcctgcatttcccttccctctgctcaaactgagctccagcagctcaccctgcctgtcccatgcataatctacaaagcaacaggatatgatgtcttcaccactcacctttccattgttttactgtagtgcagtttggccagtgttccccagcctcaaatggtttgcttgtgtgtgtgtgtgtttgactgtggtgcacgggcttgcctcgtggttcatgctgcttcatcctggttccttatcagcacggacgctagcagggtgtggatgtgttcacagtgcactaaagcctcctttggcccctcgattccttgactgccctagatatgtgagtggaaaagccccttgtcttgtccttctctgggtagactttagtccatacacatactttctgaagctatttcgtctgttaaccacatcttagagtctgttctgttgtatctgttcattcagttgctccattaaatttttttttccaaaaaatgagaataccaaagaattgtacaaaatctaaacaacagaaaaagagtgattgcattcatatgctaaatacattatcagcgattttcaacgcttctagactgagatataggacccagtgctggccatttaaacaggtaactgctgtgaaaggctacctaaaagggctcaggaaccatctgtcctgggtccgaatcctggctgtgacagttaacttgctgcgtgactgtgctcagtttccccatctgtggaatgagataataacgtaatttctaaataatatacaatgttaggtaataaatgctataagtatcctgccagtctgattgcctgacctgaggaatccattctgagctgaaaaagcatttctactgtaggacaaggacacctcttatgggattctgactaatgagaacccacctagtacatttactcagccttagtgtggggttttgttggtatgtagatacagcattactgctctcctgagattgtcttttttccccctctaaacaacaggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctg

SEQ ID NO: 124559 - DNA, 1029 bp, Homo sapiens
ctctcaaatatgccaagactgccaactaaccatagggctggaaatgaaggaggtctaaatgatatgacttctattagggtcaatcatcatacccttaattctttgagaaagtttaagggaatagcatggcataaataatattttaaattcctaaagagaaattatattttataaaagaatgaagaaatgggtgcagttcagcatgcacacagcactcacatagcgcacacgcaagcccgtcaggcaggcacgggctcttcatttcctcagagggcaggctccacacctgggactagtgagctcctggtccacagcatgcctcatgctgacccctccttacacagagtagacaggataaaactgtgtccaggacaaaaagcagttttatgtcatatatagcattgtgttacacttggatgctggagaatgagactgacctttctaggagaaacactattttcaaggaatatttcttagtaaaggactgggtttctctaaaggtaaaacaggatcatctttcacgataatgaaccaatagaacctaagtgaattaacttgtgaaaagtcaattcctcatgatggatattaacttaagccagctaacagataattcagtgtattatctttatctgactgatgcaggccagtacactgagtcagaccccatgaaaatccagaagccctcatcaggtctaatgagatttctgttctttatgctacattccttgctgcctcagctactggaaatgttttcatctcaaactgtttcataaaaagaaacaaatggtttcttttcttctctttatccctcgatgttaagagcatcatcttttaccctgtctaccccctccccctttagaaagcctaaagatgaagaccagaactcaggtttcaatgccacacccactacccagccttacatcagtttgagccttgcacaagctacgcaaatggcatatgatagaaatcaatgtgacgccagagcttaaaatgagaaaactgacctgggaaaagtggtaaaatctgggg

SEQ ID NO: 124560 - DNA, 1012 bp, Homo sapiens
acacataatggaataattaagttatagactagctttagtttatattaagcagattgaagtcaaacatttcattatgagtgcaaaatatatactttcagtaaggtcacactgtttttacacacacacatatacacacacacataaattatgcacttttacatcaaataacacataaatccaatttcaaattgcctctccaagtgcatggaatgatccataatgtttaggaaaaatgaataagttgcattgtacctagacctcttcagccctgactcatgatccattcctaatgatacatacatctttttgtttttaattttcagatgtaacatttattcatgaaggaaataaaacttttttggataatcttgtcaattttgaaaagctggtacgtaaatttcattacttctcccttttttacagtaacagaaatgtatgcctttctttcctgctctaggaaataaatagttttagtacttttctccattggatgcatggcgaattcaaggagcttatttgcttcattcaaggagcttatttgctgcatgttgtacgctgccaacaaaatgtattccaattaacaacaagtatgttagcaaggtttttgtgaaccaaatatgaaaatctgcgttttgtttttaaaaatggaatatgataagatgaagaactgagggtatattattgaaccagagctaaaactgtaaggctgctgtcaggaggaatccacactcaggagattatgttttactgctttataggcatctctcagtgtctcagcctgcatgctttcaaggcacagagggaaaaagttcctctcctggggatatatgtttgtctctcaggactccaagcttaaatgtgaggctggaatttgcagggtcttgtgtgaagggaagggccactcctttatcagcctatggacaaagggtgccatccctgagcaccacggccagagcggctcaggcaaagtaccctccctccttacaagcaagaggttcccagggcaatcctc

SEQ ID NO: 124561 - DNA, 1081 bp, Homo sapiens
agtttcttcatagccttacctcctagaatttaccttatgagttaatgcagctaaagctctttagagccatgtctaacactgttaataaatgtaagatgtcattattgccactgccctcctcatcatccctaggaagaggggtgaggggcaggtgagggataaacctgtaatgcaggggaaatggactaagccactctgagaagctgtgtggaatctggaattcttggagagttagtagaggccagaccttcaggtggtatttaatgtagacagagtgtgcacaggtttgcatttgctacacagaaaaggtaaaacctgtgttgacttctcttttctgaataccgtgtcacggaatgaaagcttgtaattattttctgcaagcaaaatttcaaaagataataaaataaccagagagtttgtcaggagactgtgtaattagttgtgaatcgttttcctactaggacatcagtttacaagcaaaaaaaaaaaaagagaggaaaggaaaagaagcttatgaaaacatttcagtccacattggaagctgtgtataacgccttgaggaaagggttgcatcagtgtgtgctgtaactgtgtaactattgtcacctcctggtgacagtaaaagctttgtggcccagagttttggtggcaagttttaggaccacctatctcataattaccccatagggaccagcagaataaaaatcttgattaaaagcaaatacattctttttctatttataggagtttttaagacattcttttcccctcttttctatcaggttatttttacaagatttttaaaggctgtttttatttggttggttctccatatatgtaatataacatgattatttgcacatgctttaaattatagtatatttatttttgtgatacttgtctgcgaggattccctgatgctgtcatccaccctctgatccgattatggctaagtcatccactctcagagcttcagttgctacctttatttaatgtaactaatttccaaatctatatgtcttgaggaggcactcttttgtttactgcagccaacaggagatatttaatgaatatcctcact

SEQ ID NO: 124562 - DNA, 1080 bp, Homo sapiens
aagtaatatagctttcgaaaagtgttgatggagaagtgtacttcctttcttcaggagtggaattgagttgggaaaatatttgatagctgcaagttactccactgaccactccccactaagcaccaaataattcatcatgaaacatgttagttaaatttattgatgagatttcagtgatctctctttcaaaccaaggggattaataaaaggaaactctttttaatctggtgtataccgctgacattcagtgtaaatctttacctgtatgcttccagggaaagggggtttgggcattatccttggccgtattttgattccttcaagaggtttagtaggaatactctttcatccagcctcttttcttcagaggcttgtaacttctgctaagccaggccccagtggctggacccatacacatgattctagaaatgagctgtgtgggaactggattgctggttggcctggccatcctcattccccacttcctcccattgccaccacgcccctcgtctacccaataaagctggcattttctcttcagcttctctcaagaacagccagagcttggaaaattattgtgagttgccgtacatcgtgcagctactcactgagtcttccttcatcaaatatgaagcaagaatctctgtgaaacaggaatataatattaggacaatggagatagatatgcacagatgcgtcatccaagccgaaaatattctgttaaatacaaatgcgtgaaataaagagacactgtggtgcccaaataataatttaaaagtttatttgactcttcatatttatttgcttttaagagaaggtctgtgctttttatttgtggaataaaatatcttcaattagagggtgggaggtggcaggtgggaagtaacacttgggatcatttagacacaaataaagacaatagaaagtaggactgatgtaggaaaggaattgattgcaggaagaaaaaattttgaaacaacacatactttaaggtaatgagaaattagttgacaatatttctttaacttaattagatatgaacagagccttctgccatatattagtggtttcccccccaaa

SEQ ID NO: 124563 - DNA, 1050 bp, Homo sapiens
cttgctaaacgtatttcctgtaaacgccatgtctgtctttattgaagtgcaccatgacatttcttctgtttgtttttatgctaaccctgccggcacattaattcttaccagaagccaaagtgatttcggggctttcactttcattatgctgtctgccagggcagtgttttataatcagatttgtgcgtgcatgtgtgcacgtgggggtaggggagagagatgggggaggagcgggcgaactcactgaagtatcattgatcacattctactgttcccaagaccgtttcctaaattggctgtaactcactgaaggtgaacagaccagggaaaatattaagtgcactcagaaaagattactttgctaatctgagcttctagtgcctttctacagccagccaatgcagtgcaaaacatttgggaattactgaggatctttttgcttctgttggtttagaacccatttgcagaaaatgaggaatcacagcaaaggtcgatgaggattttgggaatgaacacttgggatcttgctctggaattaatgaattttgattggagtctattcaattcaattcacgaggtaaatgaggagtgacaagataaaatacaaatgctgttttaactgtgaattctttgtgaagaatatcaatgcgtgcggtgatgaaattatgctagaataacgtggtccaaaagatatttggggacttgaaatatattgaaagactgactcaattctaaaaaaatcagaatatgtgagcatgcttttatttgcccctagtgtgagcatatgcttgtgtaatgtataaatatgctgtatttcatgcatataaatatatatatgtatttggagatgaggctctaatggggttgatgaaccattttatctttgatattgataggtttattttttccatgaagcttatgatagttgtacaagaatcatattcatatttatgtatgtacacacatatccatctttttacttaagaacattctacaaatttagactgcattgtaagacttcaagtaatttattgaaaattttggatatat

SEQ ID NO: 124564 - DNA, 1117 bp, Homo sapiens
aggctgaggttggagaatcacttgaacccaggaggaggcagaggttgcggtgagccgagatcacactagtgcactctagcctgggtgacagagtgcaactctgtctcaaaaaaaaaaaaaaaaaaaaagtaatgatcagtgttggtcagtgtgcaagttttatacctattttttaggaaaatatattgtctttcttttttaaaaaataaaaatcagaaaacaatttggtagtttgtatcaaaaactttaaaaatattcattccctttgacctagtaattctaatactgggtgtctgtcttaagaaaatcatttataagcagacaaagatttaaacataaggatattgacttcagcaatatatattgtggcagctataataatagatcccatttaccaaaccccagttatgtgccaggccccgtgccagtacttagcacacatcatgccatctaatttatatgaccaaaaaaattaaccattaaatgttcaacagtagaggaaagattaaatgatggtataatgaactatcatataaccaattaaacatgacatatgtaaataattttggcaagtggataaagtgcttataagaatatgagaatataaaactatggaataattgcaaatgtatatgtgtatccgcaatagttataaatgcatatgcataaatcattgcaaatcaatgcaattatttgtgtgtgtatatatatacatggttatataaaaatcagaacaaaaatagacctaagtgtaaccagtgttaacatggtattgttatcttagatgagtaaattttactttttgtcttaaactgttctgtgttccaaacaatgactaaatgttataggaaataactgcaagaggactccactttctgaccgctgagcagtgagagctatttgtgatgccactggtatcattgtatagagtgtgcagaacttaattaatccactttaagttctatttacttttaagtatttttctttggcaagtttcactttttaagtgtactgtgtaggcctactgctgctactcttgtatttctgattattccttttttttttttttttttcaaataaagaaaagcatgaacttcagccaaatgacttagtcatc

SEQ ID NO: 124565 - DNA, 2007 bp, Homo sapiens
aaatggagtgtaaaggaaaaatttatgaattagacactttaatatgcagctttgggagatctcagcaactgtcaaagaagggatttaaaaatacagtctgtgtaccacagtttccactgtattatggtcagatggtttctacagtgagtacacacttgcgtgactcgggtctctcattacataatgaaaagattaaatactacttgtgcttgttggctggctttacaacatctgagtttcatgtgtttgcaagcacacatttatagacgtataccctcaggtgctcatgtacatatataaaaaatctaactctgtatgtgttatactgaagagaatagccaggtgggttgatttagaaaagttgatcaaggtgccttgatttggaaaagtctatacctcgtgaccactgttctctgtttccaaacaattcttttcacttgtgcagttttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctgggggtaagttgttttctacccttgaatattaatctttcactgatctccttcaaaaggagggaggtgacatttttgtagagtaaaagtgcagctcctcccttctgggcccgcagctggatgaccacagtaacaataagaagctgcctaccagaagtgtttccatgacaacagttgggtactgtgggatactgaatttcctccccaagaactgaatagagaggcatgccagtgttttgaaatacattataaagcttttcatattttgtactctagataagccttctattttcctatttaaattaacttgggaaattgctaaagagtgaaattactttggggtggaaaaaaaaaaggaaagatggccttgaaccagtcctattgcgggctgacaatttaatagttaaagactccctattgaaagacaaactgtacaataagctgaaagctcacacggcaatattcctttaggtggacgtggggagtgaggcctggttacaacttctccttctgttgggccttatgtatcctcagagaatggtttattgtctgttttgaataagatcacacagattacaagctgacactattgatctatgcggcttgaacagacctcttcgttttcactggagcctgtcagatctcaatgttgctggcctccttttttggtttgcaatctttatttaatatctccttaaccctgagaaaaaaatacaaagaaagtgacttagcatcagtagttgaaaaatgtgagcactgtgggggctaattaaccagagatgcgggcaggggaggggagcagattaaccgcattcctgtttaccctttgttatcattctgcagttgggagatgaatatcagaatatacttgagggtaaagtatcttgttcctatggctttgttgctcacaggcaggtaaaatggtcctacaagctggttgattacgtatgcaaatgaagcccttctccctgggcctaatacataagaatccctccacctctcccagggctctaattgtatatcttagcaaaacatgatctagaaaaaagaatttgagaaacatatggcctaaatgacttttaatcagagagtggttcgatttttaataatatatttcaaattggtatgataaatgtatgttatgtttaattttcaagtgaccaaaaatataaaaggattttaaacagtattaagctttatcaatactgcttaattaagcagtattaagcttaagcatccacctctcaaggtagtaccactacagagagtgatcctggggtccccattcagacagaaggtgccagagaaggaagagctgaatgaactctgcagcaaaactgagacccgtctcctttgggagctgactgagagtcaacccagggcctcgtgagaagctggcaattaatgagcggctcttt

SEQ ID NO: 124566 - DNA, 1051 bp, Homo sapiens
ggggatcattcatataaccatcatggttctaaaaatatctctaaataccaatgggacagcctcttttttggaagcatggctgttataaattgcacttttatttgaagtgcatcactttgattatagtattttcattcataccactcaattactttcagaatctgcacagcagaaaaaaaaaaaaacatgaatgctggaaaagaataaaggaaagctctttgtatagaaaaatttagaacaatatagtagttaaatagagagatatttgagttatgagtattgggaatctgttctattcattagaatttttaactattttctttattaggacttcaactggagctgtttttatatagcctcattgtttttattttaattaatatttctatgacagataattaggtaaatgctgttgaattttaaatatgatattggcttaggagaaaataagcatttctgggtcaaagcccttaacaaaatattgtcatatgtgagctgattaattgaattgaatgccaaatgggtttgccaccatccaaccagactctggtagtcagttcattatctaaggttgttctggaatggaatgactggttatgtcaaagttaatggtttaatggtgttctttttaatctcagctactaatgaagtaaatcttgatgagagaatagttctaacctcattaaatgcagctaagtgtaagaacaccccaaagagtctgaacctctgtgtcacatccagcattttaaatgccaactccctctcagtgctgtcacccaatggtttctgcgcactggtggctcctatctacaagagccattgaaaaccctaaactagattcaaagctactctgttggccaggctcagtggctcacgcccgtaatcccagcactttgggaggccaaggctggcagatcacctgaggccaagagtttgagaccagcccagccaatatggtgaaaccccatctctactcaaactacaaaaattagctggacatggtggtgcatgccagtagtcccagctacttgggaggctgaggcacaagaat

SEQ ID NO: 124567 - DNA, 1152 bp, Homo sapiens
accattcaccaaggggcatctctctaaggtcatcaaaccagggactgtccacataacaaatccagtgctctttgagtcctgagcccgataaagcctcttcaagcagcatttaacactcatttccaatccttttctttcttgttggttattacatttgtgtcccgtttgtttgtttacagaaaggaggctattgactgtacattcgtttctctttattctgtttctctcctccttctctttccccttccttaactcatctttcccttaccatcgcccaaacatgaatatcccactcccttagactgctgcttatttttctgagaaatcatgttggccatagccatcctctttaggtactggctcccacaatcataactgtaaccctctttggcaagctctggtttttgatattttttcctaatagctttccttagagtaacctggggaacccaagctcagcaagtttaaaagcaaactcacctccctccccttatccttcccttatccagtctgagttccctgatgaagcaagcttaactcatatctctcttgtcacttctggtcttgaaaatctcccttcacttcccttttcctgtggaataagccccaggctccttagtttagcattcaaagatccttcaggaatttcctccaacctatttctttagctttacttttcaattatactatgtgatctcttctattactactacacaactgtgctgtagaccaagacttaccaacttgcatgtccacaggcagtaaaagtgagtgagtgaagactgccagagcagaagggtgatgaactggagagtgcctcctgcataaagtaggcaagttggctctaaacatggttgccataggagatgtggccctggtgttgccagatcttctgacttttaaattttgtcaactcacagaaagcatctctagggactaaacaagacctgcaagtcacaagaccacaggtttgtgactcagccacagacccacccacatccgttgctttgctcacatttgcttctccttttcctcctccaattcttcttggaaattcatagttctcaagtttttgttggcggattggtagcacttggagaattgggacaaggttgaaataattttattttataaaaataaataataggtagt

SEQ ID NO: 124568 - DNA, 1028 bp, Homo sapiens
acagaaaataattttcagaacaattctgtagccttttctgcttcagacttggacttggcgttcttgtctggcatttaggatatttggtgaatcttctgactttgaaatattttaatcctttaaatgagcttcatttagtgggaacatgaaaagtacaatttaaaattctccattgcatacctggctggatattgctacctaaattctcagtctaaaaacaaatatggttttagatgaatgagtatatgtaagcttctgctatttttttcttattatatccctttcaatattcttcacctgttatgaagaagaatttatgtagtactgacagcaagtaagctttttccccctaagttttctttgagtcttgcttgatatcacatattttcttttgtgtagcagcttacagattttaaatttactgtcatgtcgtatgttttgttaagaaaaaaagagagagcagagtgatcttttcatcctaattttggttctaattctcagagttggatatataaaatgtgacctttgatgtcttggttcagtttgatctgtatttgaaggcattgccagccattttcatttactgatggcttctgtagaacaattttagttaacccaagttctgccaatgctgattggcatagtgtgcatatctcagaattattatgacaatttgcactgtttgatagtctcccagggaaggtgtttgttcttccaaacaaaccaacaaacaaacatccaaggcactgtgtcttcgtcagcacattctagaaatccacagtagtgagatcaggatgaattaatattgttaagtattcttaacactccttgaatgtacctttcctacttttgataattgagaaaattgagaaccatatcatattgcagatcgtgtacttgagcttctggaaattttcagtgtacatgtgttatttgtgagtaggcacagctgcatataacagaaaagctctaatgatgatttaaacatggtataaatgtatttctctctcatgtgaaaataagtatgg

SEQ ID NO: 124569 - DNA, 1155 bp, Homo sapiens
tcaactgatagagtccagaagctcttgatggtcaacctagtgacttttttttttttttttttttgagacggagtctcactctgtcaccaggctggagtgcagtggcgcgatctcggctcactgcaacctccacctcccaagttcaagcgattctcctgccttagcctcccaagtagctgggactacggatgcgcaccaccatgcccagctaattttttgtattttcagtagagacagggtttcaccatgttggccaggatggtctcaatctcttgacctcgtgatccacccaccttggcctcccaaagtgctgggattacagatgtgagccactgcgcccggctgtgatgttttttaagcattgcactgataaaacattaagtaaagtgagggcaggcacctcattttctattaactttttaatcttgtctcctgccaacaccaagctcatgataatcccttgatatttaattatgtaattttcatggaggaaaattaagaatatctttcttcttccccttggaaagatagaagacaacgtaagtgaacttcttccttgcttaccttgccttttagcattcctggaatgatcctgggtgcctttcttccaggctttttctcccaggttgccagaccataataaccccgtagcagcatggcttttgctgtactaaaaatgtttgagggtaggtaaatatttagatggcggtaagtcttttcatgattttgtacaattgatatgcacatgacattatcttgtatttatatctttttatttctgtaaggtcatgtaataaacagaccagtgtagcttatctgtagctgcacattagcagcacctgtgatgcttttaacaaaacagcaatgtccagagatcctaattcagttgggctgagttggggcctaggccttaaggtctttaaaagttccccaggtgatgcaatccgcagccaagttgaaagacactgaaatagaacattgtcttacttccatattttgaaagaccaattctaggtttctattggttatagatatacagagagttaggaacaacgttccccctttacaacccctctgacaggactgtatgtccagcctcatgtccgctggcccctgtcctggagttctgcagcttgagaagttcataactgacaa

SEQ ID NO: 124570 - DNA, 1554 bp, Homo sapiens
attgctgtttagaatgacaaatatttttcgtttttaagaaaatcctggaggacttaaattattagcttattgcattttcttaggaatcagaataccaggaggtaaagtcacaattgttatcagtgatttggctggcaattagggcaagattagtgccttcctcttcttatgaaaggtgaatcaaatacattgacatccctgattagcctgtagaaccaattaataaggcacaatggatatttttttctctgttgggggtggggatatcctctttcatgtttgtacctgaccgtaggtaggtaggattttctgtaagtaggggaaacgtgctaggagccctaagcacatagtgccttttttaaagaggtgacatcatctttaaggtgaaacctacttactgtcaacttttcttcctttaatcttttgctccaatcctcagaaatagggaagctagattttcggacatgcatcttatagttcctttctcccgggctaccgtacgcttactgggtattgcacatcaggagaatttcacactaaacactctggaagtgttcatggctccgagttggaggccaccctgctgggtcagcagcaagctgtcctctgtgacagagccacgtcagcgggccacactcactctgggctgtggaagctgtgtgtgcagaaatgaatctgtgtgttcagccatctctcctttttaaaaagggactgaggtgaagaaagtctgtgcagtcatccatggcatccgaatttcagcctagatgagattctaactagagatccatttttgcttatattctggcaaaactagtacattataaatttgaaggccatctcaagtctgaaaaaaaaattgaattgaatgatggagtgggtagttttttttttcttgccgccttttaaagtaagggtgtaaagtaaatgaatatatgtattgattgcaactactgaatagggcttactcattgtcttaatgtttcaataatgtatattttgtatgattcaactttaatagagtgtttaataaacatctaccaggtaaaagagaatatagtatacatgcaattagtatgttgtgctttttgaaactttgaactttgtagtccctaaattgtttaggtagttttaaaaataaactctgaattccacctccactttgttttctatttcctttaaagtatttatgtctgtctaatgttttaagttttcatagcacttgagcctggatactttaatattagagggagatttttgaccagactcctaatttattctcaatctttgaagagatgatactgtaaagcaactctagaaaatacagcttgagttagctccattttccccccacttttaattttctctctctttttccttctctcatccatcatccctgtccacaattaaagcaagatgatgaagtgacgactgttcaggttaaagagcaagaccagagcgtcctggtgctgaagaaagtgcagtgctgtggcccagcccccacagctgggagtgcggagagccattggaggtgagagtttccctgcagccacagag

SEQ ID NO: 124571 - DNA, 1035 bp, Homo sapiens
taacaatctcatccattaccaaagcttaaataattcataaatttgtctctacccttgacctttgtccagaggcctagttctttatttctaactgcttgctaaacgtctgtggcaggcaggctgtcttagtacgaaacatcagcgtttaaaatcagaagcatctgtctcaccaaagccgctccttcatacacattctcccctgtttaatggtatttccattctcacagtcacccatagttatctttgattgtcagatcccatggattctacttttgcattgtctcttgcatttggccacatcttagggtgctgacccagttatacttatgttgtcatggagcctattaacttgtcagttaagagcagggtacttgcctcactcattttcacttgccgcttggtgtccagaacagtgccttacgcaaagggagcaagccctcactatttgttgaatgaatgtcaattaagtgttttaatactttacctgcatttcatgaactatttgtcattgaatatattttctgttattaattctcttaatacttttaatcttaaccaatcaagcacaagaataaaatttcatacccagaacctcaactatggtacttctgttccttctcaggatgagaaattagttaagcatgcaggggtcaggaaacattaatttacctttccttcttgagagccagatgtaattcgtaggattattacatttttatggcaattttagataacatatttccctttgtacattaatttttctgctttttctcttctttatttttaataggtcttcaaaatggaaaactatcacaatgacatagatgctattgatagtacatcaatatgattcagctcttcccctgcctggcagagtgtggctgctgtgtgcacagccatgtaatacatattagttacacaggcattagagaagcccttcccatccatatgtatgtgcatggcctgtggaagttaataatgccatatatcacatgcacatagaatgtaaaacgtacttcagaatgacagcaagct

SEQ ID NO: 124572 - DNA, 1050 bp, Homo sapiens
cctgaactcttctttctcggaccttccagctacctgaactgtacctctcaggacatatttctcagagccctttgtggctccctggggcagattcatgtgtcccctggccaacaaatctgtgtccacagactcatctctgctcagttcctttttttttttttttttttttttttttcaattttaaggtaaaacttacataacataaaattagccattttaaagtctataattcatgtctacccagttcttgagcccatcaggcccgaggcagcttatatactgggagccccatctccaccagccttaacctgcatgtctctgtgttccaagttgcatagacataggtgcccacaaatacagccttcctctaaagccggtccctgccgtgtttagctctcttcctgccttggtcactgattcgggtctggttggcacttcattttccccttgctgggtcttgagtgctgcctgatctgagctggttgagctgtggtcataccactgcattcagctcctgtcaactctcttcctctcttagaatgaaagcccttgtatggctttcccaaaccagacaggccatccagaactaaaaaccggctatgctagaacttttgactctcactttggcctagacctccctgttgcctgaccaaccaacagattgccctgcactgtcagtcagcacgagggaaagtgacatctcctttgatagctgtcatctagaatatagagcattggccatcttaggggacatctgtggttctggttaagggcactggtgtcgagcctgtctgggttcaatctcagcttcgccatctgtctgctctgtgatctttcttatttaatctctgggctcctgtctccatttgtaaaatgggaattttcatagcattagtctcataggatcattatagtgattaggtaaagtagtggatcttcagcccttagctttgcctgctgtatggtaagccctcagtaagtgttagttgtcataggtttatctgcctggttgtggctgattcctccccagttgcccattcctggtggttc

SEQ ID NO: 124573 - DNA, 1108 bp, Homo sapiens
tcttggtaagatgtgtacattgttaaacaaattagatttatctagtcattggtgattgaactgttgttggggtggcaggggactgtgctgggcctttatcatcttttttagtgcctaaaagtcccagaagatgcataatacccttatttcttagataatgctttggaatttggggagtgtatttttattctcccagcaaaacagctattggatggctgccaggatttggctgtagataaggcaagccctgtaacccatgtcctctcagtataggttgaggccttgtctgcagctgtgaactcagccattctttgaggacaggcctcttcctgggtgaaaactggctccaaagaccctggagtcagaatcaagctccatttctgcgtcagagtgctatgcccattactcagacttagcctagatctgactttaagctttggttcccagctacagtggactagattttgtccttttgttctgcagacttcaagcttgaattttccttttctacccaagcctacccctcggacttagttcctctgagactgaacctctgcctctttgcctttgctgacctctctgtccttgaccttgagccattctgatttacagtgtctgtccacttatccatcatttgccaggccatgcattcatttaacagacattgttctggatgtaaaaccaaaccaaaccagccactgttctcatgcagctgtcatcagagtggaactgaccctgccatttctcctccctcttctaccctccatcccactcccaaacctggtcatcagccaagaacttttatattggaactagaagcctgctggaaaatatttaataaaatttaagcttttatgataaacagtaacacctgtgtgattgactagccactctcaaaggtcacatgggaagtgcagagtgtgaagcaagctgtagaagctaaattacagtaaactgatataggcactagacaagaaagactgttaagaccataaagcatgtagaaattggattcggtcaagtaggaaaatgctaacacaccctaccctaaagcttttagattttttctttgagttgttttctggacagcaggaagaagaaatacatg

SEQ ID NO: 124574 - DNA, 1052 bp, Homo sapiens
agtgagtcagagtaaaggattaggggcacctcaagatccaagaaacacataatagtagagaataatggtgataatgagacaattaagatgtcagaaagtggcttggaggtatggattcacaagaaggctcaaaaaacttaatgagtcataaagcatatctgggtgacctcagaggtgcgagtcggggtggaatgtgtcaaggtaaaatttttgccctccaccatcaaagagaggagacagtggtacttcctacagatagttcttaaaacctttcatgatcttgccttggctaggatttagagaagtagaacaagctttatgttgacacccctgtgaataaagaattctaacattccccaaatggcacaatgcataataaaaatcccaaagtgagttttatgattgctggatgctatcactttctccctgctcagtcaacttattgttattacaaattgggggtttgtgatgatgcattatttttcaccatcagtctgagtagtctggagttttcctctgagagtcataggcattagaaagaactttagatatcatgtgtcttgatggcttggggaaggaaaactttatttctaaaactggcacctgctaaataggattataagcagtttcctctaaaaaggggaaaatatattctaagaccattagttcttttggaagtgcattagtcacaagaaaatgttaaaacatttccattgataatatcttctagcaaaagtaaataccttttagcctctgtaatcagaagcaattttgttaatagtttgttaacaaaaagtgtaattctttagtttgttagagaacttcttaattcaggctttgtgcttttatctctttgtgttcctgaagttagattttgtgaggccctaaagtgaggctgggctgatcgacgtgacccttgccctaagacaacacttctttagaactactcctcccctacctattagcagttagcccctcaaaaattagtgactcatgaaagtgggcacaaacaatttggccagcaaaaaataaatgggatcactcagttcttc

SEQ ID NO: 124575 - DNA, 1036 bp, Homo sapiens
cctgtgggtttatccaaacattgtgtgctaagagcaataggaagcttttgtgtagaatttaagcaagaaggaaggaaaaatgattagatttaaatttttaacattcctccgttgcaatgtgggaacagatttgaaggaggagaatgggtcacactcactccttcaaagcttcctggtcccacttccctcacagtcctctctgtcgatttcacattaagtagtaaccagcatacatgcaaaaggatttgctgtgggcagctcaagtcaggggacttcagttccaggaagacagaatgtccagtgatagttcacttctaatttattaccttttccctaaaatatactgctatatcaccatttttctttaacaagttggcttggagtcagtcctgtttttgtagaaatgaattttgtgcatgcatataatgtgaatatcttttgttaataaacaccatgcaggcagatatgttcgctttaaatacaacttactgtgctgtatatttgcctcatattgattcagccaaagtttggtgatttctgagtcattcatatactttggttgctaaagatgaggaaaagaaatttataaaagatgtccatgtaggatgcaaagaacctttttttccttttgcagtgggaagtgggtggaaaggaaaaattccatctggcatccagcagtcctaaatgttgttttaagatagcaaaaatagaagattgctgaaaatatcataacagaacataacagactgtgggcaagtgtacagtacattttttctaataaatcatgctaaatatgcgtattttacttataacatgaccaagttcttgtttgctgttacataaaaatttgtctttattttttgtattaaaattatctgctctctttttgaagcaaaaaggatgattgttttggtctgaagagatcagtgttgcagtacttaggtttaactggaataggtttttgaattttgcagttttcccctctttttccagcatttccctcctacatttaaaaaaaaatggagaaataagatgt

SEQ ID NO: 124576 - DNA, 1056 bp, Homo sapiens
gggcagaagtagtttgacctggaccttaaattaggttttgggttggatttaaagaatccacattgaagaagagtattcctagtgggaagaatagcattagaaaatgcacagagataccaaaatattagatgttttttggaactctgaaacgatttcatgtttccagaataccaagaattgggggtgtgggaggggaggcaggagaaggaagatttcatgagaaatgagattgggaccagactgtggaggattttgagggctgagaagttttacttcattctagaaataatgaggaacgactcagcatttgtttgcctgcagtttgcttcaggtagctgagatgttagtatttatctcactgacagattgttaggtggggttctaacttttcctaaggaagatggttgaggcagggccttcatgagataaattatattatttcaatctgactgaacagtgactgaatagtgagggagctgaagagtgattaagcagacttggggccagagtgaattcaagtctgattgcctctggagggtgtcttccttcagccttcatcactggagtgaggactgataggtggcccagaagccaaggtaaccggaaccacagcagtccttcgaaagagggcatgcactcagagggcagctctggaggacagagacagaaagaatacgtagggagggatgggggttggggggcgggaatgcagaaaaagaaaaggtgcttgcccagtcgtaacttagatttgaaaagcttataaacttttcatattttattttcagtaaaatagttacatcaaagtatatgactagatggatgtgggtcctatttccaggaatatagctgcactattcaccagaaaactgaacctgtattttcccgaaatgtagtttatgctttgtagtgtattaaattgtagattagaaataccaacaatagctcctaacctgacttcctgacttccaactgtagaaatgagcagtatctgtaaaatgtatgtgaaaacttggttcagcaatactttccctagggatcctgtctgtatccctccct

SEQ ID NO: 124577 - DNA, 4074 bp, Homo sapiens
ttagtttgctctgtccttcaccctcttaaagtagggtgatacgcagactcaactttaagtcttttggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacgaaagactattttattttaaattctttaggttttgggggtttttttccccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgaaaacacaaaaagagattatagatgctctcaccaagtgggagggtcagaagggagttttcccagtatcttatgaaggcttgtgttccaacaagagttatattgtttgaatatagttaaagctggaggaaagggacgttccgcttggtcctcctgaaagcagttattcagattgagccttagaactgagagtgctgccgtcatgctgggaagacaatgggaccactttcttgtgccacacattgttatctgttgacttggttgttgttggttatgagacttcactctcagtgctgcactatccaggattgctcatgaaggggaaaattcctctgcgcttatacatgtgtttctctgactttaatttttccttgagattttgttttcaaccctttccaagggggaaaacattgcttcatgctttttctcctccaagtctattaatacaaatggcagggttttactgagaaggagaggaggtaagatgctcaagtctggctggctgcttagtttaataacatagcacttctctaacagtgagacatcgaattgtaacagttggtgtctcaagaaagagaataattaggcagtttcaaagcgttgtgattgaactatttcagaggcgactattgactttaagtgtggatgtaggtctcaggcaaccttcactttgcttggaactattgaaaactttagcaccttgttcaagttgttaaaagcaccctgaagtttgactatatcatagactgacgcctaacctctgctgtgtccttaggatatttgagtatcctagtgtgcagcttaaatttttcaaaaattttccttttgattcattttaattagatgagcaacagttttcatatgccatattttattgatttcaagatgcacatttcccccacaatagtcttaacaattgatgatatgaaaacatgtcatagtttaattgtgagcatttttctttccttatggttcttaaaatgaatgctgtatcttacaactgattgcaagttaggtccagtaaaccagtaacaacttcaggtatggtaagatctttcaaaaatcaaacagtagaacagtagggtaccacttcaccaaagttagagatcataagctttaggcttatgattaaggcttatgacaaaacaactttgcacttattaaaaagatacctctgtgttgtctttgttgtatatttagttcagtccagaatattataagtagtcacggccaatgagattataatactcttcaaatctgtaactatagaaatctacacttcctgtgtccttgtgttctcactgggtgagaggagggggtagggatagcattaggagatatacctaatgttaaatgacgagttaatgggtgcagcacaccaacatggcacatgtatatatatgtaacaaacctgcacattgtgcacatgtaccctaaaacttaaagtataattaaaaaaaaaagaaatctacattggggctgataattgtaaaggcttttaacatgaggcagaaatttagtgattgaagatttgcagctttgctctggttatctgctctgtcacctttaaaccttcatttcacttgtaaaacagaacactaacattttttacttcttgcgtgactgtcatatcatgggtgcattaacagctctgaaacgtttttgtttctgagaggaaagatggtgtgtaaataaacattggaattatgactttttctatgtagactttcctgtgaagcttaaaataaggaaaggaatattagggatctttctttctagtgataaatataaacaaagccattctgtcatctcccttctgcaggatgacaccagtggaatctttcaactctcaaggctgatattgatgtagtcctccactaaatgaattatttggtactagatggttacagtttttgcagtaatttattaggaataaaaaccacctgctaattcacttcaatcttttatgtcttgggcatttgatgtgcctatacctttgcttaccccttaagttcacagtgttcatgaaggtggtgcagtgttttcgtttttcctgtcctcactttctttacagtagcagtcatctgctcttcatagaaactcagttctgacacacagcatggacagaggaaactgcagtttacttaacgtaaacctaggtctgcagtttcctcttcttgttataacaataatgaccaaaccctgaagttacatacagatttcctttcttttatgattttaaaatgcttcatcgacttcatccaccattcctgggccaaagctagttaagtcgacagtgataaaatttgagttagaatccaagttgcctattgagtcattcttttgactaaccttcattactttccagttctagaatgccacatagatgccaaagagagagctaatttgtagcactactgcacaggcaaagacataaatttgatagaataaagcctttgttgctggtacatcttgttacaaattgaaggggattacagctttctcagtaggcatttctaatattttcttaactgctaaatgctgtgattataaatgcatgccattagagaaatgcttcactctatgcttttgccaaggtgtttctgaaatttaagaagttaaatgtataattatcgcaagcttctcaggaagcactccatttttctattttctattaactagctgtaggcacaatgagcaagcactcattcctatgtgttgaaaattattatgggaggactttcagaaggggaaagaaatgggctgtgtcttctaaacattatgatagtagagttaacattgagttgttggttctttaaagaaattatctctgatgtaggcattgtatttcctagccttaattctgtgactgtgccaacagagcaagggacgtgtgttatcagatggggacctttgagcttgaccctgaagaatgactaatggtcatagaagaaggcaggggacagcatttcaggcagagggacccatgggaagatacatgactgcagtcctggtgattcctagggaatggagaggggtgggctgggagtcagcctaaaattccattatgaaagactggtaagctaaaaaagtctaccagctaccctaaggagcttaaacttgccttttggtcaaaggaaagccatcaaagaagggaagtggcataatcagatgtggcctttgtaagatctctctggcattgctttagaggaagaattgagtgaagaagagggaaatgttggaaagaacctttagaaagctacc

SEQ ID NO: 124578 - DNA, 1145 bp, Homo sapiens
actttttttttttttttttttgaggtggagtcttgctctgatgcccagggtggagtgcagtggcgtgattttggctcactgcaacctctgcttcccaggttcaagtgattctcctgcctcagcttcctgagtagctgggattataggcactcgccaccactcctggctaattttttgtatttttagtagagacggggttttgccatgttgggcaggctggtctcgaactcttgacctcaggtgatccgcccgcctcggcctcccaaagtgctgggattacaggcatgagccaccacacccggccaaaaaaaaaccttttttccagtacatttccttataagaatggcaatgaaacgggctactggtatcaattactgattacctctgtattaccccaagccagtgggataagtatttatgctctaattaaaggaaccgatatgagataccttttgctctaacgacattatcattgttttctgttgaataacttttccattgaatggacgtatattaaatcttaatcaaaagaaaacactgtaaaaacctattaagaagtagaagagaagcttggagagtcttagctattaaaaaaaaaaagatgtaagagttgaaatggagtcctctctgctgtagggcagggataaatcatgcaatcagtaaggcagcagggagggtggagcgaggccacccagaactctctcagtggcttgagttgccccttgtcaagtgtgctgagcatggagtatctgatgggggagatgggagcttttcagccacctctgctttcagtctccccacagtagatttattgggctgtctgagtgctatggctttcccgaacatacagcacacctttattcaaacgttaataaaaataatacatttctttcatgtagcaaacatttattatctttttctatagaaccatgggctggaaggcctagggaggatttggggggaaggcaatgggtaggaacacttaaaattgtgtaagtcattacggccttaatgacattgctgccagtgaccactcctgcctccactctcccagcacaggcccacctgggcacatctccatagcagggccctgggaactgaaaggcagccagcttccattgcaatcccagccccatccctcactg

SEQ ID NO: 124579 - DNA, 1073 bp, Homo sapiens
accttcccatcctgggaaagaagagctactcaggaaaaatagctgctgacttgctgtgactctgctgacttccagaggtgctgggggcagactttggggcagtcttctctgtgtgccaagactgatctgtgtgcaaaccagcacccctgcccacagtttaccctcggccatctctctggcctcaccctctcagacctagcccagccaagggagatcaggcccatagctttttacctgccctttctgttgccttgtcacccttcttcccacagtctacttgatgcaatatggggacagccttgaacttttccaacctgtcacttcctgacttcctcctttaggggaggagcctgcaacttagcatcgcaggagagaaggtcaagatctgggacttaaagagttggttcatgatatgcaaagaaaggtaacagaatctctacagattctgccatttcaagtctgttgtcttgccacaaagttctgctttgggtgttggaatataaatattaatgactttgtttttatattccttatcttccactctaccccagtggcaggtgggtctgacgaggaaaaccatcccatccacagataacaatgcaaaaaagcatatcaccatgttttgtataataatataaagtcactaacattgattaagtagtttaaatccatccctccttccacacatccatcccataggtttttatcatctcccgtttacaagtaatgaaattgaaacttggtgagttgatgtaatttcacaaacaattgtacaagaagtattgtaggaataatgctttatttttccctaatgtataataaaaggaagttcctttaaattctagcaggataggttttgatgggggttaaggcaaattttccagtcttatttcctggacttatcttggactgcccctgccccctctatttatttagtggctcatttggtgtcactgcttgtatttgcaaacacaaggacacctggggaattcttggtggctccactgtatgttttaaaattccactgtaatgtctactgggaagatttggcagtaaaattactgacaattcag

SEQ ID NO: 124580 - DNA, 1094 bp, Homo sapiens
tgtgttgactattctcagttttttctctctccataaaaacttcagaatcagtttatctgtatctacatctattatctcttctagttggctctttttttgttgtatgagaattttcgattttgtgtcccttaaaattgttgaactccaatgagttctaatagcttccttaaaaattatcttggattttccacatggacaaattcatcatctgtcaatgatgactgttttgtctatgtttaccaatgcatataattccttttttcccatattataatatttcattagagccttgcagtataagtttgaataatatcaatgatagttgtcattcttattttgcccctgactttaattaaatataatgttttctgattagaagagcaatataaatgaagaagattgtattaggaaaaaacaaagacatttctttcttacaacccctccccaccctgaactacaatacatttgggaaacaatctaggggtaaaaataaccaacaagatatatattactgtattcaaagaattcaaatatggaaatattagagatacctgactgattcactgtgcattctcaatgcttgagttggcattgagtgtggatgtgaaggaacaatggcaaggtacaaaagagcctaagtcataggtattgtattcatttgttcctttatcaaaccctagctgggcacaaactataagctgaatgcagtgtaagacacaggatacaatagtgagcaaggacaagtatggcccctgctgttttaaaatcatagcatatgtttcataaatagaatgcattaatgagtcagtgactgtcagagaaaggtaaacttcttattgtgattttaggaggtgatcaaacgcagaaccattaagcatggccttaattaagtagagttccagctgcagaatggtgttttctatgtatgcttcttatttttaaaactattgaatactttttaaaggagaagaaaaataagctaatatacatcaaataaaaaagtatttaaaatgatagctggcacatctggagcttgacagaaggaattgattaccctactatcttatgtcttgtagtaaaactgttaattaggg

SEQ ID NO: 124581 - DNA, 2156 bp, Homo sapiens
gattattatacaatatttgcatgtattaaaatatcatgtaccatacaaatatgtacaattattatttatcaaaaaagtaactctaaaaaaaagattgcaggagggagggcctggaaataaattttgctggagctgatcttgattctcgtcatgataaagagacaaatgtacagtccgtacaagttgggatgacagtgtcttgaaggataggatttgattttttaaaatttcagaataaagtagagaagtaataaaaaagttgtagcatgtcattgccagagaaagagcaagtaaatacagatagggaggctggagaaggggtggctgatttacacagagtgggattggaaagcctctgatttagagatttttgagccaagacctgaagttggtgagggagtgagtcctgtggctatccacagagtatttgggtggacacattatgccagatgggttcgagagactgcaaggaggcaagtgaatgaggctgagagaggtagctttgcaatgtcagatgaagaagtttcaactttctggaggtggagggagatgaagatgagcaagcaagacccacacatgttagattgcataatgtcaaagactggtatgaagtcaattttattatgttgtgatgtcactgtatgatattagcatgtctgttttccttacttatttgatcaatggagtttggaatgtgaatacaattttggcaacttctcagggacagagtaaagtgatctcatacacttgtactaatgatggggacataaattcatagtttttcaggaaagcagttgttcagtatattccagtaactctataatccaataggtttatatgactggaggtctggctgtaggacataatcagagatgcatgtaaagattaagatagaagaatatctgttgcattttttttaacagaaagtagaaacaatccttaattccttatgataaggaaataataaaattggtatatcagtacattggaatattaaacagcttttaaaatgatgtttgggagaattaatatagtaattttttcagtgaataaagttgtatacagtagcatgtattctctttttcatgataaaaataactattttttcttgctatcatagtagaacatgctcattgaaaaaaacttttataatacaggaatgaatgaagaagaaatttgaaagttatatatcatctcaccaatctaaccactaatactcattttatttccaaacattttttaatttttaattttaattttaattctttgtattttggctatttccaattatttttttcttttttctttttctttttttttgttttttgtttttttgagatggagtctcgctctgtcgcccagaatggagtgcagtggcgcaatttcggctcactgcaacctctgcctcccaggttcaaacaattctcctgcttcagcctccctagtagctgggaatacaggcatgtaccaccacacccggctaatttttgtatttttagtagagacagtgtttcgccatgttggccaggttggttttgaactcttgacctcaggtgatccacccgtctctgtctcccaaactgctgggattataggcgtaagccaccacacccagccaccaaatttttaaaattaatatgcagatatgatatattatatattaatatgctgctgatttaataaaaggatcatcttatatgtgctcttttgagataactttagatttgcacacaattgtaataaataatacagacagatccagagtatcttttatgcaaattaccccaatgataacattttgcaaaactacagtatggtatcacaaccagaacattaacattttcatcaacacagcgatccctcatgttgctcctttatagctacactgactttccactacctcttttctcttcttaattcctggcaatcactaatctgttctctatttctgtcatttcaaaaatattatataaatagaatcagacagtatgtaacctattgaaatgggctcttttcacatggcatgattttctgaagcttcattcaggttgttggatatatcaatagctttttccttgtttttgtttgtttgtttgttttgagacagggtctcactctgtcacccaggctgcagtgcagtggcacgataccggctc

SEQ ID NO: 124582 - DNA, 1085 bp, Homo sapiens
gtgtgagagcacctaggtgactgcctggctctagtggccagagagcagccctgagaagctggagctgcttgcttttattcagtgcaggcacagtgccaaaaacctggagccaacactacctgtaggtaattaacattcattgttcgcctttcagggaatgtcaggtgtacatagatgatcaaaggtcagttcctggtcaacacaagtaagcaagcttgtttaagataaattcccccacattcttttgtacctactccttgccctctgcctcagttttatagaacagctgccttcacctgttctcctccggggctctgcagaacctttcgacctttcagaaggtttgtgtcctttccctatagtttttcccaccaatctgactgatcccccacatgttaggagttgggaagcaccttagctaggtagttcctgctcagggtgtctcaggaggttgtggtcagaatgtcagccagagcctcagttatttgaaggctcaactggcactggagtatgacatttcttttccagtgccaacaggtcccttattaacacacaaagaaaagtgtagtccctgtttgtgtaattgctcagagttttagttttcaattcagtttcatataaacctaacaattatttgcaaaggccagctttgaatccttctaacatgttctgaagatttctgctgggagtaacttatgatgggaatgccttctctgaattttcattgtcctccctcgggaagttttttctctcccctcggtcctttctgtgttttctccttctgtctttgtataaatagggttgtctcttcaaccacctcttgtgggctaatgagtgagtgtcaattgcccaggataatgtgaagaaaaggcaaacaggtccctgcctcagtggagtttccagccaaaatataggcattagtcacacaactttaaatgattgattgctaggtcatttaaaaaaacaaaaaagaactgtgaagatgctgtagcagcatgaaagggatcttacccagtgtgtggtctgcttgatcagcactttcccctttgcgtcttgtaggaagactaacctatctttgggtttct

SEQ ID NO: 124583 - DNA, 1025 bp, Homo sapiens
acctctttgatgtgatgacagcagttattggggaaataactatctgttaaataaactatttggtggagaacagtagtttcttggctgggcatggtggctcacgcctgcaatcccagcactctgggaggctgaggtgggcagatcacttgaggtcaggggttcaagatcagcctggacaacatggtgaaaccccatctgtacaaaaacatacaaacaaattagctgggcatggtggcaggcgcctgtagtcccagctactcaggagactgaggtgggaggattgcttgaccccagaaggcagaggttgcagtgagctgagatcgtaccactgcactccagcctgggcaacagagcgaaaccttgtctcaaaaaaataagaaaataaaaaataaaagtacggttcttaagaagcatatttatttattttttctagaattcttaaagtccatactagcttaacattatataatggcttaaaagttgtatattttttgggaataaaacatggaagaatattagattatgtttcttcttacatttagtttaggaaattgagaaaaatgggctctgtattttaaaaacatttctatcatggcatcaaaatttaaatgtttctaagattaatagatttactaaaagcctttagggaatttgtgaattggcaattctattaaaaattaatttgtaaggacaacgctttggtaactaagacctttgctaatattgctctgtcctctcaaaatgagtttccttgatttttttttcttttttttccttctttttttttttttttttttttgagacggagtcttgctctgttgcccaggctgaagtgcaatggcgtggtctcagctcactgcaacctccgcctcccgggttcaagtgattctcctgcctaggcctcccgagtagctgagattacgggtgcgtgcaccatactcggctaatttttttgtatttttagtagagatggagtttcctcatgttggtcaggctggtctcgaactcctgacctcatgatctgc

SEQ ID NO: 124584 - DNA, 1036 bp, Homo sapiens
gataacactcaaatagcacttactctgtgtcggatcaatcagtcccgatgatttatacatgttaattcgtctaaatctcacaacaatcctatgaggtagaggactgtgactccaccccaccgtcaggaaactacagcttctctcaaggttggcataaaataattagagatttcctactcttgttttagacttttggatctcgggttctgaatcttggtcttctaggaggcttcacttgttagcagtttttatgcgtagaatttctagctggaaacagtcttcgctaatctgagtttatcccaatatcagtctttgtaatgtaacatccctacaaggttctacaggaatctgtccctacaaatgagagattgctaccatagaagatccctagaatgtctgggacttcactgttgatgtagttacacagttgctgtagtttataatcttacctccaaagggcacgatgattgagaaaagatatgtatggaatggtgtgtaacatagaataaaagacgtagtaagacatgagtttaaaaattatattatggctttggagatgctttgttaaataaactatatcatgaaaatccacctgagaatcatttatgagctttttgtagattgaataatacgctgggtctaccagaaaacaccaaaaaaagtaacttgagacataaaaattaaaattttaattatgtaaacataacgttttattttattattacaacaaaaattaaaatgtctaatatagacttatttccttaaaatacattttatatacaaatttttatttatcaggaaattcaggtagatcagcagttagggcttcagagaaattaccaatcagaggttgtaagagcagctttgaaaactgaagacacagatacacctgctcttttgaaaagatgttagtgtcgttagcttgttcttctgagttcttgtaaacatctgtagtttcttctgttgtttgtaccatgaaattcatgagatttccacgacaggaaatggtttccaacagttattttttatctattca

SEQ ID NO: 124585 - DNA, 1074 bp, Homo sapiens
gccctaacaaggtgttgagggattgtttttcaggatccgtgtcattctgtaacgggtaaaatggtcccccaaacatgaataccccacttggtacctgcacatattacattacagggcaaaaggtgctttacagatagaattaaggctacagacctagattgtctgtgtggactctgtctaaacatatgagcttttaaaataaaggagagaacttgcttttgtgggagtcaaagcaatatggcagaagtcaaggtgaaagaaattctaagcctaagaaggggtcatcatgtcattgctggctctgagatgtaggagcccatgtgcaaaaaccagaaagagggccctaggagctatgggcagcttccgggtgacaaccagcaaggaaacaggtacctcagccctacagacgtaagaactggattctgtcaatgacctgcatgagcatggaagaacatgctcccctagagcttccagttaggagtgcagcccagcaggtactttgctttgggccttacacgaggccttgtgagaagcagagaacccagttgagccaacctgtaactggacttttgacctatacaaatatgaaataataagcggatattaagcagtaaaatgggtgataatttgcaatggaagagatactaaactaatgcacatttcttgttaaatacaagaatttgaatttggatttgaatttgaatttgaacccataatctcctgattctaatacagcagttctcttttgaatgtcagaagctgccagggcacagctacttaagttgattgatacctctgacgtttcaaagtgaattttgaaacctgaagtctgtccttcatacatttataaaggcttcagaattctatagaaatctaaaagttcatttttaaagtaaagtctgaaagtaaagtctgaaaaagcactttaagcactgtttacacattttcactgaaatgcttcagcctcttttattctagttgcaatgggactgggctaggtaggtgaaatataataaatggaggaaatactgattgtgaaagagtttataatttaggtggaagaaagggcttaaa

SEQ ID NO: 124586 - DNA, 1099 bp, Homo sapiens
tttttaccagtttcctcgaataagttctgactggttcattcccactcctgggtgaatctttttgcagatccacagcttttttcagctttctcagagcagtctccatttcttcagatatttaaaagtccatttgagtccagtatcagagcttcaatcttccatccacttcaaagcatctcctttcccccaacctgagcatgggaaaagggccagggttggttttgttgacatttcccatcatatttttctgtcttttctcttccctacctcctcctctgcttcactgtgctgcttctggctcagccacggtttgagaggctagggagaagtgacgccatatcaagaaaggtctttcttgactgctacagttacaatccggcctcagggttctcatgtgagagttgtagaaatctcttttttttcctgtatgaggccattgtgtggattggtggatattcctgtgtctaaagagctctggattataattccatggccctgtcatttcctcttcttctgaaactttaggactgttcctccagcctctggcttccttctcacagttttcttctattggggtcaccctaccttttcgggaggcctgtttccaaaatgacctatacccaactctctactggcacataggaagcacgagggcattattgtcctgtcaaaccctggaaatggaggccatcccaacacagcacagcttttttctctttctctgcctccatgtgccccatttgccagccctcttggacttttacagatgagagcagtccctaaactttaggaacaaatgccagccaattcaagtgattaagacccctgtcatttgacttgaagtctgtacgtatgtataatatttatccttgtagcactccagcagctccctttaaataaatggtctttgttgatccctcctgaataatcttcaagtctccctcataattccttgaagtgggtgaagggatgagggttgccgacatggttttacagaattttgctgcttcaggactaatggaatctgtgggggtgcacctagctctatctttcggaggtctgagcacttttcaccaattgttcttgactttgggtttca

SEQ ID NO: 124587 - DNA, 1026 bp, Homo sapiens
attagcatttgaaattgagccatctaattaaatattaaacattaatactcaaatcctcaaaatcaaatgtgaaaaatctaattttattcagtttagattaatatataactatacactctggactcttaatgaaacctttcccattcataattcccttttagtacattttttctataagcataactagtagccagaagctatgaaaaattatcttctcttgagaaggtgaacaatgtttgtattcatgatatcaaagatctcaagaaaaatctaattctcattcttccaccatcccacttcttttttcataggaatttgctttgttaagcaaaacttacttgtctagaatatagacatcatgggtaggggaaatggggagatgttgatcaaagcatacaaactttcatttattaaattgagcaagttctggaggtctaatgtacagcatgagtggtgatgggtgttaataaatttgattgtgctaatcacagtgtattcacaaataatcatgtggcacaccttgaatagatatctttgttaattacatatttttaagtataaaaagattttggctttatgctaagtgagacgggaagtcattcaaggattttgagtagagggacatgaactaacttacattttagcaagactatgctggcttctgagtccaggtgagagatgttgtggctgggaccacagtggcagtgatggaggtggtgagacgtggtcaggtgagagatatgtcttgaagagccagtaggatttcagggtggatacaaggcagagtatgagagaaaggggttcaagaatgacttccagttggaaggatggagtttccatcaattaaggtgaggaagactataggaagggcagggctttttgttattttccttttgggtaggagtggacataatgataatgcatccagtttgatggttagagggatgagggtggaggaccataggtttttgtcatctctgcatcctcacagtgacacccttagatattgcagacctcttgaactta

SEQ ID NO: 124588 - DNA, 1614 bp, Homo sapiens
tctaaagtactaaatatataaagataaaattattaaaccattgcaggtctcttctagagagagacagtatataccttttttttttcaatactaccatcataagccaacttttatgttatggtagaatgtttttggcctaattttggagatctaagctttggcttatctagacttggaatatactgtgatcagagaaaagatgtccatggacattgtcctcattcagttgctctgtcccagtactttctatggttgcacatgcatgatcctatcccattcttttcacccctggcccacccctctttacttcctcatgccagtgtgatactcttgctctttcctctgctcttcttgcctttttccagtcaaattctacccagccctcaaggggaagccccagtcctgccttgaccacaaaacttccatgatgtctccagtccatgttgctactgctttcagtaacttactgctcttgcattttgtatttaaaaaaattccatgcttccatgtcattcttagttctatgatgctttgtttctatccattttattcaagtgccctcttgattcttacattgtccattcatttgctgaaaacccaattttgtgttccttttaataacctttttgacgtttaaaggctactgatacctacctgtgtgagcctatctacattaggcccctctaatttgctgtcttctaagtgtcttcaaaataatgcaaggaaaccatttaatggctctatgtaaacacaattttgttccatacaaatgcatttctaaaaatagtaaaggggatttttctcatttaaaaaagaatctttaaagcaggaggggaaatgaagctgttggaagttttctaagctagtttgaagaaacagaattttatacaaaataacttttatacccaaactgaatagataattagaaaaaaaaagtgactgaatcagttgtcaagggtactatctctgggggaaaaaagaacagttatggtatctccttccaacagacagccaaatcaagttatccagaatgtactgtttctagctcttttattttaagcagagagttgaggaagaatgggtgaggaatgatgaaataacagcgtaggaaaaggcagtctaattattcccttgggactggtaagatgcttctaacactaccttgtttgggcctttaggctgtgagggaacttgactatttcaattcagctgtggttatagcagctcccagcttgccaggggtgggagtgggtagggctttgaatagacagtctgtaaagcttgaatgcataaaactgtatcctaccacttacacaatagttaacatttatgctgtgattaagatagagaggactgctaaaatttaactcatattgcactcaaatatggaaagaaaatgtagcttctttgtttttctctaagtgatctgatgtttgtctacatgaactgccatcctgcagaatgaccaaaaaaaaaaaaggcgggggtggggtggggggaagaagcaccctttagtaaagttattctaatacaggaatttaaaaagtctctctagttaactttttagtgtcttttagtaaaagagcccagtctctgtatttctccctgtttctc

SEQ ID NO: 124589 - DNA, 1029 bp, Homo sapiens
tggcttctagaacactgtcctttcgtccagtgcagatctatggccataggagtctggcaactcctactggacatgggaattatgttatcaggttagtattatgtcttgaaggcacagcatcattattttattaagctatcagatgaaaatacacttgattttctagaggatgttacagtctggatggaaattatttttgaagataaatatttgtattctctcttattttctaagtgacaggtcatcttttgattcacttatttctcttacaattcttgcaaaaattattagatacttgctgattcatagactaatattacctgtaggagtccttcctctacttcctttcttctgaactcaatatgctgcttacaaacttttttcaaaatcagtgacatctttagttgctctaagtgtgtgatttatcttgtagttaggataatcatcagaaactgattttatgagtgggatgttatgccattttaattgactaagtaatcatgaacactttgatatatgacctatgaaaattagctgtttagactgaacagaaagtagatgttaactggcaactaaaataggtgatggatatctcttttcttagttgagcccagagaactgaaggattagaaaccgagcaatctggattatttatttagcccagtctctcagctgctagttggtcactgaaaagcacttttttcctataggtaataaatatcaagggcatacccctggtcctgttgtgaaagaatggtacagatatggacgtgggtgtaatcttcttagatagtcaatagtacctagcaccgaatactcttatttataaaattagttaactacctttgaagaatggaggtattattaggatacttgatagtttcaggcttttggttagcaaaacattttgtactaataccttttggaaaaatctctagctcttgattcctttaaaacagggtttccccaccttggtagtattgacatttgggttagatagttctttgttgtgacgggctgtcccgtaca

SEQ ID NO: 124590 - DNA, 1035 bp, Homo sapiens
tttattacacacctgtgtaatcattatccatttagccactatccagatatagtggattttcatacctcagaaggttccttcctgcttctcttcagccagtaaccattccctgcaaccatttttttaacatcacaaaattggcagaatctatattcttctgagccattaattgagcaaatccatagtgtggtgagaaaccccagtgaattaacactttaattaagcacatttaatcaatcacattaacatttacataggttttgaaaaatatgccataggctagacatgcgtattctgtttacaaacaatgcctttgtgtgtatggactcacggagctctttaaaaagctccaagatctgctgttttcctcccattagggattcattcatagcccaaggtctgagaaccatgaggttagagcccagaccaagtagacaggacagggagtaaaagggctgtggtggttggactacttcacatagaaactcactttaaaaaataaatgatggcatcacctttagaaacatctgacttctcctttttaaaaaaactaaatttatatgtgtaagtctttgagtagagtcgtgagcaagctcacagtattcattttatttacatgaggccatgtgtaacatcaatcattattctcattttttcctcctttattggatctccatggatagagattgaaaaaggattgggagatgaacattaatcaggttcatggaaaaaaatccatctatccaaattagaacagatttagggtttaacgggaatagaatggggagagagcatgtgttttcctgtgatctggccaggaccaccattcttttctaatctaaggactcattaatattctgggtttaaacatgaagtgctcatgtgattacctagggatgaatcattttcatttttctggtagtaaattgaggtaaagtattccccacataccacgtgagaactcactttcaaaactttgaaatgctttctattcactttatactgtaggaagaatcacactggtttctgagacgt

SEQ ID NO: 124591 - DNA, 1022 bp, Homo sapiens
tactaagaaaaaagtaaaactatgtaggcatgtacccccagtaatatattaattttcataaaccttatgaagacagcttattttcatttagccccctttgcttgtgaaacagcattgtgctttgggggaaggtgctggttatagagaaggaggtagtattataaagtaggacctagccccctctagatctaagaactacccttcttcatcctccaagaaccagagactcatatgggggaattagaatatttaaaaaaataagttaaatgaaatttttatctgatagttggaattatgaagtagatgaaaccggatgcttggaattgactttgaactctgcagttgaatgaagcttaagagtaaagcagcctgctgtcaaattgtgtcatggttcgagatgttcactagatagggaagaaaattgtttttccatcttccaagacctgtgtatgtttgcattatcaatatgcagacttaatgcataatataaagtcttcaatttgctgtattgatataaatattatatttaaaaaatagtggatgttttacactgaaaactttgtgtaaaagaaaattatttataactgtagttaaataaagcaggttagcatttggagaatagttacagcttagcagcataagtggaccagtagctaaaataaagtaagatagttgtaggtttatagctgtattggctaaaatatgtctcaaccttatggacttggttatgattttatatataaatatatgaatatatataaatatatatatatatatatatagtatgctattggtagttcacaaattgtcacattattgttctatatttacagtgactgtcttttccatttagatttatggagagaattcttcttgtgcaggaagagcattgaggaatattattatcgttcaagcagctgacctgataaaggacagagtgaacctcaaggggttttacaggtaacacagttttctaacaccttgtcagaaattctctttgaggaaaaaaaaccaccctgtgt

SEQ ID NO: 124592 - DNA, 1046 bp, Homo sapiens
ctacgggcgcccaccaccacgcctggctgattttttgtatttttagtagaggcagggtttcagcatgttagccaggatggtctcgatctcctgacctcgtgatccgcccgcctcggcctcccaaagtgctgggattacaggcgtgagccaccgtgcttggcccacctcctgtaactttttaaaggggtgttgaccttttatttcaaggacacacgtaatatcagacttaagagggtatagaaagatcgagcttctgtgggccttccaccttggagaggggcatatcttagaaaaaagaaataagattcaatcattccattttatgttccatctacaacttttaaaatagtttcagtccagcttaggaactgctttaaaaacaactatgttggtgatttaatcttaccctcagtgaaagatctgtgtggaaaagtagttaattgaatctgtatttcagggttctttaaaaccccgtttcctcccacgggttgctatctgtgtcgcagtttgcatgctgaagcctgagtactgacgttctctggtgtcgaactggagagttggcactcgggactcaggagggaatgtggtggacagtggagggctgtggggcagggatcaaagctgaaatccttgcctgtggagctctaatgaagctagcgtcctatatgtgaggatcatgattttaatttaaaaattgatatgcggtttacataccccagagtgagtagctaatgcaatacctgtattctgggtcagagagggagtttggattttactaaaaacgacattgaccatgtgccttcaggtcaggtattaaatgtagctgttgtcttataatccattgcatatatcacactcctgtttctgaagctgatatagaacctggttgcgtatagacatgatggaatctaaatacgggggactcctgagttactgatatttgactttgcagtatttactttctgaattgttttcttcagatgttgttagatttgattattcagaggttaatggcaagagaaagtgatcctaagcactttagcaaa

SEQ ID NO: 124593 - DNA, 1372 bp, Homo sapiens
tgcagcattaatatttagaaataaaaaagaatgggagattcctgtaataaatactcttttcattctttaaatttggctcaaagaaaactacagctgtccattcttttgttgaaataatctttcccttcaggtaagattgttaagactgttggttattctggcaaacctagatcagagtctgtttgtagggaagctttacttaaaaaaacattaatgactaagtatatcccatgcactgaatatgctgttttgggcccaaggttggttagtgttgccctctctctttcacctcctccccctgaccccccactgtatctgggtatatagtcatgcagttcaacctgattttaaatatgtaaatacttaaatatttatctactgaagatctgaagactcaaaggaacttttaaaaagtttttttcgtgacagtttaacatgagaattatagaatcactatagtgaaatgttagcatttaatatgaatatatatctgtatcacataatgagctcagagttgatctcacttggtaggcagagtaagagatgattaaaagcattttatttcagctatgtacctacacacatatgtttgtgtgacctgggtaaccatataaaatatactccttacagtgggttgcagtaaaaaaaagtttgaaagccagtgatttacgaaaacagccacaggttcttccaattgtgtgtctgtgtaccctgtagtgggttgctccctcaggcgtagaagggtgtaagaaagccagagagaaggtggctaaagatttaatgtgccacctgttggttaataggactgtgattgtgagaagtgtttgctgtccagcttgagatacataggacttaggtgaggactatgtgaaagaaattgcctcccatgagtcatggaattaatttataactggaaagctttcgaaaacaagtttcctgtgtgtgtcaaatctcgtccataataagaaatgggaaccagttgttgaaaacctcttgttagcatggaatctttactacagaaatgtgggtgagagtggagggagaaagtgcttttcacagaaagaagaacatcctgttctctgtaggtggaacactcctcattttacctttgtatttagggctttatttatatgatgacttttttactgcatttaagtacatatgtaaaaataaaacattgggaaacaattgtgctaattaactcctggagcttcatttgctcatgattacctttctaaggttgccattgaaaaccttactgaaatgaagaaggtttgacagggcattaaatctccccagggcgtggaggcacagcaatttacaggcaaagttcgagtgccctggtagagaaccttcaaccgggaggctttag

SEQ ID NO: 124594 - DNA, 1003 bp, Homo sapiens
tcaaagcatgttacatggtctcagtcatttaagggaccaacaaagtgtcatcctcccaggagtcttgaaggataaaagaagcacaaatgttaggaatgtctacctcagccattagacgttgagaatacacaaatgactaaaggaattatcccagtccttagctactcaaagtccagtggggaaggtaaacatgttgattgtattatggtttagttttataaaattttacaaatttcaaaatacatagtgtaactatagtgttagaacataaaataacagaaaatactttggggagtgcaaagatatagaatctacctctctgagtttggaacgagagcaaaacttcagtgtggaggtgatttaagagctgggagttgtctacccaccagagttagagctacattaccttggtaaggttggtgtctgacttattttatgtgctgcgtaacaggtaaactaataatttgggttgtaactctaagaaataggcttacctggttttgagacctcaaggaagaaattaaagcaatctgtcagcagtagaatagatccactagttcaaatgaaatgcagcaggtaagtatccttctaatgaagacttgctaaaaatacttttactgagcaattatgctactgacagttctttgatctcaaaagattaaacttgctgctgcagtatgaaaagaacaaagccaagtgtaaaataacaatcagggttagttattaggcaacaaaggttgcatataggtactttgatttgctcagagatttctgacatattttacattagatataaatgtgagtggtgtgttaacattgcaaacaatgtgctttataaacaaaagagtctcttcctcagatctaagagccatggtattgtcctcttacactgctgtattccccactggctttgcccatcacgctggacatggtcccactgaaagcacctttgtaaaaattgtaacagaaaattatgacagtgaaagagatctgacctaaccaa

SEQ ID NO: 124595 - DNA, 4313 bp, Homo sapiens
catggtgagaagaaactcgtgaacagaatgggcactggcaagtatgatggcaaggcagagaggcccaatccctctttgggtggaggatagagggagaggcaagggaaggcctggccttgaaagtgatgctgggcttcaccgtagagggtcctgaggggtccctggacctctggttagaagctaggactacttgaatgtgaatcaagggccatttctgtgcataaacatgggtggctagggtttggaatcggagaagctgttatatgaggaattggcattccttctctgcaattgcctagcaatgttttttctgcccctgcttttttttttccgcagacaccctcagcatcgtcagcttatacgcaggaattataaaacctttatgtgggactttgatcttgctaaattttgtcaccgtgtattgaacatgttctgaaatgcctgccaaaactacattcatgaagtaacaaatagtcgaataggataattacacctttggttcctttgcccataggttccagcaatgggcgtgttggtgagataaaacacatttttcatggtttggggggtcatccagatcatcttctacagtaacctcaccatgaagcaggactaccacacatactaataccaattctgcgtgtttattagttcttttatattgaaatgtcatgctaggttgaaactatttcagagcttttgtaaataatattggggtggtaaaggttgggtaccaacatctgaataccttgtcttaataaatgaaatatataaagacaaaacaagcccccaatctcaaattttctgttgttacaattctttaggtataagaaaaattctctatgaggaaaaatcaaccctggaatttttttccctctctttctgggtagttgggttgatacctacccagatctcatcttgaattaccatgtgttgtaggaggaacccggtgggaggtaaccgaatcatgggggcagatctttcctgtgctgttcttgtgatagtgaataaattttatgagatctgatggttttaaaaaggggagtttccctgcagaagctcttttcccttgtctaccaccatgtgagacgtgcattttaccttcctccgtgattgtgaggcctctccagccatgcggactgtaagtccattaaacctctttcttttgtaaattgcccagtccagggtatgtctttatcagcagcatgaaaacggactaatacagtaaattgataccagtagagtgggggcactactgaaaagatacctgaaaatgtggaagcgactttggaactgggtaacaggcagaggttggaacggtttgcagggctcagaagaagacaggaaaatttgggaaagtttggaacttcctagagacttgttgaatggttttgcccaagatacttgtagtgatatggacaataaagtccaggcttaggtggtctcagatggagacgaggaatgtgttgggaactggagcaaaggtgactcttgttatgttttagcaaagaactggtggcattttgcccctgtcctagagatttgtggaactttgaacttgagagagatgatttagggtatctggcagaagaaatttctaagcagcaaagcattcaagaggtgacttgggtggtgttaaaggcattcagttttataagtgaagcagagcataaaagtttggaaaatttgcagcctgacaatgtgatagaaaagaatatcccattttctgaggagaaattcaagccagctacggaaatttgcataagtaatgcggagcctaatgttaatccccaagacaatgggaaaaatatctccagggtttttctgttgtgaagcagaaaaaggtccaaggtgtcagagacctttactgcagcccctcccatcacaggcccagaggcctaggaggaaaacgtggtttggtgggctgggcccagggtccatgtgctgtgtgcagcctagggaacttggtgtcctgtgtcccagctgctccagccatggctgaaaggggccaacatagagctcaggctttggcttcagagggtggaagctccaagctttggcaacttccacgttgtgttgagtctgtgagtgcacagaagtcaagaattggggtttgagaacctctgcctagattttagaagatgtatggaaatggcagaggtttgctgcaggagcagggccctcatggagcacctctgctagggcattgtggaaggggaatgtggggtgggagcccctaaacagagtccctactgggggacagctctctaccacctagtggagctgtgagaagaaggccactgtcctccagaccccagaatggtagatctgctaacagcttacactgtgcccctggaaaagccatagacattcaacaccagcctgtgaaagcagcctggaggggaatataccctgcaaagccacaggggtggagctgcccaaggctgtgggagccctgtcttgcatcagcatgacctggatttgagacatggagtcaaaagagatcattttggacctttaagatttgacagccctgctggattttggactgatacagggcctgtagcccctttgttttggccaattctcccatttggaatggctgtatttactcaatgccttcacccccgttgtatttaggaagtaactaacttgcttttgattttacaggctcataggcagaagggacttgccttgtctcagatgagactttggactgtggacttttgagttaatgctgaaatgagctaatgttttgggggactgttgggaaggaaagattggttttgaaatgtgaggacatgagatttgggaggggccgggtggaatgatatggtttggctgtgtccccacccaaatctcgtcttgaattctcacgtgttgtgggaggaacccggtgggaggtaattgaatcacagggcagatctttcctgtgctgttctcatgatagtgaataagtctcatgagatctgatggttttaaaaaggggagtttccctgcacaagctcttttctcttgtctgctgccatgtgagatgtgcctttcaccttctgccatgattctgaggcctccccagccacatggaacaagtccattaaacctatttcttttgtaaattgcccagtcctgggtatgtctttatcagcagtgtgaaaacagagtaatacactgggttttcttatatttatatgtcagaaaacatggatgtgtgagggagtcaagggatgacctcatgcagctgaggccataatgataagtcacctcgtgttactcagtgtggcacaagttcaagtgtatgaaccctttggttttgctccattttctcttctttctggtcatttctccagtaaagcttggttgctgggtacctggagaagacaagcaaatggaagcccagaggacaggagcccaaatctgccaggaaggaggtagagcattcccagttgaaggcttccaggaagtggccatgcctgtgcatcacctcttagggggaacggaccagagggaagaggagagggggttctagtgcggaataccctggtaagagaatccaagccctggtcagggaacaaggaggagctcagtgtggaggaagggctgtgggggctgggggacccagacatacaggaatcccttttccaggctcagaccctggggcaaggatggttcccgcaaatccatcttgttttcacctccagtctagagtgaatgttctccctgtccccctagctgggaaaggagtttttccagttcagagactcaggtccactttctgtgcttaccatctccttctctggtttggtcttcagaagtctctgatcggccttcttcctggtttgtgaagattcatctccttacttccccttggatgagctatccatcttcactttgggttaggtttcctttggctttgtggttcctgttgtcttgttctcctctcccgagcttttctcctggaggcttctctggtgggctgttttcccagtctctcttctctgaatcagctcaggcgcttgtttgctgtcattgtttcccagcacagcactcctgtttcttcatcctggcaccaaaccatcagtttgcctggccccagctgagggctccatttggaatgggagagggtgcttgatgcccttttcaggagtttggatgattgaagcacacctctgcatgttaaaactgtcagagaagccctcaccccacccaatctattaattttttttagaatatttaagttctcacattccccacttcccataagaagaaaaggggaactgttgcaaaggcttgagtaaccatccacctggtctgct

SEQ ID NO: 124596 - DNA, 1968 bp, Homo sapiens
aattttggtatgtttaccttttaatgcactatgattacctgcatggaattactcttaattgtttttgttgtgggtggggggattccaggcctttttgagaatcaaaagatagcacagcaaaagaaatgcacattcagacataattttgcatctcatttcagagggcttgtggatgttctgaagcctgtgccacaagacccctggttagaaagtgcttctctaacttgccttccagaaagcagcatcatggttttacaattattttaccttttctctccttttcctctaaaaacttgatataagtactcattcagttgctagtaaattttttttgaatcaaaatattttactggtgttgaattggaaatcattcacctccaaatatagcaaatgcttcggtaagccctggtaggtggtggtgctgaaaatgatgataactattaatatttaacaaatcctaatataacatttatcatatcaggttgtttgaagtactttaagaacagtaactcatttagacctggtaacaacaatcttatgtcgcagatggtctcatggtcttcttttcccgaagagaaaaatgaggcataggttgagttgcctaagatcacccaataagagaaggagtcaaatttgaacccaagaaggctgactccatattatacagtctaacacttcttctgcatcctctctctaaataagataattaatgtatgtccttgattagagtctcttttttttcattttgacactttcaaaattgagatgtatcttacggttgctgtgatcatttgaagaagtacttactgttttgctccctataaagctattattaaattgatggtatatcttaaaattattggtgtccttgaataaaggaactatggtaagccatgtgttttatttaaaaaatatagctacatagtttatagaaatatcatagtaaatcacagctttaacatggggtatacaaacaatcccaatttatttatgaagtgggaaaaatgtaaattaagattatattaacaatctatatgaacactgatattgcttaggtaatgatctaaatgtgagaagagaataaatttaaattttttcctacaaaaagcattaatagccttagagtaatgttgaaggtggaagaaaccaaaattgtaagtgggggcagggggttaaaatatatatatgtgtgtgtgtctgtgtgtgtatatacataattatcagttttcttacagctttttttaggagagcaaaatttaaaagttaaactttccatataaatttcctaaaactgagaaccatgaatataactaaatgacattagatatagacatgcctttgagtcactgtaatttgtatagtgagttggcagatcttaccttctgtgactcagttaatctgttttgtattcatctgctttgttcatgggacattgacttcttgcttataaaatccttttcattttgtactgtttgtattatctgtagagaaaatatcattcaggacttctaccaaggcaaaacaaatctttactaaagttacaattctgaaaaccagggtttttgcatcctagttggttgtcttcctgtatttttttccaactggtctagcaacttaaactcagtccattggtggttttgttgttcagttgaatttgaccttgtcaaatcatttacctgcagctgttatgaggtgtacatgcaaatacttgtgattgcctaacacttaggactttggtgctgacggcaaatttattttatctctcattactgttgagggaagtgaacagcttatcacttctgcttgctctgacactctaaatgttgactgtaatgaacaaacactgcaaatggttgactcattatattgtgctgtgaatttgtacataggaatgaaatctgcaaaaaaattttttttacgttgagaagaggatataataataacttttggagattaggggaagtatga

SEQ ID NO: 124597 - DNA, 1084 bp, Homo sapiens
attcaccagttgtgccaaattgctcaccaaagaccttcagtgattcccagcttttggattggtcatcagaagggcctaattctctttaaccacccttcactagccagggttcttatggcctgtgctcttcaaaattgagaaactgggaagaacagctggtagccctctgaatgaagttctctctttttctttgcccagatgattccgtctcaaaaaggaacaaagtatccctttccctttgtacaagctggagtgctttagctctgactcaataccctcctctgctagaaacttgactttattgattgagaaatagaaaccgatccaaattatataccagtatgcccaatgtatcgccgttttaggcacctattttacaggcaaagcatgtcatttattctttgtgtttaaattgaaatcaatggctaacatcatagcacttaattatgtaccatgcatattctgatataaacttcaactctcactacaagcctatgagcctatgagttagatgctgctatttgcattccacagatgaagaaactgaaacacaggtgtaatttgcccgaggttacagagtgtgtgccagaagggaggtttgcatctatgtatcctgtttccgtagagccaagtccatgctctgaattaactttagttttcctcaaatgcattgagagggcaaagggtctatttactctaaactgtgatagccttatagtacctgctgatattatcttaccactctgagagaggtaaataaatgccattaataatgtcagacttttcacttttatttgggcacacagaagcttattattgacatattgggtttaggggaagtggggagaagcattgtggttataggcgaaaggtaactaatgtttacttaaattaaaaatagctcaagatcagcctgggcaacaaagcaagaccatgttgctacaaaaaacaaacaaacaaacaaacaactaaaatacaaaacaaaacagcatccatgtgtcataagcaaaatcagccatgctcacttgatcaaggtcaatccaaaaaccttgtgaattcacccagcttactttgttctcatctg

SEQ ID NO: 124598 - DNA, 1940 bp, Homo sapiens
agcttctcgaggctgcatctctcttttcctaggcattttccatctcaggtggaaaatggtccatcccaggtccatctcagaagatgttctgaggattctctgtgtgtgatgggacattcttaaagtcggtgacccagagagtttaggaattgcccacaagtgaccttaacatgtgtggcatttaggattgcctgcaaagtaagtgaggaaatgtgtccccaagatgtggtgtcggaataaacaagaactggagttatagactttgcaggaatccagggaaaagtaggtcaaattatgtttctattatccttgacggttactttttcatggcacagaatactgaagacatgagggctgccaggcagtctgcgacaagaattgctgagggtttctgtataaatagatctatagtatttatttgcgttcatactcatgtttcttgctgcctgggagggtgtcgtataccttgtcaatatacctatttagttttattttttaattactctgaatgtggttacctcagataatgtatgctttattaaccctctttgattctaatactgtattatttctttttgggactttccaaacacatttcgtaactgcatagccagtttttattgaaggaagtttgattgtcagtttttccagtgttggaaacccatactttttgactatttatttgactgtttatttcccctttcttctgccttggaactacctttgtgattttggaatcttccccatcaaaggagtaggaagggggttgaaagaaggagaaaaacaagtgaaatatgaacttgtcttaggcagctcaggctgtcataacaaaataccgtagactgggtggtttaaacaacaggaatttattttctcacagctcaggatgctgggaagcctgagatcaatgtgtaggctgattaggtttctggtgagggctctcttcctggcctgcagatgaccactttctcgtatatcctctcatggccttcccttggtaaacgcagaggaagagagggctccctcttctcataaggccactaatcccatcatgagggccccaccatcatgacctagtctaaccctaaataattatcaaaggcctcatctccaaataatgtcatgtttggggttagggcttcaacataagaattttgtagggggcatacacttaacagtccaaaacacagggggtttgaaagaaagagagatacaagtagaatatgtatcagactggttggttggtgacttgttagcatctgggattgtctggttaaccaccttggattgggcagtgatgctaatgcaaacaaatcatggcttggatctttttgtagaccttcagctttgtgtctcatgggccatacctccagactggagctgcgtgacttcagggataagttaacagaaatccattaccactagtaaagacacagctttgtgcattacatgagttagttgagttttcatctcctatattgaccaagatctgatttaggaatatgtgtggtccttatccatgctgccctgggctcccacaaacctggacaatctgacatcaactgacattaacaaagttctttgtgggttgtgttgctcaacccaggtgcattataggctttttttgttgttgttgttttgttttgttttttttctgagacagggttttgctctgccacctaggctggagtgcagtggtgtgatcatagctcactatagcctcgaccttctggctcaagcggtcctcccacctcagcctcctgaggaactgggatacaggcacacaccaccatgcttggctaattttttttttcctatttcttttagagactgggggtctcactacgttgtaggctatctgttactaggaaaaaatcaaactgccatttggttaatatgcctgagttccttggttcctcagttcagtcacttctagttgt

SEQ ID NO: 124599 - DNA, 1070 bp, Homo sapiens
gtgggtcatttttgctgtcaccagcgacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagtaccaataccaccaattttgtagacatcctggagaggcaggcgcaagggcttgtcagttggatgagttggtggtaggatgcagtccagagcctcaagcagcgtggttccactggcattgccatccttacgggtgactttccatcccttgaaccaaggcatgttagcacttggctccagcatgttgtcaccattccaaccagaaattggcacaaatgctactgtgtcggggttgtagccaattttcttaatgtaagtgctgattccttaacaatttcctcatatctcttctggctgtagggtggctcagtggaatccattttgttaacaccgacaattagttgtttcacacccagtgtgtaagccagaagggcatgctctcgggtctgcccattcttggagataccagcttcaaattcaccaacaccagcagcaacaatcaggacagcacagtcagcctgagatgtccctgtaatcatgtttttgatgaagtccctgtgtcctggggcatcaatgatagtcacatagtacttgctggtctcaaatttccacaaggagatatcaatggtgataccacgttcacgctcagctttcagtttatccaagacccaggcatacttgaaggagccctttcccatctcagcagcctccttctcaaatttttcaatggttcttttgtcgatgccaccgcatttatagatcagatggccagtagtggtggacttgcctgaatctacgtgtccaatgacgacaatgttgatatgagtcttttcctttcccattttggcttttaggggtagttttcacgacacctgtgttctggcggcaaacccgttgcgaaaaaggtcaaaat

SEQ ID NO: 124600 - DNA, 1170 bp, Homo sapiens
acttaggccacatcgcactctacccacttaaatgatatataactatctcagagcctcaattcccacattaaaatagggatcgtagttgggagttgtgaactttcctcagtgtctaatgcacagaaaccattcaataaatgttattttagtattactgatactgcatctagtaatgagatagctttgttttctgggtttatcaggcctacctgttaatggaaatcagtaatcgttttccttttgattgacttcattttatgtctgctcacatttttgtttttgtttatgataggtaactgtgctcaaaagaaaagtgtatttgaatacagttctgtatatttaatttgtttgttcagtgggattgatccttgtctttcacaactgaatttgatagatgaggaaacaaacataaatgtataaaattttctaggtcttaggttatgtctagaagatttttatttcggaatttaatttctttcttctcttcacaaacattttagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgttatgcttgagtcttttttgaattgaacatgctaggattatcaggtaaaaattaagccttttggtactttctcaaaacagggaatttatgtgtgtacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaagaaataaaggtcctggcggctctgttgctagggggtgggaatggcactggagagttgtgtgatttatttgtaggttaaatgtgaggctaaagtttccctcagttatattaggaaactaga

SEQ ID NO: 124601 - DNA, 1083 bp, Homo sapiens
tttggaaagtcgaggcaggtggatcatttgaggtcaggagtttgagaccagcctggccaacatggtgagactctgtctctactaaaaatacaaaaaaatttagctgggtgtggcagcacgtgcctgtaatcttagctattcaggaggctgagacaggagaatagcttgagcctgggaggcagaggtgacagaggttgcagtgagccgagatcataccacagcactccagcctgggtgacagagtgagactctgtctcaaaaagaaaggaataagatagcttgttcttcctactgattagtcctggacataatttcatactctaatgaagattggagacttctgtagcgtaggtaaatttagatagtactggttggtctagatatcattctaactatcctaggttggattacaaagaagaaaaagtcttgattgtaaatgttttgtctgctggggttttaattaatattttttctcttctgtcttccttgattcaggatttaagaggggtgcagatcccggaatgcctgaaccaactgttttgaggtactgctcttaaaactaaacatttcaggacaaatgttcatacagtagtactgaatcactaagatgtaaaagagtaatagtggcaggccttgaaatggagctttatcagtcagtatagttttgggctattggaaaactgcaactactttctcttccccctcctaatttgtatttactgtaccatgttataactacaatgaagcatattttaacagaaaaagaatttattatcctaccactttaaaatacgaactgttttaaatttctcatattcccgtcttatcctcattcagatgaatacaaccttttatatcgctctgacaagggtatgcaggattttgttttcacctaaaattttagttggctgtcccatatgttttccagttgcggtttacataggtttttcaatttttcagtattttatacaacaatacaattaacatttgggcagggtgtggtggctcacacctgtaatctcagcactttggaaagccaaggtgggaagatcatgggaggattgcttgaagctaggagttcaa

SEQ ID NO: 124602 - DNA, 1025 bp, Homo sapiens
caaattctaaaatgttggcaagtaattaaaagaaatttttttaaaaaagattgggatcaaagaaaacatggattcgggccctactgagtgtcacttcgtaacctttttgcagttcaacctcaggtttgaacaacctgattctgagaagttaaataatttgtccacggttacacagccagtaggaataagagttaggactaaaacccagtccctctgaatttaattaatgttccttccatgagaaggaaggaacacctgaagatgcgttttaaaaatgggtaacagaaacgcgaagttaccgccagccatgatcgcaaccacgcatgcgcctactactgccggcgaggcggaagagcagggaaggttaaaggcgatgaattacgacctctgctggcgacgctcacgactcctgccgtaaaggccgtgtgtggcgcctgcgcacctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggtcagtgggagaagaaccgggaaagtgactggagggaagagggtggcggagacagcagccccatttttggccgtcgggggagggagagaaaaataggggacactgccgtgcacggcccctgaggctgtctggtcaagtggggccgatctaacctgagttcgagttcccgttctatcgctttatagttgcatggtctttaagcagtcttgcaatccctccttttctatttttgcatccttaaagtggaggtcatatttctcgggattgtagggagggttggatgaccccagtggatgtgaaagtcactaattcactctctagcactaggtggttctcggggtgtttttcctcaccgctccatgtggtcctaagtggaaagagtcctgttcagggaatcgagacacctcg

SEQ ID NO: 124603 - DNA, 1061 bp, Homo sapiens
gtgactgggtaagtgggctcggaccttctggacgcaggagccgaccacgtggctccggggctaccccgtgcgcttcctaggcgcgcctctcgctgcccccacgccgaggcctcggctcggcgccgcggggaagcctccgttagggcccctcgggggtgggggcgtcctcgtggcgcttgggcccttcgtcccgggttaggacggcccgtgtccttgtgcgcttgaaggggccgccccctttcctcgaggatcccacccccactcagcagaagccgccaggcgcccgtcacctcccgtgcctgagtccctgccgtccacgcattcggcctacaggcagcttttagtcctttttcaattaaatgattgcattttgaggatcaaattccaaccgcaggcggaggcgccgagccccggacggtctctgggttcttggtgcactcggggctcctgcctgcccaggggctgtgaccgcgcggacggaagcctatttgggaagcgagtgagatctgatgtctgaagcgctttaagtttctaagcggggcagtataatagcggggttagcaaacacacggaggtcatttcactcgcgcagccatcccccaccgccaccagtgccgttcatttgctactggcccgcagtcagataatttaaaggcttggagggacgagtcttgctggagccgacgcctacagtaagttgagcggagtgctgtgagccctaataagggagcctgctttcctcccgaagattcgcttttttgggagtggccagagcgttattacagcacagggcccgcttccaacgtttaatcagggtgtgaggaggcccttcgtggttttctgacctgggaaaagtctgaactactgggttctttctggcttggaccaggacaaggtgttgaacgcctaacttaggtctactaaggtgtagaaatacgcaaggctgcccctagagaacgtttgtctggggaataatgtaagtttttggagcggctctcctgagcatcgctgagcatactaattgttcattactggtacaaaatgctatataaagggatact

SEQ ID NO: 124604 - DNA, 2075 bp, Homo sapiens
ggctttgttttaccattgctttaggtgttagagattcttattgagcccattttatttttattttattttatttatttttttgagtcggagactcgctctgtcacccaggctgtggtgcaacggcgcaatctcggctcactgcaacctctgcctcccgggttcaagaaattctcctgcctcagcctcctgagtagctgggattacaggtgcccgccaccatgcccaactgtttgtattttttagtagagacggggtgtcaccttgttggccaggctggtcttgaactcctgagctggtgattcgccagcctcagcctcccaaagtgctgggattacaggcgtgagtcagcgcacccggcctgccaaattgttttttaactattcagtttaaactgtgagagacaccatgtcaaggaagcagtgtgagctagcgtctaaggattgtgaaaactgagcaagtgcccagaactagaaacttcccagccccctgaactcagcctcagggtaagcgagtttaatagtgcttcctttgattttcaaatctgtggaaggtttgtttcagtttttcccagacaaatattgttgggatagtgtttcttttcaaaaatggataggattcaatgctcatcagtgggaagatagtgactcctgaccattttcctcctagctggaaactacagaagactcccaagtatcaggaaatttggagaatttgtacaggaattatattcagagatagcaatttatttactcatcaaagagagctattggatagccaccataaagaccactcattaaaaaacaaaattgcatgatattcttaacattgtctttcactttttttaaccaggcttggtggagtttcaagatgctgatgaacttaaggtatgggccgagtggaaagaatttggtttaagttattaatagttgaattgaaattgtggccaaggatgagaactctaatctgattttatgtgcttctgctgtgatggattaaaggatttacctgaggccaaattggtatgcaggaatttattaaatggaatcataccccccccccttttaaaattacgcttttggtaaaagggaaaaagctcttggtaaatggataatactactaagccaagagaaagacaggattttgagtgaaaacataaatttagatgtcacaacattactaaagcaacagtgtgtaagatactggacgattttatttacttacttgcacagtttttgtaaacagtctagacagtactgtattttgctatttagtaatacctactgtgatacttcttttacaggtctggcgcttgaaagaatcagtgaagcttttcaagtagaggaggtatatttgaatatgtaacctttagtatctacagaatagaggttgcttttttttttttttttttgtccctttcacagtggtagcaaggttgaattttgagatggccccaatcatctataggaatattatttgacagttttggagacacaaaactgccttatagctgacttgatcctgtagaacatttctgtggaattcaattctattatttaaggtagtttttccatgaaccagctgtggtctgtaacttgacagtgttaataaaacaagtagcaataccttcatcatggttcacatggtcaacaaagatatgacttaactctaagattgttattttacagtatagtcttttttttttttttttttttataatagatagtttcactcttgttgcccaggctggagtgcagtggtgcaatcttggctcactgcaccctctgctacccagattcaagcgattctcctgcctcagcctcctgagtagctgggattacaggcgcgtgccaccacacccagctaattttgtatttttacacatttttgtttgtttgtttgagacggagtctcactgtcgcccaggctggagtgcagtggcacgatctcagctcactgcaacctctgcctcccgggttcaagcgattctccacctcagcctcccgagtagctgagattacaagctaatttttgtatttttgtagagacagggtttcaccatgttggccaggctggtc

SEQ ID NO: 124605 - DNA, 1099 bp, Homo sapiens
ataagtcttcagtgttttctttaacagtacaattttagaattttgtttgttggctttaggaaatctcagtggcattacatgaattgcattatagcatgtacttagaaaaaagaacttatggctgggtgcggtggctcacacctgtaatcccagccttttgggaggccgaggtgggtggatcacctgaagtcaggagttcaagaccagcctgaccaacatggcgaaaccccatctctactaaaaatacaaaaattagccaggcatagtggcgggcacctgtagtcccagctactcaggaggctgaggcaggagaatcacttgaatctgggaggcggaggctgcagtgagccgagatcatgccactgtactccagcctgggcaacagagtgagactctatctcaaaaaaaaaaaaaaaaaaaaaaaaaaaaaaaaacagaacctattaacctattagacacttgaaaaaattcctggcttgtagttgattatatgtttggttaattccatttcatctaaggaactaagtaatttaggaaatgtgttcttaactactcttagaagggtacttgtagagaaccagagtggtgattttgtaagcagtattttgtcctatacaatatgcactcttccagtaactccagtagtccacatagctgactcacctcctacaacccgactttgttaatatcaagataactgttttataattgtagagaaagattttttacaaccagttgtagttattattttctttgcattatgttattgtgatagtagtggtagctaatatgtgtaattaaaatgatcatcttatcctcaaaatcatcctataaagtgcatagaatccccattttacagaagaggaaactgaagctctcaatagggtagaggacttggctaaggtcacctagctgctgagtggcaaaactcagccttgaacacaggtcttaggactctcactttatatagcttggtaaaagaagatactaattaaatcctacctaatagagatgtatttaaaattcactcaccccatctgtcttacaggtaatagttttaaggtaagataaaatcaaagtgttctaaaagtaaatcata

SEQ ID NO: 124606 - DNA, 2467 bp, Homo sapiens
ttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactgaaaaaaatattttttccagatcagtttactcatttaaaaaattattataaaaatttgcagaagttttgatatgaaggaagagaataaaggaggaagacttaggtaagttgagccattgagagcttttgggggtaagtgataagacaatgacctcattcctggctttgtgctttacatgtcatagggctgaggagtatgacaggtccactcgtattcatccaaagatgaagatgagctctatgggccatgcaccagtggcggattatttgtcatatcagaagcacaggcaaatttaggtaacatcactttgtccttctaactttagaatctttattgccatgtgtggtgagtagtagtcccaactactc

SEQ ID NO: 124607 - DNA, 1031 bp, Homo sapiens
ctagatttttttaatttgataaaataatctacaatatagagtacaaccttctaaaaaagtctttaaagtattctaataccaattttttaaaagttccttggtaagagctttgattttatactgctttgctactgaaggagagttcacccctagttttactgcgtgatatttctaattgtttcttatcttttgcatgaataggagaattctttctaaaaacttaatggggtatggtttatggcatgctttttgtttaatacactataaattactgtcatttaattacagtgaagtatttttgacattttataataaatgttttgatttatcctttgattttctataatctgttgctttataaattatgctaaagcttaatttatgtaaagcataactgatttggtgttaatcatttaaaaagattgcttaaaatacttaatgttaattaatctttgtcatttctttgtttaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattact

SEQ ID NO: 124608 - DNA, 1660 bp, Homo sapiens
tccagtcaagtaacacattcacagcttacccttctcatgtcttctgtatgttttctcacttttatttattctaataatttaatctcataacagaatattcactcaattcatcaaaaaaagatgtattgagtgtctactatatacaagctacttttccaggtactagatacatagtagtgactagatgaaaattttaaaaactccttcctcatggaacttaggtctaggaaacaagataaataaataattgtaggttagagagtgttaagtgctaagaagaagaaaaaaggaagagggtatgtgaaacgtgggggctattaaaactttggatgggttgaccaagggagacttcactgtaaaggaaatttttgaaaaagatgtgaagtaaggaaatgagccattcagccaccaggagaagacagcagccaggacagcagtaagacagtgtgggtgggaatgtcgggtcacagagttatatagggaaagaagttggagagctgatagagagcaagattaggtaacaaatgtttgtttggattacttaattatctttctttattctgtagttttcctgagaattatgtttctgttctttctagctctgtacagaattacttgctcttcttataaatttaataagcagtttaaaaaatctgccattgttaaccatttttgagtgataacaagtatcaattaattaggtaaagacttatgcttgtgggaaaacacatgatcttatttttctacttgccatttaattccatgatttttttaaatgtaatatcattacttcttgggctgcagacctttattctgataaaagtgattacatttcagttgcgtggtactgctttatgtaatattctccctgtcattttctagtttttcttgcaaaatcctgaatttctgccattgaagcaccactttagattaacagctttcattggcatctcttaaaaaattgacccaattaaaaaaatacacagacctaaactcaagaattattactttcctaggatttcttccagacttttattttctccggctctccattcaaagtaaattgtttgctttttgtaaaatggccaggaatctacatgaataaattaaacctaactgtgggatgtcagaggatatttaactcaaacggactcgaatgaagagttagagttagtatttatagtatgttagaagagacatttgaagttaaaagattttactggttagcttcccccactgaatagttgtgtagctcttcctgaacttcagtttccttgtctgtaaatgggaatcaaattgcctacttcagaggctcactaatagattgttttgagattacaattgaataatatatgtgaacactttcaagaaagcgacttagggcaattcattgtaagtattgttctgtattctattaggcctatgcttagcttttaaaattttattaaattttaatattcattgccttttttatgtctggataatttccgaagtttgattttttttggactggagatccctttagtagatcttttgtgaaacagcttccacaatgtaaataaacaagtcttggctgtcactccacagtgccatggcgattttatctcagttgcagtgacctctggcatgtacctcaataagaatttatttgccctaactt

SEQ ID NO: 124609 - DNA, 1117 bp, Homo sapiens
gataaagaaatgtataacatagggtgagcaagttgttctttcttttcttgttttgttgaagaacagtataacaacatgatagtaaactagattaggggatatttacttataattccagtatttaaagaattttcatttagttttttctatgcatgtatgttttcatggttgtactctatttaaacttttttggtattttgtttttgtttagttaatattgtcagacattttccctagttctcctagtaaatacagttattttaatggctacatgatatcacattgagttaatattccatcatttgcttaatcattcttctaatatgttaagaaatttgtttctgagttttgctattataaataacactgtaaggaatagcttaatgaatacagataacatttttctccattgaacagaatatattataaacataaaatgactatattaaaggatatttgttctggtatggcatttaaaatatctacatctcataaattgtaaaagaatgtgtatgactttgttttggggtttattctaagttaaagtatttttcataattcatgtaaaaaattgtatgatgcagacaaataataaattatatttttaaagcttcagcttattattttcacaaataagtttgtaagcaccccatgtcagagccagatgcctttagactcaaagtaatctgagtacagagatgtataaattctatgaataaataaattattcttttattaaaattctcacctttagtaaatatggcagccataaaacaaataaaagcaaaagctaaggtggttttgtaagtgacataataaaatagatatttgggattataaaatgacatttgagagaaatcacaacttttcgtcatcagttttaataatatttgcaatttgcttcactttttttcttaaagctggaagaaatttttttgggcaaaattatttgagtacctttgagaactaatttggaaatgtctattaaaagtattctttaactttcatttctacatgtggagagtttacctatttgtgcatatagggggttacacaaataaaatatatcctgagaagtttctttttggatcttttttgagctttttgaattatttga

SEQ ID NO: 124610 - DNA, 1292 bp, Homo sapiens
tgtcttaggattgtaccctcattaaagtagcattcttatcacctgtaccccttcacaattctaacacttgggaaactctgtttattataacaataaagtcacagatgagaatatagaagtgaatgaactataaaaagtaagtcacatgcatggaacaggtacagaatacagcttagccttgtttatcactcttctttagtgtgaattccctttatccagtggactctaaaatactcttaagtccttcttatttgcctctacaggtaggttgcagtctcctccctttttagggtagtcttggctttcccttctagagcagtaaagttaccatgttcggctgaatttgaaaggtttctattttccatcctcatggtcctgcttcctacttgaacacattgtttttctaggctctctaacaggcactggcttcctgtggggaaggtagacacctttgctgtacttcttagatatatagacaattctcaaattataaatagatttttaaatttaattttgtttatatataaattacaaatttctcaaattatagattttttaatttaattgtgttaatatataaattctattgttaatatttatatataaatcaaaacaaaatttgtttatacatttctttagaaacaatgttaaagggcttgtagatcccagggtgagccacaacagcctttttatctcataatgtttctgaaacataggactatagaatgtaagttcagtttatggctgtatgaaaatacatttagagtttctatatttaatggaactctaaatgtgtttcccattccacccactcatatccctactattccctcaccacaccaaccctcacagtaggacaaatttcttcccaaaccctcagctgtatctatcatacagtagaaacaaggaatatcccaccttaagccagtggtgatgaggattgggaaaggagaagggacgagaaccatgaactttaagaaatattctttttttcctctttctccttgcctctttgttttcctagtttttggaaagaagaaagcaattggcccttttttctttttttctgttggagctcttctctttttcttttacttatttgtctttatttattattgcatttcctctaatttctcctctttctatcttttctgggtagaagagggaaacgagtgaatgaggttttctcatggaagacgccaagtaaaactttcctttttgcttttttttttttttccatctccctttaccataaaagaatatacgtaattaagccatgtgaatgtactggt

SEQ ID NO: 124611 - DNA, 1044 bp, Homo sapiens
aggtatggcatttggaaaaaggtgaataggctaatgcagtagttaacaatagagggtaaggctgtgataggagctgaagctagaaagctaggtttaggacataaccatggtgggcctcaaattccatcttaagcagtttagactttttttgcactgaggggttaggaaggtggctatgtggaggatagattggcaaatgaaaagatggggaatgcaagaagactaggaagctatgacaatagcctaggagggagctgttgagaacctaaacttgggcagcgtcaggaggagtggaaagaggtatggtagaagagagggatctgaagtacataattccttttgtacttgagtttgattgatggcatgatagactctaacagcagattcagtggtaaagtaacatatcctggagtccagtccaatatggatctatgtatctctgggatgaaactaccaaaattgagggaggctcttcttttgagtagttaacctcttttggagggggtatagaatatcccactcctactggtaatactataatgcgtatcatgaattttaggtgctgaagggattagggagtatattgacaagccaaaaaactttaactggaataactgaattgaagaatcatatttgtcttgtctcttccttcttcccaaagcttcttaacttgtatagaatgcacaggtaggctgttttcttgaaggattttactttttaaatattgagtgaaagctgttttaaggttttccatgtttggtttagaattatatatttcaccaaatagggtaagtatagccatacgctttatgttttttaacaaatgttgttgatcatttattatttattattttgagaagcttaaaaattattctgtcatgaagtatgttttaactaggctactttggaaagtgtttgtaggataaatttatgattggctagattagtttatagcattccttttattcagataactctagtgaatatagctctaatggttcagagcagtgtttctcaaactactagtgatgatggaccagtttt

SEQ ID NO: 124612 - DNA, 1036 bp, Homo sapiens
aacaaaacaaaacaaaaaactttgattaaatcttgtgtgtgtgtgtgtgtgtgtgtgtgtgtgtgtgtgtgtttcctgcttgtgttatctttgtgattaaaatagtctgttatcacggcttttttttggcagattgatggaaatagtcaagtttaacagttgaatgctatttcttctagggcattcttatgttaatgatgaagtaaaatatgcaaaagcaaatgtcgacagctatccattctttaagatgggagttgtggaaagagagcatgttaaagggtgggttgtaggggtgagatcagctagtaaggtaaaaaatggaaaaccatgactgatctccttccctttccatctgtttgtttattcccttcccctcctggtttggatatatagacacctaggaagtgcagtaccgaggagtgaggggcagagcagcggttaacagcagtagtgtctgaggaagtaggtggttggggtgaagggctgcagaggtggcgtgtagaagaatagccagagtagttacattggtagattggttacattgagcaaataagttgattgaagaaataagtaaatattttgaggataatgggagttagatttctatctgtctgaaaaaggaattacaatcatggaacagcgaaagccaagaaagaactctaaggtgttgtgttggaatcattatgaactcatgggttctaagtatgcatatgatacatatgtgtgtatgtatctgtacatgtatgcatgcatatatctcctagctttgttcactgggaggacctagaaacaatggcaccctggtcgcagtgagtacactaagctcccagatcttgttttccaaataccatcttccactacaagaaaccagagtatgaataaataggaaatattatttaagtaatattttatcaatataacatattatgtgggtaacaatattttattaacatttttcataaatttaatgcaagcatagggaaacttttcctttaggaggagagagtgaatcatggcctgcaggaaataaaatgta

SEQ ID NO: 124613 - DNA, 1043 bp, Homo sapiens
tttgccttttcattctcctagtggtatcttttggtgagtagaaattcttactttcaaggaagtccagtttatccttttcccctccttgtgattagtgcttttgtgcctcttgtttaagaaacctttgcctagcctaagattatgaaagtactctcttgcattttcttctaaaagccttatggtttactgttcacaattagatctgtggtccaactgaaactgtttttatttttgcatacagcatgatctctagggtcatggttctttttgtcctccccatgtagctatccaaataacctagccccatttattataaagagcatcctttcctcactgaatttcagtgtcatttttgtcataaatcaggtgaccatatatgtgtgggtctgtttctggccactctattctgttccattggttgttttctattcttctgacagtgccaccactggcttaattactatagtttttggtaagttttatactaagctttgctgttggaagtccaggtcccacagttctgttgttcttcaagacagcccttgactgttcttggttccttgtatattcctcttgatttcttttaatttttgaaaaattaaccttaattttaactggagagttattttgaatttttgtaaaaattttacctccccatttctatgtaacttgatgtagtgtggttccatttgtgataactttctgtcctaatttattaaacaatggaattcatacaaaagaaaacttttgtgcatttatattggctttgctttacaaatatacataacaacataaaaaaagtagatacaggcagacagaaaataacagtaagacaaagagaattggttatgaaactcacagtattcataatataaaaacaaacaagttactccaaaggagagattttcctagtactgaaaacttaagatgtgaattttctagactctgttggcttttaaggaggataaatgtcatctagcagtgctttggtaacattttggacataatttcaaagcccagtttctccaaacagacagttctat

SEQ ID NO: 124614 - DNA, 1060 bp, Homo sapiens
cgccgtggctttcacctttaatcccagcactttgggaggccaaggcgggcggatcgcgaggtcaggagatcgagaccatcctgactaacacggtgaaaccctgtctctactaaaaatacaaaaaattagccgggcatggtggcacgtgcttgtagtcccagctactcaggaggctgaggcaggagaatcgcttgaacccgggaggcactggttgcagtgagccaagattgcaccattgcactccagcctgagcgacacagtgagactccctctcaaaaacaaaacgaaacaaaaaaagcagtagaagagaaatcctaattatgcttgctgtaatttgtgttgactatatttttatttaaaatgtttttataaagggaatccttctagtaagcttccctactatacttataatatctaatttttaacaattgctgttatttggagatgagattttttttttacccatgataatgatgggttgagaggaaaggaaggacaggccaagaaaaagcatgtaaagaaaaataagactaaaactttttgttttcactatgagaacatcaaatatgtcatacaattttaggttgcacctcagaaaggccagcctcttcatggaaatcatattgagctagtcacaagatggtaattaaagcagatgctctccatgtcaccagattatagagctccaaagaatttattgtaatacagtgtgatttactgaatttaggtttcatcaatcaggaattagttattggtgaaagggtctaagcagatgtttggtttttctataataaaccctttcttcaaaaacaatgtgtaattgaaaaagaaatgcttaaaatactttagggattaaacaatcttataggactttcaattactttgggaggaaccaagatagaaatttttgctctgctaattttagcctcacattcagctacaaaacaacgtctaggttacattctgctatactagtataagacagtattattgaaaactttatcttaaaaataattttatatttcagcctctgctaaaacaaattgactcttagcccagt

SEQ ID NO: 124615 - DNA, 1543 bp, Homo sapiens
tcttgctaacacttaatccttatttctttttcttaggacattgatcagaacttctagaataatattaagttatagcagtgaacagtgaggatccttggcttatttctcatttaaatggaaatgcctttagggtttcacagttgtgtgttcaaaatttttatttatggtatgttaaggaaatagtcttctatgccttttcagggggaaccaagatagatattcagtttgatcacatgccctcttaatgtaccttgagatgatcatatggttttccttcttttacctattggttgatgaattgtgttagatttccaagtagctttcatcaaacagttgctgttttagggataaaggcaacttgataatagcatatctctttaaaatagtgctatatttgatttgctatatgagattgatctttagtattccttttgtattacctttttaaggttttgatttctgaatatgccagctttgtaaaaagagagactgagagagaagctttccatgtttccatttttgcatgtgctctggcaattaatctcttccttggaagatttgaaatagattggctctaaaaatgtctaggtctttttggactgaatacaattataaagatcttaatatgtgcttgtgtactaagtattttgcataattaatttcatttagtccctatataactttgtgaggtgaagattattatttctattctacagataaactgagactcagaggttaagacagtcgtccaccatcaataaagtacacaaagtttaaactcaatttctatctgatgtaatagcccatgttttctaatcagtaccgtaatgtttttcttaattaggactctttcttcaccccatattactgagaagtaaatttaatcattttatttgagcatcttattaagtatttttcctctttgcacacttagttttaatttttggtaaccctgttatattatcactgttctgttctgtgttgatgtgtcatcttttgctattttaataaatactgtgatcttggagtgaggtgggatagggtgggggaacttaaaattgttgttcatataatgcacttaatataatttacattttaattcgttgagtgttcaagatcaatttgcattcctgaatcttgtttgtaccttgtaagaatgttatgttaagtgtaccacatacaagagatcaaagagttttggaaacacagtacttttccattttagtttgaattatttttgttgtgagccttgcatcagggtagctttttagtagtaatgttaagtgatatatgtttggtgtgcgttttcttgaacaaagagtcttttcatagttgacaaacattagttgctttctcatataaatacatagaattcagtcatttgtacttgacttaatgaaaacataatatatgagttattaaactgtaccatgaagattaggttttagctactggaatatttatatttactattatgttgagtgatgtataggcttggaaatttaagagaataatgtaagccttaaaagtgcttaaattggcc

SEQ ID NO: 124616 - DNA, 1011 bp, Homo sapiens
ctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaaggtgggttatgaaaagaacggattttaacgctggcgaaggtgaaacaaagaggctttttttttttttaattccataacatctacaccgataagcatagaaagtcactttttcctttctgtaagctttatttatagataatacacatctaagtagatttgtgggaatgtttgggttttgttgactgggatcctgtttcaaggggacaaagcaggatgtgagttatgtgtaactgcaaaacctagtttgctttgtctggtggttctgctgggaatatgggcaacagtagaggaatttaagatttttatgaagatattaacttctggtttctataagcaaacgctgactgctgggattttgtctttgttcaccagctcctgctacagtgcaccagtgcagtctgtgggaatgcttttaaatctttcctggcctggcctttgtgctgaagtactgtgaatgcctgaattcgttaatttatgtaactgactttcatgtatctattttcaaattcatgttcctttcatgtaaacctttttgtatctacaataccacagacttcaaattgctggtgcatttagctattgcctgcctgtaatggtagttgaacatagttaaccagggcttaaactcgttgaagactcattaggttccctcccactccctcgaatatatgttttcattcgtggatcatagcattgtaaagcattgccttaatccctaaatagggtgaaactggattgcagcagcaaatatttacttgaggagcagaggattatctgagactgtccgtttagct

SEQ ID NO: 124617 - DNA, 1476 bp, Homo sapiens
taaaaagtgactcacatttcttagctttggagtatattaacatcacttatttaccgttacaatagaagtacaattactgaaaaatcagggttctgttactgagtaggaaggaaaaaatggttacctggtgaacaaccaggggtcccctccacaatgattaactgaccttaatctgccaggttctcctgttgtcagtggtttggcatgtgattcaaacagttctccaatagcacttttatcaacttcatggaatcatgcatcttttgcaagatgtgcagtttcacttcgcaattgatttacattatggttatattgtattgtcctgtttaacatcataacacaggaaacaattgaccgagaatgactgacaagggcagttgatgggaattggcagaaacagtggctggtctgagccagagtaggaatgtttgagtgaggaccaactttataagtgctcttgttctttagtaaatatttttgtgttatgactacttttacatccctttacaatctcattgctttaaggatcaggataatgagtgcctagatgacaaggacccctctgtaaacatccagaaacattccttcaagaatttgagaacattgtgagattagcatacctcagttccaatcctgctctctcattatttcattttgttattttagataacatgatttgggtcattccatctctctgtagtatagtggccgattctatacatagaggcaaaaggggattctgcagagccagcagcctcggcttcttctaaagccttttcctacattgtttttgtcatttctagccttttgtttctaagtaaactctccagtgaagtatgggatacatataagagggcacaaatcataaatgtatagctcaattattacaaagtgcacatcccaccaacaagacgagaacatgaccagtacaccagaggtccccccttatgcccttctcagtcaccaaccccacagtagtaacaactattctaactctgtaaccatcgaagttagagcagaagcaaccattgataaataccatgccatgccatcttctaagggcactatgcacccctgttattaagaggagctctttgttctgtctttggtgtgtggtgcattcatgaaagtctgcagcacatcggcaaaaagtgggtttttcctgtgtttgaacttatataaatgtaatcatatggcataaactcttgtgttttgttttcttaaagccaacattgtttgtgagattcatctgtgctgtgtgtagcgctacttcatccttgtggtatatagtatcccattgaatgaatatagcacaatttatccattctatcattatgaacatttgggttatttctagtttggaactattaagactagtactactttgaacatttttgtacactttgtacatgccttttggtatgcatatgtatgtattaatatttgtgttgggaaataccaaacaggaatttttga

SEQ ID NO: 124618 - DNA, 1782 bp, Homo sapiens
tctcccaaatctgactgttatgagccctctcatgattaaattccaacatctatgctcatcctctgaattaaaatgaaaggcaattgaattccaaatatgtgctcaccctggtttcttatactgttcagtttagtcagccagaaagcgtttgcttgagtgtttgggtacagtcagggtagcttcttcagcagctgcaatgtgggctggcttccattggaatggatttagttagcttagcacctccaaagctgaatttgtccaatttcaaggtagttgatgccacactttccggtatgttagaacgtccctaggattgatataagaagatctctcatctctgtaccaaacagcccagatgttgacattttatttatacagtcctaacccacattattttttgcagccaaaaacagaatataaactttggtttctggggaacagagggttttcaaagaaaacataacaatcttggcttttggcttgccagtctgaatcagctttctgtaatctatagactctagggctaaactcagttgggaggaatcttccatgcttataggggcactgtttaccatctatagaagagatttattcaatgtatattgatgcttctctggcataggactcattttgggttttttttgtttgttttttttttgagatggagtctcgctctgtcgtccaggctggagtgcagtggcgtgatctcggctccctgcaacctctgcctcccaggttcaagcatttctcctgcctcagcctcccgagcagctgggattaccgggcgtccaccaccacacccggctaattttttgtattttagtagagacggggttttaccatgttagccaggatgtcctcgatctcctgacctcgtgatctgccggcctcagcctcccaaagtgctgggattacaggagtgagccactgcgactggccaggactcattctttttcttagacaattgttagagatttgccagggtgataatactcagctaccaggtatcatagagtttcccttttttccctattatccatcctgcacatttaaagcttaattttgatatcttttttgaaccctatgttcctggcaacctaatgctgaaatgattgagttctatctaatgacaaagccttctctcatttttgagaggagagtgatttacatttgtagccagcagttctgcagagcacagtttgtggccttgcattccttacaattctgagcttcctgattgttctgcacttttgtgtgcccattaagatcctgtcatgctgtgaaattccttgtatctatgaatcctgtctcttggaggggtttgtcctcctttcctctccatttgtctcagctggagaatggcctttaacattcctttaaggcccgtggtcccacagggaccactatggcccttacagcatgctcctcaaaaccttgcttttcctcagtatttgaaatttctaggccttgcaaactcagcagcagcgcagacatgttcctttctgtcacctatttgtgtcaaaatgggctatgtctctagtgttgcattttcctctgtggtacatctgttctttcaggcagcctcagctgacttgttaacctgcttaagttggatcttttcctttctacatcaggtagctgacctttttagattagaatacctttctttttcttttccttatgattttggtgtttgttttgcttgcatacatattcctctaatgcctttcctacagaacttcccctagtggaaaataagagagcacatgtgttcagaattag

SEQ ID NO: 124619 - DNA, 1138 bp, Homo sapiens
ttaaaagcccagggttgaggtggaggttgcagtgagccgagattgcaccactgcactccatcctgggcgtcagagcgagactctgtctcaaaaaaaaaaaaaaaaaaaaaaaaaaaaaaaagcccagggttttctttttaaccttaggtggaaagacaaagaagcagataaatttcataatattttagccggcaagttaaactttaaaaaaaaaatagctgtagcatattgtgccagaaagaaccctggatttggtgttcagaactgggtccaagtcctacttcctctacttagtactattttatgagcttgggaaaaaaacaaaatctagttttatgtttctgttaatatggtcttaaaaagaagtacactaattcactcttttcttagcttaatttaaggcacatcttgggtggagaattaatttgcattgactatagaaatgttgggcttgctggggcattttcttccagagagaactgtcccgttatttttctgcatatttaacatggcctggaatgccgtggttcctcagtcaaacttgtggtagtacagatgccatttatgtttcttctcttcattgtagctaacatgcttgaatcaaagtcctttgaagtagaactcaaagatgctgaacctgatattattgaacaactggtggaatttgcttatactgctaggtgagttaagtattatttttattttagagaagtaatgttggtatctaccatggcaaagcattgtcgtaacaaatagttgcactacaaattcttcaaaatgaaaaaccgcaaggatggaagagtttcagtatcctatgccatactaattcaaggactgaaagtttaattttgtgtttaatttcaggggctattaggatacattccacagtaacatttaaataataaaaaatcatgggtaactaatattccctctaacttatttgcagaatttccgtgaatagcaacaatgttcagtctttgctggatgcagcaaaccaatatcagattgaacctgtgaagaaaatgtgtgttgattttttgaaagaacaagttgatgcttcaaattgtcttggtaagaaatatcagattcctgttgtgtgtttattttgttttatcctttatttctaatttaatttttt

SEQ ID NO: 124620 - DNA, 1098 bp, Homo sapiens
caggatggagcaggatgacgtgagatttcatcacacaactcagaacagcacacaatttcaaacatatgaattgtttgtttctggaattttccatttaatgtttttgaaccacagaaagcaaaaccatggataagggggactactctaattccattttcctacgcttgttgtgattcagaggctttaaagaaagggaagagcgctggtataggagtgctaggaaagcagggaggaaagaaaagtagaatgaaggaaagtataaagaggggtcaaagaatccagtcagtgctaagatatttgacccaggagaaaagaagaggggtgctaaatgacaagaacgcaaagactgatgcaaagggctcctgaagatgcttcagaattttggcaagtctcctctgtccctactttttgtaggctttcctccttccggacactttagtactccttcctgcataccccctcactgtgagcacagagagagagatcttggaaggcaggtggaaagcagcagaataaatttcaggaggaagtaaaagtcaggtgaagggaataaaaatgagacttagcctaatatccagaaaagggattggactagatggagcaggaagagaaatagctatgcaggtgaatatactgaaggaatttttaaaaggtagccatgggtctacatattgaaaagatccctatattagaaaataaaaggccaatctctaatcctacctgtacagcagagacactctggcatgagtccttccatctctttgggccgtaattggggcttcactcatcaataagatttatattcctaagacttaaggttacttccattatataaataattatcttcagacaatactataaacggggaattaccttaattaagtttttggaaatgatggcttatgtatgtttctataactccctagcactctaaatttcctcctggggtgattcaactacaaagaagaatggctgaaatataggtaggtagtagatgtggtggtgcaaagcatagtgtggaacctggagtgagtctgtgctaagcacatcttaggctttgggcttctgaggagaccatttagtagttttgcctctgga

SEQ ID NO: 124621 - DNA, 1008 bp, Homo sapiens
atccatttgtgtccacccttttgcaatgtgacttggtagctcctcccatctcccttgtaatctgtggccgtgtgacttgctatagcctgtggaacattagcaaatgtgaagttagcagaggatagaaaaatgcttgtgctttgggatttgccctccattgttgctgggaactcttctgctgccatgagaagaaggctagagaccatagggcagagatcaactatcccagctggtgtctacaacaagttacttagaaaagaaagagaatcagaatgccattaattttttatctgcagcacaaaattagaacataatgtcacaaggttgcaaatgagagggagagaaaattgcatttcaaggcatcattcatttggatattgcaagaaaacaatcacatgtatcccttctgagaaaagtattagaagtactgaagctagctaagtgagagaggtaaagagctcaagataaggatgtaccggttaggtttcttacttgcaagcaaaataaaccaaatgttgctggtttacacagaaagggaatttatggaatggctagtgagtaactcatagcattgcccagaaatctcaagtcagattttaaaaagaaggatttgaataacacaaacttgttttagctagataacacagaatgttttacctagtcatcagagaacacagattgttttcagatacccttggagtatttacaagtactgatcatcagccacagaaaagctggagcacctaaaaaagaggagacacaggccacgtcccctgattacagtgcagtaaaactaaaaattaactatggaaggacagcttttctctcccaccccattctgaacacttgaaaatttaaccaaagaattatttagaaaattaatttttagagatattaaaggtaaacttataggctatatagaaacatggcaataagcacacaataaactgaaatctttggaatataaccaaagtatttcttagaaggaaattggtagccttaaatttt

SEQ ID NO: 124622 - DNA, 2967 bp, Homo sapiens
agctgggcgcggtggctcatgcctgtaatcccagcactttgggaggccagggtgggcggatcacgaggtcaggagatcgagaccatcctggctaacacggtgaaaccccgtctctactaaaaaatacaaaaaaaattagccaggcgtggtggcgagcacctgtagtcccaactactcgggaggctgaggcaggagaatagcgtgaagctgggaggcggagcttgcagtgagccgagatcgcgccactgcactccagcctgggcgatggagcgagactccgtctcaaaaaacaaaaaaacaaaaaacaaaaaaaaaaccagtcttttataagacagtatagtattggcacaagaatagacaaatcaatgaaacagaaacggatccagatttatgaaatttactcaactaattttcctgaagtcatgcttcatcttgaatgtatacttggtttttctaaaaatgattttctattcttttattttctttctgtgtttaggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtgactaaattgccttctcacatttttcttaataaaaatgtctttattggtttcttaaaactcatgtttggacacatgacaagggaaagagtcatattaggaaagaatatgttctttacactaaacagagtattgtaatcttaggtgcttgccaggctggctctttgagaaataggccacttcatagagataaagccattgggtaccatggtaggcagaacaatgccttccccaaagaagtccacttcccaatccccagcatctggaatatacctgtgtggcagataggactttgcatatgtgactaagttaaggattttgagatgagattatccaaatgggcccagtgtaatcataaagatccttaaatttggaagagggaagcaaaagaaggcagcgtcaagtggtgcaatgtgagaaagacttgactggtcattgctgtctttgaaggtggaaggggaccataagccaaggaatgcaggcagctgctagatgctggaaaaggcaaggaagtggtttctcctgtagagtctccaggcagacacactggttttagtccactgtgacccattttggactctgacctatagaactgtcagataaactgtcagaagtgtaagctggttgcagtcatttgggagctgggtgggagaacactttatttaattcattcattcattcattcattcatttattgagacggagtctcgctctgttgcccaggctggaatgcagtggcgtgatctctgctcactgcaagctccttctcccgagttcacgccattctcctgcctcagcctccctagtagctgggactactggtgcccgccaccgtgcccggctaattttttgtattttttagtagagacggggtttcaccgtgttagccaggatggtctagatctcctgaccttgtgatctgcccgccttggcctcccaaagtgctgggattacaggcgtgagccaccgcacccggccttatttatttttttgagatggagtctcactctgttgcccaggctggagtgcagtggcatgatcacggctcactgcaacctccacctcccgggttcaagcgattctcatgcctcagcctctcaagtagctgggattataggtatgtgccaccacaccctgctaattgagatggggtttcaccatgttggccaggctggtctcaaacagttgacctgcccacctcagcctcccaaagtgctaggattacagatgtgagccaccatgcctggctgtgggaacactttaatatgcagactcacttaatctctcttttcagccccacatccttctctatattttaagccactaagtttgtggtaatttgttacaacagcaatagaaaactaatataggtactataagatcatatgttttaagttgcttttgttctaaaaacaaaaatttgcacttagcaatgttcttttgcccagtcttcttcgtggcccagagtatcaatttgcaaattgacaggttggacctggaggacctcactagataaatagaaaaaatttacttccatgatcaaaattggttgacttaaatgcagtatggaaaaggagtaacaagtaacattacactggagaaacgttataaacagtacctgcagatggtcagcattagcatcatcagtgatgtcatgttgatagtatgcacacttgatgtaatgaaaatgccattcacctctatgatcgtcctcctaaaaaaccataacctcagtctaataagtaacacatcagataaacccatattgaaggacattctcaacaaaatacctgaccagaactcaaaactgtcaaggttgtcaaaaacaaggaaaggctgaaaaactgtcacagtctagaagattctaaggtttaatgactacatgtaatatggtgttctttatagtattgtggaacagaaaaataacactagataaaaactaaagaaatccaaaaaaatatgaaatttagttaatgtgtcaatattggttcattagttatgacaaatataccatactaatgcaacaccttaacaactggggcagggtatgtggaaactctttgtgctatctctgcaacttttctataaatctaaaactattctaaaataaatttgtttaaaaaaagaccaattcccataaaaaattaactcagaaagagatcagaagttaggccttattaatatcactcgaaaattaattacaaatatcaccccaaaattaatttagtgggtatgggagatgtgtgtgtatatgaagcaattgattttttggggggtgtttaatgatttgtaagt

SEQ ID NO: 124623 - DNA, 1928 bp, Homo sapiens
tctgctacataaacctgattagataggtattatgagtagatatgaagaacatttaagagaatgatttagtttatctttgagggattgttccctgtacaatatgatcattattttatctctttatttcattctgtggtatacagtttctctaagagaacaagtgaaaatattttcccccagtttttcaagtgtttattgagtggaattgaagtttcacgaacatgttatgtttatcacattgttttgtgtgcccaccactgagtaacctacggggatattaattagagaataacatcctaagctattaaggctctattttcctggtcacctaaaaagcaaaatgttcatctttgtcaggagtcaaagtattctacattaggggctcttcctttcctaagagaccattcctgatgttctgtgatactttaatccaatgaatgcctgaaacactggatacgatcataggttatcagtcagattttctcgaaggaaactcaataatcacacatagtgctttccttggtgagattgggaatggtatgaattcctatctgaccctgattattttcagaaaatagcaggaacgctgtagcttcctatctcaaaaaaagagagggtccaagatactataactttaggggcatccccccatgcacatacatggaagggcggcacaagcattcttcgatgctatcaaacatagtgaagaaacagatgctgtgaacagcccttactgtcaagtactgataggtgtgtatttctaatcattggggtgaaaagtgagtatccagagtacttagaagagattactcaagtatttccttataaacatcaacagttttaaagtccagctgactacattggctcaactcaatatagaaaattaataaagaagtccacaaaataccttctggctttagactatcagtaggataatggcaatttgagcttcatattatccattgattacttatatcacactatatatctggcagggaagggatggagacctttacatttgaaaaagcttttttaaaaaataaaacaacttattttagaatcttcttgtattgtcttcaataacagaaggaatagaagacagggtggtgatggtatatccaaatatatttaagtttattttagagccagaaaggacccaaagcagtcatgtgcctgccttttgccctccgccccatctaatcaacattctgcagaaaccacacaagattaaattggtaatagtctcaagccaaacatttgtatgtgtagtctaataaattaacatattcttatatgttttttgactgtatctttgcattgtccttttcagttatatttttttccttactgaaagcttcccatccttttctgctacaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggtaaggacttcttaagtattttggtttggggcatatgctttaaagccaagtatcttggctttcatatttaaataaacagctggtattatttgtccagatactttcttggtaatttaaatatgtgtttgtcacattttagagctcatctccctgaaggtttatgtcgttgctttacaaaccattaaattacagaactttagcttcctagattaatggcccattttttttatcataatgaagcattagttgacattatctgaattatagttctaaattatttgggctgcataatattatttgttttaaagat

SEQ ID NO: 124624 - DNA, 1196 bp, Homo sapiens
atattaaataagaatatgatcagatagtagttttcatattttaaggtatgggtctaccatctgtaaggaactattatgcttttccactttatataaacatttgaagtatggataattcccgtcatgcataatggggcttgaagacatatataaggcttcttatttaatttttcttttgaaatcaaatttatttttctaaagtttaattaccaataaataagtatttccaacagatccttttaaggatgttttccagggtctatacaaacaggattattagcgttttcttaaactattcctacactttgttgttgttgattgagtatgaaaatggccgtatgaccctaaattcttccttccttaactaataagatctacagtcagttctttccaaacccccgcacacactaaagttaagcatgatggggcctttttcttttacaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacgtatgtatctatttaaaatttattttacagttaactgtattctataagctctgtaggagatgtcaaaagaccagaggaacccaacagaagaattttgtccttgagtgaagagtgtatataaacttttgagtgtgctagggtcagtggcatatttatgacctggacctttcccttacaccagaaatggcttgaacttacaccccatgggaacctctttctttctggttctgcgtgcaataaatgcctatgaatgagacacatctgattgattcgtcaactcataaaatgtttttgtttgagcggtcaggaaatgtagaggaggaggggggagtttatgaccagcaataaatttatccttaagtagaaatattagatattggctcatggcattaataaatcatgcctccctagttctttttaggtgtaaacttcctaagtacatttagattcatgtttattaaataaaattattcttaaatcaactgcttttaaaaaggcaaagtgtgtcaaaaaggtaaaatgctaaagaaataactggttagccagtttt

SEQ ID NO: 124625 - DNA, 1609 bp, Homo sapiens
gaatcttaaataattgtcttaaatgaaagggagtcggaactgaatctagacacaagcttcaatttagtcagtactttaagcatcacttaagtgtaccagtaacttcttttccttcttctgtccctgtccattgctattttccataaagtgctaaaaggaggaaaaagaaggacatttgagtaattataatcaaagttaatcagaggggaaatcaccgattggtttattttgcatttttccagaatagataaaacatgtttaattttgtagaaaaaaatcaatatttaaaaagaaatattaaatgtctattgtgttaagagtaagaatttaggtggtggctatgtggacattcactgtaaaattattacagtttttctgtgtgtttgacatttttcacaataaaatattggaaaaatacaaaaagttattactttaagaaaccttagaattgttgatatagtttttcatgttgttcatgttttattcttttgaaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttg

SEQ ID NO: 124626 - DNA, 1051 bp, Homo sapiens
tcctgtatttttatttgctaagtctggcaactttatccctgaggcccttttaggagttgcctgagttcaaaaatattttctgataatactaagtgattaattgccatttttcactgtgttgacatttgcactgttggtgcagcagcattgaggagtagaactacttgtatcttagcaagaatcaaggcagaggcaataaattactagtagatgtcacaataaaaaaatgtttaatgccatttgaacttaagaacttcctttatgaagagataaaaattattaattttgttaacccttgaccctgagtacgcacctttttagtattctgtgtgacaaaatgggaagcacacaaaaagtgtgtctgccccatgcccaagtgtgatgaacaatcttgtgtaattgttcaagttggactgagctagccacttttttcaaagacaatatttatttgaaaggaatgacaactatggttatttagaagaaaacagttgatagtgtttattgccaatgaaaaaaattaaaactttcaagcaaaaattgaaattacggaaaactttgtcatcgtgagcatgatggcttctcagtacttaaaatctcttctgattaaatggatggcaacattcacaaatgtgagggccacacgcagcagctcatgcctgtcatcccagtgctttgggaggctgcggtgggagaatggcttgaagccaggggtttgagaccacctggacaatatagcaagaccttgtctctacaaaaaatacaaaaattagcctgagtatgatggcatatgccaagactcttagctactctggaggctgaggtggggggatcacttgagttcaagagttcaaagttatggtgagctctgatggtgccaccacactccagcctgggtgacagagcgagaccctgtctctttaaaaaatttttttggctgtgcacggtggctcacacctgtaatcccagcactttgggaggccgaggtgggtggatcatgaggtcaggagatggagaccatcctggctaacacgatgaaaccccatctctacta

SEQ ID NO: 124627 - DNA, 1022 bp, Homo sapiens
gcacatggcccatacctgtaatcccagcactttgggaggccaaggcaggtggatcaaatgaggtcaggagttcgagaccagcctggccaacatggcgaaaccccatctccactaaaaatacaaaaattaggcaggcatggtggtgggctcctgcaatctcagctacttgggaggctgaggcaggagaattgcttgaacccaggaggcagaggttgcagtgagccgagattgcaccactgcactccagcctgggtaacagagcgagactccatctaacaaacaaacaacaacaacaacaacaaagatttggagggaaaggactttcagctgctctgaagatgcatcaggcattgatcggctctgcagactagtttttacaatatctaatggtaccgaatgtatgagcctgtcattcaccccagagatgaatctcgacaaaacaaaaggaaaaaaaatttttacttctagaaagtaacaccttacacagctcactggtccccagagaagtggacagaggtgactctaatacaactccagctttctaactagccaagcagcttctaaaaagccaaacctgagaccaaaatgggtataagctgcaacagggagaggaaaactcaaataggggaagagagaaccatccccacatgatttcgccacctcctggccttgcatatttctttagccaagattgcacggcccatggctataatcattcttttgaaaatgtgttaacttcaactcctctgtctcctcttcctccaagcacttggctggccaacctgtgctcctgggaggctgtctcctctgcccagcccacctgtggggtggagggctgcagaggaaagtgccctgtgaggttgctgcctgccacctcagtgaccctgggctgcagtccacgtggcacctccagtgggctcagcacctgttcccacagcagcaagtccataccttcaccactgtcttctcatctgtcctctctctgaggaatagcccacctcctgcttcacagagaaaacaga

SEQ ID NO: 124628 - DNA, 1011 bp, Homo sapiens
tggaaaaaccacaatatagttggagatttcaagatttttctctcagtaactcaaataacaagtagaaaatcagtaggaacacagaaaattcaaaaaaacactatcaactagcttgacataaatgacatttaaaaagaaaacactctacccaacaaatgtagactacacaaagtatatggaacattcaccaagacagaccattaaaaagctgtttatcagtaaacttcctggtactagtacgtgtcgcttggaatcttgaaggcattcctgagcctggcattcctttagccaagtgagtagttcagaatgggaaaaaaaaatgcaaaaatctgaagattattggcatcagtgttttcctaataatattgtatcaaatttaaatattcagaggatgtgtattgagaagccaagtgatggctaaaaaatattgactttcaaaatttttctttgattcatttaaagttcataaagacatagggtctgaatgcttgtaatcaaggtatttccaggagacttcctttaaaaaacaaagcaccctctgtttacttgatgcactgaatatattatgtatgtgcttttcaacagtaagaaataaaaagtttctttaaccactgtgaggtgattactaaatgaagaatggaatttgtttcgaatattgatacaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggtaagtcaaaagattcaaaccaaacacctgcaatttcctacttcagtaagtcttgtagatggtaaagccttttagatcacacggctcacgtcatttccacgaatgacagtgctctcattaccaagtggggaggcacctggacttggcaatattttctttagcccaacactatcacttcctaaaccacaagtaat

SEQ ID NO: 124629 - DNA, 1050 bp, Homo sapiens
atatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtggtcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttagtagtggtagaggaaggtttgggggctgtggtgcataaatgagatgaggatgaggttattccaggcacaaaaaaggacaagagcagaagactagaattttgaaaagatctaacaactttgggtattaatgtgtacatagtttcaaagcacctcccaacaa

SEQ ID NO: 124630 - DNA, 1050 bp, Homo sapiens
cctcccttctccaattgtgacaatcaaaaatgactctaaacattaccattattacctaattgagaaatgctgctgtaagcaaagctgccctttgccctggagggaggcagtatctttctgttaagaatattcacgatacaaacattcttggatagtcaaaacaaaaggcagtcagtgtttttgcacaaaagatgtgcagaagtgtgttacccatggagaattgtcaccgaagagaatcctgacaccattagtctctttgataaagttactatcaccagcaatgttatatattgacatatgcctcctgtaggtacactgagaaaggcatagcatcacttctgtggtatttttgctgggatggagtccacagtgatgctaatctgggaaccacacttgagaaccactgctttattcctagagttagccagtgtgtgttgtaaggtaagaataaaagcaaatgaactattccttcattgtatctcttatctgtccctgacaggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcatttcagatttggattgagtcacttattggaaaatacagctcctaaagtccgtctccttggttaggctgctcttaggacaaggcttgtgtacctcatgggcactcctgctaactggcatgcagagactgtcgataagtgagctatacctgcaaccaaaaatcagtacattctacccaaaacttatgacacgctgcctttatcctggaaatgtcatcagaatttcctggagttagcactggctcctgtgcttgacttctctgctcagatttttattaatttaatttagcttaaatgtaaatcttaaccctgtttgtttaatggaatggcaaaaattttaa

SEQ ID NO: 124631 - DNA, 1366 bp, Homo sapiens
tgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgcagcttgttgtgtagtatgttttatttttggttttcaattgaatgggaatgttctgaattttttttcaaactctacgcagatttctgttataccatgtccagccatggtacttaatgtgaaccttgataatactcttgcatatgaactaagaactagagcgttcagagtttttcctaacaaacactttgtttactttcttgtgttactggagtattctggaagggttacagaagtcctcctagaagaatattatcacctcaaagtataaaaataagaccagtgggctatgttttatattattttttaaaatttttgccattccattaaacaaacagggttaagatttacatttaagctaaattaaattaataaaaatctgagcagagaagtcaagcaca

SEQ ID NO: 124632 - DNA, 1050 bp, Homo sapiens
catccaaagaaactgatttgtccagttatacaagtgaatggcaaaaccagattcaaatcctgagtctgattccaaagtgtatgtactcaatcacttcaaaattataaatagctttgaaacccacttacaagttatatgtattagagactagaaacagtttgctttttttccattacagatgtaacaagctgtagatgaaatttttaaaattcctgttaagtgtctgttccataaaaagctaaagttttatcaggagaacgttaaatgccctttataaatataggacaatcctctcacacaaagtgatctgaaagagatgcattactttcactaatagctggcaccaacactcagacaggaaacaaaaggcaatcttctccaaaccttggtcaagatggtcctgctttttataaattagccaaaattcggggacttggaactcctaagtacctttcaacgctttccctttcataccactgcacaggttttgctgaagtacttgccgttttgcctccttttccaataactctgccagcagcaaaggatggcactctgatatgagcttcaagtttcacctcttctttaggactaacaaagttttcttctttaatttttccataaattcttccctgagcctgcagatgaaaacacatcctattagtgtcattcatgtatgaaatggaaaaggtcagttaacttgaaagatggcccaaatccaagtgggatagccctttgcagtgatacatctacatttcatagattgttgaaaataacatagaagagagcagttagaagtcctaaaaggttgacaataactactgcccatcacagtagaggcaactgaatgcttggtgaaagaaggataaaccatattcttctgatgaaaacagttaaaggcaattaataacctaataaaaacgaatttttgtgggcaaatggccattcgtactaaaattgtgataggtaaaacttctcatgctggccatgagacatcagttgcatttttctttcctttttgttggagtcagggtcctcctgttgtccaggctg

SEQ ID NO: 124633 - DNA, 1052 bp, Homo sapiens
gggattacaggtgcccgccaccacacccagctaattttttgttgttattttagttgagacggggattcaccatgttggccaggctggtcttgaactcctgacctcaggtgatccacccaccttggcttcccaaagtgttgggattatgggcatgagccactcactgtgccctgccttttatttttttttatttttttattttattttttttagagacagagtctctttctctgtggtgcgatctcagcacactgcaacctctgtctcctgggttcaagtgactctcctgcctcagcctcctaagtagctgggattacaggcatccaccaccatgcctggctaatttttgtatttttagtagagatggagttttgccatgtaggccaggctggtctggaactcctggactcaagtgatctacccacctaggcctctcaaagtgctgggatagcaagcgtgggccaccgcgcctggccaagacacttctgatatttagagtcaatacatcctatcacctactgcatgcaactatataaacaacctattatatataaacaacctattacatacagcaaagcagaaaggagcctgagagttggtttgacaagctgccagggtaaaccacaaaaaacaatagtacccaacacgcgttcactgattcagaaagctgagctcattttagggcactaccgacaaaacaaaattcatcttgataccctatattccaatgatccttaatgcctcaggccaatgacgtagatattactattacttaagacagtcaaaaagacactagggatatacactatcctccaaaactgaagctcttgaatttgtaaggaaaaatacggggtaggtggtttaccattccttagatctctaaagtaaaacattcatttagcattgtcaccaatcacataaataaaatttaactactatggcttaagtgttacatttaagttaactataaaacatgagttttattagtgaatacagggaaagaactttgaagttcctatcatacaaacatcataggagttgcaggacagtaa

SEQ ID NO: 124634 - DNA, 1064 bp, Homo sapiens
ctcagggacaggagggaaaacatctgaaaacaagtttccaaggcatattaacctggcaggtttgtaaattttaaggtctcaccttagcataggattacaaaccattaagcaaaattaacctttgagagacaggtaaatccagcaaccagtacagaactcttaaaattaaagacttttggttaatttcgaaatataattttgagtgtgattctactcagctcttagataagaatttccattgactctttctgagatttagacatatttaagggagacgccaggttatggactacctgtgcatttgttacctgtggacatagcacatactctagagcacataccttgaactgagcctctggtggtccagtgataatcaccatcctcactttagcatctggtgcttccgctggagcaatctgtaacagacccaacaacaagttatgatactttcaggtatcactgataggcatcttgggccaaccagcctaacatttgcatgtgactggctgaaatgcagaattaaagccttcgtgaaggaaattagggagaggcagcaattcctgtgggttcacaatttaggcctccctcctgcatatactatatgcttattctgtgccgggccctaatggagacctccacgtgctgtctctcagctaatcctcaccacgtcctgatgaagtagtattacctccacttcacaaatgcggaaatggaaggctggagaaattgagttatctggaccatgatcacacagctaacagagctagagggagagctgggtctgtctccattgcctgtgttcactacaccagtggtgctcaaagtatggtccttggcccacttgcatcagggctccttgggcttcctgtgtatgcaacacactctaggaatctctgtaccctaagtttcaaggatactgcacaccacatgcctttgtttgtctgaggcagggtcttactgtgtggcctaggctggagtgcagtggtgtgatcatagctcactgcagcctcaaccacccaagctcaagtgttcctcccacctcagcctcccaagcagctgggact

SEQ ID NO: 124635 - DNA, 1164 bp, Homo sapiens
gtggagctggcgtccttgagttctgttgtgtttgatatgtagcccagaatttcatttacttgttaagaatctaccttgagagtggtagggggctcttacttaatttttaatgcaagcatgtcccgctattctaatatgattaaactttacaacatctacatatcttttaaatccataactcagtgacattttaaagtttaaggcaacagtagagaaaagtgaaattttaaataccactgttttcaggatgactgtatgagatcttcttgacctattaggtaaggtctggtcaacttcttatggtagcttttccttaaactttcctggtattcctactgcatgagaaggtgtccttcctaaagctaatgttaacaaaagcctgatttgtagcaaataaacatgggtgtcctggctttcttttctaacagcaatcagaaacggagactgttcatctgtttatcccagctctatcagtcggtgccatcatcggcaagcagggccagcacatcaagcagctttctcgctttgctggagcttcaattaaggtactgttctaccagctgtggttctctggttctttaagtaagttacagaaatatgaatcttcttgccactttataatttgaatagaatgtaaaagacactgttagggttacataaggatatgaagaaacccccaaacaacagtggcttacaccaaggaggctaacttctctgtgcagaaaacacagttaggaggtgaacatccgggctgggtgttggctctgcccccaccaagtccttggacctaagttccttccaagccaccttccccaggtacggccttggtccctcttggttccagattgacaccattcagtgctccaggaatcaggtctgttgcccagccagtaggagaggagaacataataaagagcttttcttctagggaggtttcttgttagctactgtgggatatttctacctatatttccattgcccagaacttggccagacgaagttgaaggggcaaaatacaggctatgcacagtcagctaaacattttgtaactacagaaggtaacataccagaggacaaataatggtgtctgccgtaatagataactgtgtgttctgaagattctgtattttgatgccttatttaaggaaaataaaggttggccag

SEQ ID NO: 124636 - DNA, 1042 bp, Homo sapiens
tttcaaactgaaaaaaggataaaggatcaaaattggcagcatccttatttaaggacactgcctgaggatagcttttcatacttctgtttgcctcatgttggccagaacataccactggctgtgtctagctgcaagagaagctgggagacaatccctgtgtgagggcagcaatgtgcccattaaacacaggatctgttactaaaggaaaatacatgttggggacagctatttgtctgcttcactggatttggcactattgcctgttaaaggagcctcccagagcctggaagagaggaagcaagcttttaagttctctcaaaaagcagaatctaaattctggaggagaaaattccatattccagattcccattcctgtggttattttcatctaaataaagagaaaacaccattattcagaaaatcatattgtccctggatacaattagagtaaattctactttcaaacagctgctaggcaattttctggcttaatgttcaggggaacaattctttaacaagtgttgtttgagtatataacttcaagttgcagggggtggggggtggttgcaagtactcagttggaatagctttgccttcactatttttagactttgttctttttctaaaccgaaatcactaatacttaactattttgtgtacctagtggtcaccactttttgaaatacaaataaactattgtttttaaaggcagtaaatttcccaaagctttaccagtttctttgcttatcattgcttcttttttttttttcttttggagacagagtcttgccctgtcacccagggtggagtgtggtggcgcaatctcggttcactgcaaactccgcatcctgggttcaagtgattctcatacctcagcctcccgagtagctgggattacaagtgcgcagcaccatgcctggttaatttttgtatttttattagagacagggttttaccatgtttgccaggctggtctcgaattcctgacctcaagtgatccacccatctcggcctcccaaagtgctgggattacagacgtgag

SEQ ID NO: 124637 - DNA, 1014 bp, Homo sapiens
ccttcccccaaagtgtaaccactgttgtttcttctgtttccttctataaattatgcacatatctccaggtgtatatttgtactggatggtactgttttttatttgtacgttgtgttctggtagtaggggtttaggaatatggttttgagtaagagactccatcactgaagatatttcctgaagtgaataaaataagaactattttagaagttaacttctgtattttttctccccttctattcatgcattgctagaatgctggccaattgtcagcaagttttaagctgtacctaacacagtgcttcccagatggtaggtaggaagtaaatgtttaatgagtgaatattgtctttttacccacgaataggtttacttattctaattttatggccacttttctatttacagcacagaagagatccccttgaagattttagctcataataactttgttggacgtcttattggtaaagaaggaagaaatcttaaaaaaattgagcaagacacagacactaaaatcacgatatctccgtgagtgctcctttgcttttgaataagaaaactttccaacactgtaagctgcatgttgtgtattgggcttagcttcccactttacagctgcttcagctagcctgtgctgccgtacttacacatggtttctcaaatacagcttgctgcctgttaggtttctgacccgtattgaaagcattatctgcttctggcaggaggaaccaaatgctttacattcatgttttctaaagcagtcttaactatgttttatgacatttattcccaaagttggaatatataacccagtttattatccattgtcgtgtaacgcattatcccaacatttgacagcttaacacaatgtgaacattaattgctcagctagtttttgtgggttaggaatgcaggagcagcttagctgggtggttctggcttggggtctcacaatgctgctgacaagttgatgctggctgttggcagaaggcctcagttcctcccacatgg

SEQ ID NO: 124638 - DNA, 1125 bp, Homo sapiens
gtaagtctattctggagattatgcataaggaagctcaagatataaaattgtgagtaaagaagattgtcctgtgaaagaggttgatatttgtgctcttgtatttttgacatctctgacacaattcttgggaattgccaacaaacagagggaaatgatatcctgatgagctacagtggttggcactgttgatctggttgtgaagtgtatgtcttttaatatttaaatattttcattcacatttgaacataggcgagtggtgataacggggaagagaaatgcagctatagaagaaggcaacttggggaacctaggaccaggaggtatcctggattaacccaaaacaggagccccaaatcttgactcatcctttactcggagctcattggagctctgttcttgtccactgcctggccccaccttggagcagcagggagtgtggaggtggggaagtgcctaagtctcttctaaggcaaactggagatttatctgggtaatgcaggcgggaactctatttcttccacaggaactttgagtgaaggttgggttctgtgccacgtttagcgtacagaacagcgctgcactgaaagtagaatcgagagtaaggcactggagttagtgtggggacctcattaccaaccttaatttgtagagaactttaaatatgttttagtaatattatatgtgggtgccatatcataagaatgtaattattaaagtaaaaattttaaagaagaattattttagtatagagaaaaataggcctggtgtggcgactcatgcctgtaatcccagcactttgggaggccgaggcgggtggatcatgaggtcaagagatcaagaccatcctggccaacatggtgaaaccccgtctctactgaaaatacaagaattagatgagcgtggtggcatgtgcctgtagtcccagccacttgggaggctgaggcaggagaatggcttgaacccgggaggcggaggttgcagtgagccgagatcgcgccactgcacgcctgcctggcgccagagggagactctgtctcaaaaaaaaaaaaagaaagaaaaaggaaaagcccaccatctattaaccacaatgacattttaaacagttttatatatatatgactggga

SEQ ID NO: 124639 - DNA, 1175 bp, Homo sapiens
tattgcgctccagcctgggtaacagagcaagactctgtctccaaaaaaaaaaaaaaaaaaaaaaaaaaatgaaaaagagagaaactctcccccaaatagtgtggtagaatgggcacactcttttttttggtttatcaccacccctgcctctttgctccaaatcagatcgtaaaccacaaagtcagggactggctcataataggtactgagtgtgattggtagaatttaatactcagaatagtctcttgtaaatggtttagagatatttgtccactggttcttaaaatggttttaaatacttcatattttagaggctgaagtgaaggaagtatatatttctgatgtctcttccactgtggtttggaaacattagccaaggcaagaagcccacttgcttctctcttgctgcttagctattcctaaaccgttagtaaccttatgggttaaacttaaccaagagtttgacaaaatgttttttgtttttctatttttcattaggagatggcacataggttccctttggaaacttgtggtctttttccccactgtgcctgtctcaaaggaaaatgtgtgtgggtggtggtggtgcggggtgggagaggggaggattatgtgtgttgcgggtttgctgcttgtgctggggcttcactcagaagtttagagctagtaatgctgagtagaagagatgggtgttgctttgctaaaagatgtgtcatatagcctgattccttttcccacccctgccccttttcaactttcagagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaagtgagtatgctgagtgtgtggtgggtgttcatgagaattccccttggaatcttagtaacagtgtgtcgttctggtacttggtgcccttctgaacacagccatgaggactccttgtacagtacttgggaatgt

SEQ ID NO: 124640 - DNA, 1053 bp, Homo sapiens
gtaggacagtgatagaagactgaagtgagaaaccgagaatcattctgggccggagaatgtcagcgagccctctgtctgcttgcccaggtctgccttccaggtcctagccctcagtgacctttttggtactagaactgtcacccactccacccccttttttctatttaagaattgagagtagatttgcaaataaagcagtgtataagccggaaatgaccacaccaagcaactagaaagagaccattttatgcctgtttttctttcccacctggggtgaactcagggccattggaacagaatctgagcaaagaacctgagtgacactgggaagtgtggggacttctttctttttgtttttcattttgttgtgcactggggagttaaaaagggatgtattgttaggtgtatgtttatgaaatctgggctatttcgtctctactagtttattattttcccttctgaaaacataacacacacacacaaaatgaatacaaaacaaagcaaaacaaacaaacaaaaaaccccagaaaacagaacacaacaatttggatgaatattacaataaattaaaagtttccagatatgagaaaatacatatcatgtatactcatatatatttacataaaatttttaaataggcagaattaatctatggtattagaagtctgcaaggggtaggggggcagtgactaccggaagcaggtactgttggggcttccggggccctggtgtgttctagttctggatctggatgtgtgtgttcaccttgtgaaaattcactgaaatttatgctcaagatttgggcacttttccttgcatgttaaaataaagatcaagaatgaaaaagaggctgggtacagtagctcatgcctgtaatcccagcactttgggaggccaatgcagcagatcacttgaggtcaggagttgaaaaccagcctggccaacatggtgaaaccccatctctactaaaaatacaaaaattagccaagcatgatggtgcatgcctataatcccagttacttgggaggctgaggcacaagaatctcttgaacc

SEQ ID NO: 124641 - DNA, 1375 bp, Homo sapiens
catttcattagtttcattaaaaatggaagtatgtgtttagtgaatgcaccttttcttgttcctcagagcgagagaggctcacctatttccttccctcttccagagatgttgagataagccagtcaaggacagacattactcatgagaggatttgtcatgtgtgacaaagaaataaccccctagaaaatgtgtagacattgagttcttatactttcttttgtttggggttatcctgatgtttatttttgttagggaataggaatgtttattcatactttgaaacttcaatcattctgaggcaggagaattgcttgaacctgggaggtggaggttgcagtgagccaagattgcgccattgcactccagcctgggcaacaagagcaaaactccgtctcaaaaaaaaaaaaaagaaagaaactatcattgcagttcctttgtatcattgtgaagatctgtataaggtaaatatggttatgtttagaagtgtttgaagcaacttggccagtggctaaaggtaagaaaattcccatttaaactttaacaattatgtaaataaaagatttattttggaaaaagaaataaagcagtgagacaaagggattttttgccattcagggataaccactgttaaatttgccatagagttttgtagactttgtcccatgcattataactttcagaattacaaagatcattctgcagagttttgtgggtttttcattcagtgtatttatactgattctaatctctgcatagtgttggatcctcaccacagtttcctatcccgtcttctgttgtgtgtcatctagggtatttgcccataccgttttgttttgttttgtttttagaaccaatttagtcatgaagccttacatttgggcttcatccatatttattgcattacggtacatccttaaaatcatattacccaggctttcaataatgattgccaaattgtcaacctcttattcttgatacaaggagataattgaatttatgacttttcaataatgggttaaacctcattttgtgaggaccctgtattatatacagggtgatatctgggaataaaaaagaagagatttttagacatggaattttatttattttagtattattttttgagacaggttctcattctgttgcccaggcagacttgggagtgcagtggcacaatcatggcttaatgtagcctcaacctcctgggctcaaccagtcctcccacctcagcctcccaagtagctgggactacaggcatgtgccactacacccagctaatttttttttttttgtagaggcagggtctcactgtgttgccgaggctgatctcaaactgcggggctcaagtgatcctccctccttggcctcccagagt

SEQ ID NO: 124642 - DNA, 1825 bp, Homo sapiens
atccatcccttagttctgcagtccaaagccccagataattttttggctcttttccatcacaattacttagtgattttaagacatattcctgcccttgataataacttgggaaactcaaaatttataattttctctccccctcctgataggtgctggatagtttactagtccagtatggagtggtggagagctgtgagcaaggtacatgtcttctgaattgctttcaaatttgtaaaaggaaggaagtagaaagaaaactaacttttattctcttcgtttttctcttcctctagtgaacactgactcggaaactgcagttgtaaatgtaacctattccagtaaggaccaagctagacagtaagcagcttgaagcttttaatctatatataataactaagttaagtacagtaacatattttgcggatttctcaactgagaagggctggtaggtggcagagagaaactttattttacaaaatttgaccctgtaatcgtgcctttctttttaagtttgaatgtctagtaaaaatctacattggttaaagttgtattacattttcaatatatctttaatgccaataatagagtggtctagtatgaaactgaatcacaccctatttgcagaagctctgggccttggtattgttgccaaataacataaagtctctccccgtctccccctcttgtatgacacatatattatggctattttatctgaagctggtaagttggatcatgtgttaaacaacagtgttaaatgataagtcttcttactcactggttacctgattaccattgtcatttaggagcgtgcagacattggattaatgtaatttgctcttagatttatggaaaaaaatatattccagtgcagtaaacaggcaatacttgacagatcaaacagtctcccctaggaaaagataattctataggctggaaaagatctaataaactgagcactagagagagaaatgggggtcccacaaatatggcctttaacagatctgcccagaatatgaacatgaaagaatggcatacaaagtgctcagtagcacagcactgggtgttagctaactatggaagcctgaactacctacctccagataccatactggcaggagcaggctgactgtcctctgtgtcagaaaggtgaaagaaaagaccacactggctgactctgagccctgaaggggaaaagtaaaacgagctgcaagagtaggagctcagctaggttactataggcagtactcactcaggagggactatgaaagaaaagactgagaagaagatggaaatgtgtataaggtaaatggaactttatttgtaaaatcaataacactcacatggttcaaaatataaaagatttgaagatgcacatagtacaaatcttcctcccagtattattccctaactaccttatctcttgggagataaccatgtggaaaacaaatgctacatgtatgtattcctccttttacacaaatgataccataacatttgaatgttttgtgtatataaatatattttttatagttacatagtatttgattgtacagatatggcatgactttgattaatcgcagtttggatatttaggttgtttccagtctcttgcagttatgaacaatattgtagtgaatctgtttttgcatgtcgtgtgtatgtaagcatgtatccacatgataaattcccagaagtagaactgcactttaaattgtgttgtagagctggagctagtttaaatttccatcagcattgtgggggagtctttctccaattctccctaacacaggactttatcaaactttgccaatctagtatgtga

SEQ ID NO: 124643 - DNA, 1068 bp, Homo sapiens
gcttgaacctgggaggcagaggttacagtgagccaagatcataccactacactccagcctgggagacagagcgagactctgtctcaaaaaaaaaccaagaagagaaatgtctattttcctggcatttttttttttttgaaaactatctaaaggccagtgtaattcagatttgatatttgttttcattttcttcctgattctaaaattatatactccttgtagaaaacttgaaaagtgaaaagaaaaagtctttctcccaatggcaacattattccgtgactaatagttcagtttaatgattaggcatttttcaacatcgttgggtcttgcatgtataattttatatcctgttttaaacatttttaatttttttaaaaatcgaactatatttgatgtcataaaattcacctttctgaagcatacaattcagtggtttttagtatagtctaaaggtttggaagtatcaccactaatcttaagacattttaattactcccaaaagtaaccctatagccattaacagtcacttgcccctcctatcttccagtctcctcccaggccctagaaaccactaatctactttctgagtctctagctttgcctattgtggacatttaatataaaaggaatcatatatatgtggccttttatgtctggcttccttcacttagcataatattttcaaggtgcagccagattttagtaggtacttcattcctttttatggctgggtaataattattgtgtgaatataccacttactgtttatccatccagcagctgatggacatttaggttgtttccattgaatgatgctgctctgaacactggtgtacatgtttttgtgtaaacatagattttcagttcttttgggtgtatacccaggaatggaattgctagatcatatggtaactttttgaagaacaaccagacagttttccaaagaggctgtaccattttacattcccaccaacgatgtctgagggttccagtttccctatatcctttgcctaaacacttgttattatttgtcttttcaattatagccatcctagtgggtgtgaagcg

SEQ ID NO: 124644 - DNA, 1042 bp, Homo sapiens
gcccaggctggagtgcagtgatgtgatctcagctcactgcaacctctgcctcccaggttcaagcagttctcctgcctcagcctcccgagtagctgggattacaggcacctgtcaccacgcccagctaattgttgtatttttagtaaagacagggttttaccatgttggccaggctggtcacgaactcctgacctcaagtgattcacctgcctcagcctcccaaaatgctgggattacatgcgtgaaacactgtgcctggcctgttggtttttcagttaatttttttctttttttgggggggtgggggtagagatggggtctcgccatattgcccaggctggtctcaaattcctgggctcaagctgtcctcccacctcagcctcccaaagtgctgggattataggtgtcagccactgcacttggcccgaggtcattgagttttattgatgcagaaatcactgaagttcttacaaatgttttcgtttttttgtttctttgtgttgttttttattttttggtggtggcaaatggaaatcttggtgccagctgtgttggcccttcactagcagggatcagatgttttggaaagtatattgcgggtgttttatcttgatctggttacttgctttaaatagttcaggttgttttggttaggctttctaatagtagttgatcataatactcagctttctattttggggaaagtttaatttcttattaaaaaaactttaaggaaaacctcagactttagtgttgaaaaaatgagtcacaaagaagtcagaaacatcagtgagggctgctccttatggctgtgaaattgagcaggctgtgcctccagatgccagcctcattagggtggattaatgctaagctcctctgagcttacacccatcattactccatgttcttctttctcagcaaatctgatgcccatcaattctgagcatgttctgtgcacttccagtattccattattgtttaccactacttgaagttgcccagctgaacaaacatttctgacttcagataatttacatggtat

SEQ ID NO: 124645 - DNA, 1068 bp, Homo sapiens
aaggaggcatgtgttggtataaggccagtttgagaccttagaggagacggctgcagttcaacatcagagctgagatggtgctagttcatggctcctgtctcaggcttgacactgacagttgacaacacggtgctctcctgggccttaggccattctgtcaccctccctgagctgtggagctgagctccttccctgtccttgcttctgcctcttcttagaagcctttttgaatttatcagagtgcctactatgtgccggaggagaatttgctgcacaagacaactttgatgtcttatccaagtcagcttctctgaactcgcaaaaaaacagattccttctagctctgattttcactaaatgtttctgaggtcttggttattctccacataaacctggagacatacttttcattaaaatataaggcagaggtatggggtttctgggtctgaacctcagaatagtcgaatggaagacagggtagggactttgagggcagcttcttactggctatgagactttggataaaagtgacaaccatacagagtccctttcccatctgtgaaaatgggattaacaaaaaaaagtcctttcagggtcaatgtgagaaccagcgaataagacaagtgcctcgccctgctgcactgtgaattaactttttttggaggcatttgtcctttggctgaaattcacatgctgtgtgctccagtactgtgaagtactttacttcctcaaccccatccttctcttagcttcaggactttttgcatacattttctttgccaagaatccatttgctcttttttttcccccccaacagtcttattttgttctggatcctttccatctttctttattctcaccaattatttagccctcaatttagacatcattcctaccacgcttggattagacatctctcctgtatttctcccatacttaacactatggtagcacttaacatgtaggcttgcattatctcatgtattttttttttcttcagaaaactaggtttattgctacacaatctgccagtaattccagctattttgggtgatttcattatttgac

SEQ ID NO: 124646 - DNA, 1064 bp, Homo sapiens
agagggtggtgcagagaaactgcttagcttttatgtatctctaatataaaaaaaatcaagactaactagttttgtgtgttttagactagtcttctaaaatgacatttgatgagtcactaaatcataacccccatcaaaatgcaaagtttggttaaaaggttagtttggtgggaagttgatctaagtctgattctccaaggtttctcagttggtcacaggtgatttgtgctgagaatatttatcttcagaacagtattattgagattaagctttgcaggaaggggttggtttttggtatatgctgaatatattgcaagttatataatgcactaaaaatatactttatagatggaaacggtgggttataagattaaactttttacatgttcctgttttagattaacatttatttagggaattcagtagcttgtgggataggtcctcaagtgttgtaatagcaagattactagttcaatccccttattttaagatgagccatattaaatatgatttaaaatgtaatttaatatgattttttttgttcaggagctacatctggtatgatgtagctttctatgaaacagccaaatggtagaaaccaagtttaagtaaattattagagtactagcatatctgctatgggcagagtttccttttaattcattcataatctcttcaaatttagagaatttagcttttagtttattgcattttcccttattctgggtatttgccgtatctaacttttcttaatttttgtatttcactttactctcctcattgtcctttgaggtagtgtcaagttagtggattatctctgttttcaaatgggcaaatatgggcacgcaagataaagttaattaagcaagagcacatactgaatcgtaagatgcttggaactagactttggaattcttcacctttgactccctttaaaaatttaatgattatttacatattgatcaacaaaaacaattttattgagagttcgttaggaataagatgggctgctgctgttaggtgtttctttccttaaaggcttgagggaacactatttccttttt

SEQ ID NO: 124647 - DNA, 1801 bp, Homo sapiens
tactttataagcatgggtctggctatgctcccaaaacatttcatggagttcacagctgttcttagggtatcctctgacagggtaattaaggcaaattgtgatacaggactaggaatcttataataaggttgactgagcccatgtaatttttttaaggttagctgtggcaagacaatcaatggtgctggttaaagctcctggtattatatgatttttgttaaagacatcccaagtgatgtaatgaacctttggagaaaaatgtgatagacacttctgtgtgcacgtactactacctaaagttggggacagcagtacagcacagtggtaagggtgggccagtggcatcttgcttggagctacacaggcctcagtaggaacctttgcttagccctgtgatcttgtgcaaactgattaaactctgagatttctgtttttaaaatctgtaaatgagggtaataagacctatggcagagggttgttgggaattaaatgataatgtctgtaaaggacttcttggattatctggtactaaagtgatattgtctcactaataagtttgtgtgtttaccatgtggtagtggaaaatgggggatgggtgtgcctattcccgtatgaccccgtggtttatggtttatgtttcatatatacggagacataggagtgtttcacatttctttgtaaaatatgggttatgcactgtgaataagttaagaattggtgctttatatctaggtgcatggatcttagaatccctaaaatgtgtttagttatggaattatcttaggagagatcatacgtaaaggaaataatagaccaggagatgaattcctaattccaaagaggtagaaacagtataaaaatgaacgaaggatgagaagtggcagttcagaagggcacagctgaaaagtcagtctgtgtacaaaaagatatccaatctaggctgggcacggtggttcatgcctgtaatcccagcacttggatgaatcgcttgagctcaggagtttgagaccaggctgggcaacatggcgaaaccccgtccctgcaaaaaataacaaaaattagccaggcatggtggtgcgtgcctgtagtcccagctaactggggggctgaggcagggggatggcttgagcccaggtttgcaccactgcattccaagctgggcgatagagtgagatcctatttcaaagaacaacaacagcaaaacaaacaaaaaaaacacccttgtctaactagttattagggaagtgccaacgataatgacattttctgcctatgaggttggagaaaaatgaataagattggccgtatctggtgttggcaaggttgtggaggcatggccactcatatagctaaagagtaaattggcaaagacttcttggcacactatttggcagtatctattagaacttaaaatgagaatacctttcaactaagtgttatggaaaacaacccagtcctcatggctttgtgtaatctgtaagcacagttttaatcagcaatatcgtacaatattgtaaaagagctccatccaaatcgccaagcaggaattggtaaaaagggtctctagtaggtgggagtctgtaaaacacagaattcttaggttatactatattacacgtcacattttaacagtatcgtacagataatctgaaactaacactgttgtctacttttcgagcaaaaaagatctctagctctaattttactgtttgggacattttgcaattgcctatctttgagttgtagaaggggaatttttgtaaaggaagacaatactgagagtccttccttttttcttctt

SEQ ID NO: 124648 - DNA, 2368 bp, Homo sapiens
ctttgctgatgtaactggccgtccttgtaacctttctccaaatgataccttattgttcagaagaagctggagtttttttttcctggcagagttgactgatcttaccctaagtgaaaatggaagctgctagtcttcttaaaggctgggctcagaattggcacattacttctgtcacattctattgattaaggcaagtcatcaggctagctcagattcaggggagatatggaaatagactccatctttagttggtagagtggcatgcatgtaccgagagaggaattgatggtggctatctttgtatgtcatcttccacaaattgaaggaagggtggagtagtggtttcaaaatgcttgcaacagaaaatacctgaaaattgcatttagcacagttgtaatattccggcaggagatgatatgttactagctttggaggtaatgagtagtggctattctctgtatagctgtaaggaacagccaacaggatttgctgatggattagctgaggagtatcagaaaagtgaagaattgcaagattttttggccagagcaactgggtggaagatggtgccatttaccaaaatggagaatattgggagaggagcagattcttgggtagaaaataggaactttggttttgatatggtgtttctaatacttactagaaatttaagtgaagaaggttagtaggcagatatatcaatttggagctcagggggagatgggacatagaagtgacatttggagacttcattagcttgtggcatttgaaaccatggaattggacatgatcatcaagggactgagcctatggctgtaggatgaaggaaagaccagcaaaggagggtgaggaaggacagtaaagtagaagaaagcaagcagggcaaactgtttctgggagataaatgaagaaagcctgtggagaaggagggtgtaatcagctgtgtagaataccaccgagagtgatgtagatggatgaataagtgagtgagggtggtgttaaatctcggcctggctctgctgtaaatagaaggagaacgatttacaaattttggagcaacctgggatgtaacctttctttcagaattcatttattcaatttttgttcactttcttagttttttatttatttatttatttgagatagaatcttgctctgttgacaggctggagtacagtggtgcgatcttggctcactgcagcctccgcctcccgggttcaagaggtcctcctgccacagcctcccaagtagctgggactacaggtgcgcaccaccatgcccagttgatttttgtagtttttagtagaggcagggtttcaccatgttggccagaatggtcttgaacccctgacctcaggtgatccacctgtctcggcctcccaaagtgttgggattacaggcgtgagccactgtgcctggcattttcttagtttctagaaatatctgagtacttatgtatatgttagagatggaagaatctcctcagtagatcctctgactcaatggacaaggcttgtctgtgacaaatgacgattgatctactctttttttttttttgagatggagtttcactcttgtcacccaggctggagtgcagtggcgatcttggctcacttgcaacctctgcctcctgagttcaagtgattctcctgcttcagcctcttgaatagctgggattacaggcacccgccaccatgcctggctgatttttttttgtatatttagtagagacagggtttcaccatgttagccaggttggtcttgaactcataacttcaggtaatctgcccacctcagcctcccaaagtgctgggactaccgctcctggccagttgatctactcttgcacttttttaacatttctggtgagtgtgagctcactttcgtttttgttttttttttttttttttgaggcagggtctcgcacggttgcccaggctggagtgcagtgatcacaggtgtagactacaggcacctacaggcacatgcctcctcgtctggctaattttttttttaatttttagtagagacgatgtcttgctgtgttacttaggttagtcttgaactccttggctcaagcggtcctcccactttggcctcccaaagtgctgggattacagacgtgaactactgtgcctggccttcactttcttacaaattcattctgctttcttattaacataacattgggaaaattgtctgaacctatcttaggttccaaaagagtgtagaccaagtccagttcttcttcttttttcgagtcagaatctcactttgttgcccaggctgaagtgcaatggtatgatctcagctcactgcaacctcctcctctcaggttcaagtgattctcctgcctcagcctcccgag

SEQ ID NO: 124649 - DNA, 1021 bp, Homo sapiens
tgttgtttttgcctgtgtacctctttcatgcagttagcaagggggaaatgatctttgccacgctttgaaactattatgagcgacacaagtttagttaatgtgtggttataggattgggattttgtattaaagtgaagctgtcaaactaccttcatgtatttgaagtgactccattataattgtttttagcagcagcatccaggcagcaacttttctagcaataactaatttttggaaggtgtgagttatccattcagtaactctggtggttggtttggtctgggaggaaggagaggcggaaagacgagatggttagctgtgctattcttagctgagtttcctttatcaactgttgcctctgattcaagcttccagagtcataagacaggaggtggcagtgtggtagcaatgaccaaggggtaggattggtattcttagttaagatctcagccccataaatctgatgttacaaattggcttggattgccagaattttgcttgaaggctgatggcaagcatacatagttttgagtgttccattaaaattaagggtgtaatgtatcatggtctgaaattgctgtttggcaagtattcagtattggtaaataaacacagttctaaatattgacatattctgtgaattttgttgccctgaaggggactactttgtagtacataaactatagatattttagagaattatcctgagaccatataacttgattaggaaatagtttaaagttattgtagaaatatccttgggccaggcgaggtggctcacacctgtaatcccagcactttgggaggccgaggtgggtggatcacgaggtcaggagatcgagaccatcctggctaacacggtgaaaccccgtctctactaaaaatacaaaaaaattaaccgggcgtggtggcggtcgcctttagtcccagctacgcggtaggctgaggcaggagaatggcgtgaacctgggaggcggagcttacagtgagctgagatcgcgctactgcactccagcctggg

SEQ ID NO: 124650 - DNA, 1084 bp, Homo sapiens
ctggtgctggagaatgcacgctgagatggatgaatgggcttgcactgactaaacaggggagcaggcccaggaggtgattggaggcttggcaggctggcctggctttgacttccagtggagcttggggggggaccctttcaggaagtagtaaggttgaatttggttcagaccaagcttagctcccaattactgaggtctcaagggaatgtggaaggaatgtggcttttctgcattcagatacccctcagttggggaagattatagcagttactttacagacattgaagtctcctgcagctggactaaagagaagattgcattggatatctgtgatagtgttgcactctctattctaaatataaaagatacagaacatgaagactttgactccgaagtataggctcaacttttttccctccaccttggaagtaagggtaggtgtggaaaatagttggtacttggaaatgttgtagctgtgtttggttggaagagctgctggtatcctgtggggccttgtttgtgcccctatgtgattatgtaaatagcactgatgtccttttttgttatgttgtgggctgttgggcatgggagagggaagaggaaaattgctgacactggggaactgagaggatggtggttttagttcaatttccattactttttaaaattacgaaaataatttttcatatgttcagttttttagaacctaacctttttgttgttgttgctgcctcctatgtgatgaagaacctaagcatatttttattaaacttcctcatgatttagcggttggcattgtttaggattatgtgtaggaaaaatacatttgaagaaaggagaaaaaaataataggatattatagttaatatttttctaggcaggatcctttacctttttcttcctttcagggtaggattttttctatttttatttttatttttatttttatttttatttatttatttttttttaagatggagtctctctctgttgcccaggctggagtgcagtggcacgatctcggctcactgcaacctctgcctcccaggttcaagcgatccttctgcctcagccctcctagtag

SEQ ID NO: 124651 - DNA, 1051 bp, Homo sapiens
gtctcccctgccgtccccgaccctttctcgccactccctgtcttcctcaagcccaccgctgagtgttcccggcgggtctgggctgaagcagagggcagggccagggcgccccctcctgaagaaagccaggggagccccctgccccgagtctgccctgtggagcgtgtccagggcggtgagagggtgggccgcgtccctcttgcgggcctcgtggtgttggtggcccccaggggtgggtgggggaggcttggagactggactgatacccaagtagtgggcccgccagcggaccctgctccccaaccatctgcgagttaaatgcccacgccgctcgagggggtcggcttctccctccgcctggagccgcgtccgggcctcgggggcccttcgagggcctcaggaggccatttgtgtcgccgcttgggctgtgcgggtcttcgggcagggagagccgctgaactcggccgaccgtctcacttcttgtgtgtccgcaggtaaaatagaactgcacgggaaacccatagaagttgagcactcggtcccaaaaaggcaaaggtgagctgctgcttctgtttgccccgattctgttctcactccgttattgggtggagagactcagctgagaacttcttgtcctctggtgcttaccccctgccgtgtggcgtggtgttccggtctttaatccttgcttttaagtttatggcgggggtgtgtgtgttgatgatgctgggcaggaattgaaagcttttctgtggcctctgccgcgggattatggttattggttacaaaatctctcgaaagctcacagctgaatgtcctcggtccgagcgggtcaaattgctcctacgggaaatgggtcccaacaagcagtttggggggtttgcagggcttgggaagcagcggatgattcccccacccctccaggagcaggagaggcgaaagcagctgcggacacgcgggggtccctcctttccttctctgtccggggttgggaggccgtgggcgcggccgagtggagaggaatttgcctctgccctgtgagctcgccagg

SEQ ID NO: 124652 - DNA, 1011 bp, Homo sapiens
cgcgtcgcccgcctgtcttgcccccaccccctgcccccctcacccactcccccacccctcctcgcagcatttccgtccatgccagccttagaaacgtgcctgcggctttgctggggttacacttctaatgccattaaagccaccaggcgagttcgggattgtgactctggttttgttgttaataacctattttgaaaaatcgaatgattaaaactacggtaactagcgctgaggaactgcctgttagtacctctgcccatttcctcattaaaaaaaaaaaaatcaatattccagccctccctcccaggatccgcccagaccagataaccctttacaaactcgagttgtgaccgtcagcgccccgcttggtgccggctgcggttcctttagcattttccttcttcctcctcccccttctcagagtccctctcccaatctcgtttcccctccccctcttcctctcgctcgcttttttctccgaaacccactctaattgaggctctgggattcctcacgtgagacgttgatttgtagtttgaacacgtggctcattcaaaaagccggacactcggagcggattttttccgcctcctgcgccttcctccctcctcctcctcctcctctcccctccctcctgccagtcacccttctgggttttttatggggaggcggcgcctgcctcacgtagtgtgatattttcacagtccgctggccgaagccaaaggggttgggaaggaagagacaaaaagtagttttttcccctcctcctcctcctttctcttgctaatcccgcctcctcctaagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtggg

SEQ ID NO: 124653 - DNA, 1363 bp, Homo sapiens
gattaccgatacaggtaatgttttaacttgagctttctgttctaaattagatgatagtagtgttacttggcacttttatgttggatacatatgaataaaaacttgatttttaaaatagatcatatatgacgcctttgggagcagaagttagcagtctgtatatgtcagtattttgttgtgctatatacttttctggtctcattggcagaaagagaacttaatattaagtagttatcaccttaggtacattattattttgaatgatgaggaatttttattttcatctgcctcagtggagtgattatatagtatgctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggtggaaggtggcagttaatagttggaaaaatatgaggcaaattaaactataattgttaactttttttttttttttttttttttgctttttctcttttaggacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaattt

SEQ ID NO: 124654 - DNA, 1062 bp, Homo sapiens
tttttgtatttttagtagagacgaggtttcaacatgttggccaggatggtcttgatctcttgatctcgcgatctgctcgcgtcggcctcccaaagtgctgggattacaggcatgagccaccgcacccggccacgattttattttatagcaatagtgggtttttgttttttgttttttttttgttttttaaaagaagatggggccttaacatttttgtaaggttaggtgaaaagggtgaatgtagaggggcttgactgagaagagtggaagatgtagtgacttaagtgaaccaaaggaagaataccctttcctcagaagcaaggaggaaggacctgagaatagttagggatatatgtataccttcttggaagagggaaggactttagccattttgtttcagtatttttacctaaatgtatttctctcaaaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggtacgtggtttataaaagttaatgaagacttattttctcttttatgtgtttagtcatggcatatcttgcttttaggggagcttggccattgtttagaagtgatactctggaaacatccttaataagctgctttagctttcaaagtaaaggaaatgccaccatctttcgtaagcttaccatgttttatgacaaagaatgcaaaggaagtatattttcttttttttagacaaagtcttactctgtctcccaggctggagtgcaggggtgcaatttcgactcactgcggccttagcctcctgaatagctggggttgcaggtgtgcaccaccacacccagctaatttttgtgtttttagaaatggggtttcaccatgttgacccctctggtctcaaactcctgacctcaggtgatccacctgccttggcctcccaaagtgctggggttacaggcgtgagctaccatgcct

SEQ ID NO: 124655 - DNA, 2245 bp, Homo sapiens
aaattacttctgtgaaattgagataattatttacactgataatcaaggcttaactggacacagaaaccaagctgtccatcctgttttgatcataagtgcctcatatctgtgcagttaaaaaaaacaagcttatgatcagtaagttattttatttggaatgctttgatttacacccaattttttcagaaacccatcactttttggatatagaatatagtcactgaagggagtaccagtatacataaatgcataaattatgtaaaaactgaacataattctaaagagatggaatcaaagataaagactatgatataaattttgtaccttcttgcacattgtggtatgtcgtggataatagagcattttaaagtgatctggttgcaaaaatgtgtatatcaggaattaataagctaatggggaaattttaagaatttcatgcttattagttttttcggtatgtttgtcttcagaacatattttaagtcagaatgagcaaagatagtagtcaaagttgggagaaggtgtaattttactgatttttttctttttgacttatttgaaccttgacatgtgctatgggtgagtttagataggtgtgtacaaatatttcagcctgggatgccttgctctaactatatcttgatttcttagcatgacttagtgaaagcttatttttaagaatcttcagattataaagtagtgaaaatttaacacttaggtggggggaaattatagttgttagatttatatttgaattatattaaaattgctcacattttaggaactagaatgaaacatgggaggagggtgaagagtatggtttaaaaagcatttagagaaatttagtaaattctctttgttagaaactagagttttgaacaattttaaagactataaaattgttttttttttttttttttaaataaactagttacttgcactttacctgctggcttttccatttggtagataacattctgaactccagcagagttttataatccccacgtgcttaaatatactaaatgttctttttccattaaggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgtatggtttatgttccagtgtctgtatgatcaagttgtagatgaatttgcatgattacttagttaatagagaattggtgatctggttcaagtagggaattattgaggacagttagcagtattaacagtgggttattattgagctgaaattttttctggagggtgttgtctaaccatttgtttttcaggagcaatcaatataaataattacggtactttaaatgttaggtgttaggcatctacatgaccagtgccatttgtaatactgtcttctttgttaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtaagtgtgtttaagataatacttaaaatattcttctggggtttttgaggacaaagcagttgttggctgcattttgtgtagaaatttcacgaaagactcaaaattatagtttttctcagactgctctttgtaaatgaatactatatcccagacaaagacttggaagtatggcttgagcccaggagttccaggctgcattgattgcaccactgcaccacagcctgggtgccagggagaccctatctctgaaaaaataagaaatcaatactaaaatcatctcccagcccaattaatatattggatagttgcaaccagtacaaattatgtgtatatagccatcaatttaaatgtgtttggcatttgataattagtgtctggtttctatgccaacaatatttgcacaacaaaaaggcggttttctgcattggagtctcacatgtaatttaatgcagagaaagttgatgtgtgtatgcta

SEQ ID NO: 124656 - DNA, 1021 bp, Homo sapiens
caaccaacagcagggtcatcttgataataaagaatagtttaaacaagcaggccgggtgcagtggctcatgcctgtaatcccagcactttgcgaggctgaggcgggtggatcacttgaggtcaggagttcgaggccagcctggccaatgtggtgaaaccccgtctctactaaaataaaatacaaaagttagccaggtgcgatggcgggtgcctgtaatcccagctacccaggaagctgaggcagaattgcttgaacccaggagttggaggttgcaatgagaagattgtgccactgcactccagcctgggtgacagaaaaaccaaacaagcaaataaacatcaaaacaaaaacctgttaaagcaggttgtgctgtgagaagaacttttctgcctggcttctgctttatagcctataagatagactggaggcctatttaagacttttgttaaaattcatgatacgagttgagttattaatctgcccatttaaaccgggcagtgtatttttaatggttattggatgcaggagccagattactgaggaaatggtaggattccttgactggacagctttaagaacaagtagtctagtgaaacagggcagataccacccattcccagcaatcttttttgtttgcaatttcaattcattttccaaattgtggatagttttatgaatttctttgagaaaaagttgaaattatttcataatgaagacgagtcagagagaaaaggattagcctagcatttgtcctctttatataaaggacttcttatagcctgattcctaatgcagagttcagtgaaagtgacatttatttggtaacagcttttgagaaatgttactttatttctaaataattatatacttggcagtttattcttccagttaagtttactaatagttactgatttgttaatataagtttgtaagttgtttttgaaagttaaaatgaagctgggtgtggtggctcacacctgtaatcccagcgctttgggaggccaaggcgggcagatcaagg

SEQ ID NO: 124657 - DNA, 1168 bp, Homo sapiens
aatttaagtactatcatttatctgattttaatgctttcagttgttctcctctccccttccatttaagcaaagaatttgtaaacttaaaaaaaattaaaatctcaaatttttatatttgaggttctttcactgaaggatgttgatctgctcaatataagtagagggcaagattttgaaaaggagcagtgcaagtaattatacccacagcgcataactaattttacagatctgtcatagaggcttatactttgtaccactcattaaatggaatatagaaccttgagatctgaaagaatgtccagggatttaaatatttagggatgtgtggtttggaaaacactttgtctgtgggcttaattttgtaaatcaaccaaactctaacctacgatgtagcatgtgtattataagaagtgtgaaatgtcatcaataatcagcatagtagtttcctagaacttgactggcagaaaactttctttgatagtatcagtgggtgctcacccattagataactaaaagatgtgtattcacgtgctaatgaattaaaactgattgctatttgttcatatgtcctcacaaatttagcaagacaggcatggaggtgaaaaaaatagtaacaactagatgagggaaagattgtatacactgaagaaaagttgagaggagaatactaaagggaaatatggtttcccttccctccttttaagttacttatatatatagttatatataatccttactgtcccatgactttcaccaaagatggagtgactaggcctgactgatatgtagaagaaaagttgtgatctttccttgaaaccaggaccctatcatctgacttaccaagattcataaatactgtataactccagaagattagaacataatgttaaatcacattagtccttacaaacttgttttttctacctttgaaattgccacttatacattagttttttgaacattacaattgatcaggatatataagctatgagacttatgaaccacgtttaaaatttgtacaaaagattataaattttacaggtgatttcacaattatggcatgagtttaaatttgattatatgtgggtgtcagttactaaatcatgtatttatgataagacttctaaattttagagaataaggaaacatacagaattagaatatgttt

SEQ ID NO: 124658 - DNA, 1579 bp, Homo sapiens
taattcctcgatgttgggttttttctcttctttatatctcaacttttaatgctcttcttcctatgacctttcatctaaaaactgaccactcctttacaggtttttacggtaaaaaaaaaaaaatctgtctttctttaatcttacatagctgaacgaattcattggctcagtatttttaagataactagtcagtatatactgttctgtaacttaaaagatgacctgaaaattaacaggccctctcccatttctcttctcactctatcccccaccgaagagggctcagaaaaaagtttttattaatatatttggggtcggagaaatacaaacatcacaaagaatacgatatccccagcttaaatgtactggaacgtttgtcagtgagtttcatttccaaagtttaccctacatagggaattgtagaagtgagttagtagaagtgagttcgtgtgaaaccctggaaagaaaacaaaagccccatgcaacacgttccgggctgttgtgtagatgtttattctagtcactaggggaagcacataaaaacacctgaggtgtgtgtgctgaagggcgaattttgtccttttggggagttcatgatataaacatctagaaccaaaaagtcaaatcagaaggtcagtttaggctttagttctctttgaggaaagatttaaagcaatagactataatagttacccggtagactaaaaaatttgcctttaattcttttgattggaatttttttttacaaagtttggagcatggaaacaaatgaaaattgaacctgcttattttttaggatggtgtattgatggccccaacagaactttctaaaatcatgcgataaacatatatgatagtagttgtaaaatgcttcttgttttgaaaatgttgagtaattatcgatagaaattttgctgtccattcatacattccttcaattaactttcattgttaaaaaattgggggattgatgtttggtttggtttgtggggagtgaagaggactactggagggaccttgtttgcttgctttttttctttttttaatttatcatcaagtctaggaaaggagtaagttgccgacaattgtcacttttccctcctaagaaagtaacatgttaagattcccacctaccagcctgggtgacagtgagactcccgtctcaaaaaaaaaaaaaaagattcccacccacttttaagctaaagtatatgtaggcattaaagatttatttaatagaaataaagggccctcttacggccctttgtggtcataggaaatatttttttcacaagtggtacccaagtgtattttagtgtaaatcaactagtgcttgtaggctcacctgttgtatctttttatttttcgtcttttagtttttataggatgagataattgtctttatttgtaattggttaaagaattagaacaatgcgagaagcttgtctggagatgccctttttaaaatcgtttctggccgggcgcagtggctcacgcctgtaatccaacaatttttgggaggctgaggcgggtggattacttgaggttaggagttcgagactagcctgcccaacgtggtgaa

SEQ ID NO: 124659 - DNA, 1105 bp, Homo sapiens
gcagtgatcgcttcactgcacttcagcttgggtgacagagcgagaccctgactcaaaaaataaacaaacataaaaaaacgcttccaatgttttgttcccttacatcagaatccacttggacaatatttaaaggggctaaggtcatataaggctcatctggcgactgaaaagtcttcaaagaggttgacgcgtccgaggtgagtctgaagtttggaggacagcacgggaccgcgattccaaggcgcccaggttgagagcgcaggccgcccgccaacctccaccctcgctccaggcccagccgacacaaagcctcgcgggaggtggagcctcgtgacgtcacagagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggagccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggc

SEQ ID NO: 124660 - DNA, 1050 bp, Homo sapiens
gtcagttataagttacagaaaattagtcctaaatcaactggaagtgttcgccagttactacgtgaaaagataagagatgcttatacacatccacaatttgtgactaatgtaatgaagcctctgcaaattgaaaacatcatcgatcaagaggtgcagacattatcgggtggtgaactacagcgagtagctttagccctttgtttgggcaaacctgctgatgtctatttaattgatgaaccatctgcatatttggattctgagcaaagactgatggcagctcgagttgtcaaacgtttcatacttcatgcaaaaaagacagcctttgttgtggaacatgacttcatcatggccacctatctagcggatcatgtcatcattttcgatggtgttccatctactaagaacacagttgcaaacagtcctcaaacccttttggctggcatgaatacattttagtctcagcttgaaactacattcagaagagatccaaaccactatagaccacaaataaattaatttaatttaattaaggatgtagaacaaaagaagagtggaaactactttttcttgattagattgagtctgagaatattgataagccacttagtaaaaggaatatttactagaatttttgtcatataaaactcgaatcaggattttatgccccacatactctggagcttgaagtataatttacttaatataacatcaaagccagttgggttctaaattgtagttgaaacacagaaaatgccactttactgttcctgatgaggcccttttgtgcctaatattctaaagacatttcaagctatacaaattaccttcaagttttcatgatgtatgggaagattttcagtagatgtattatattcacataccaaatgctgaccagtgttgctccattttttaaatcttgaaaagggtttctgtatttacctggtttgccaagtatgccagtgtaacgaaactgccctcattttaaaagccagtcaaagattccactgattgacatttgataaataaacatcaggattatgtttattattt

SEQ ID NO: 124661 - DNA, 1035 bp, Homo sapiens
gctattgtcaatcatgacaaatgtaaacctaagaaatgtcaacaggaatgcaaaaagagttgtcctgtagttcaaatgggagaattatgcatagaagttacaccccagagcaaaatagcatggatttctgaaactctttgtattggttgtggtatctgtattaagaaatgcccctttggcgccctatcaattgacaatttaccaagcaacttggaaaaagaaaccacacattgatattgtgccaatgtcatctaaattaacaggttgcctatccctcgtccaggtaaagttttgggattagttggaactaatggtattggaaagtcaactgctttaaaaatttttagcaggaaaacaaaagccaaaccttggaaagtacgatgatcctcctgactggcaagacattttgacttatttccgtgaatctgaattacagaattactttaccaagattctagaagagaacctaaaagccatcatcaaatctcaatatgtagaccagattcctaagcctgcaaaggggacagtgggatctattttggactgaaaagatgaaacaaagacacaggcaattgtatgtcagcagcttgaattaacccacctaacagaacgaaatgttgaagatctttcaggaggagagttgcagagatttgcctgtgctgtcatttgcatacagaaagctgatattttcatgtttggtgagacttctcgttacctagatgtcaaacagcatttaaagcctgctattactatacaatctctgataaatccagatagatatatcgttgtagtggaatatgatctaggtgtattagactatctctctgatttcatctgctgtttatatggtgtaccaagcacctatggagttgtcactgtgccttttagtgtaagaaagggcataaacatttttttggatggctatgttccaacagaaaacctgagattccaagatgcatcacttgtttttaaagtggctgagacagcaaatgaagaagaagtcaaaatgatgtgtatgtataaatattcaggaat

SEQ ID NO: 124662 - DNA, 1048 bp, Homo sapiens
ctgtgctttgggagccttctcattctcatttgtttgtactgaggaaaataggaataaggaatttgttgactgctcccgagattctggtaaaagaagaattctaaaggttttgttggaaggaaattggaaccagactttgtacttcctcctctttctgaaatcagatattaccccctcattattctttgacctcacacctcaggcagatgttccaagacacatcaccattttttttttttcttcatagcagtttatcacaaactgagataacttgtttgtttgcttgtttgttgtcccgttcctattaaaatagtatccagaaaaacaggaatcctgtctttcatatcttgctttacctttcacatctatggttcctggcacatggtaggtactttgctattgtgaatgaattagtgaacaaatgaatgagtaaaccaagttctttcatgccttaaatagaactgcatgtagtaaaggttgtgtttgagcctaggcctttatgcactgccccccaccctccacctccaattcttttttctggaagtgtgttatcactatgtttactgatcatggtgaaggtctctacctttagaagactttgtgtttatctttgttttacttcatatgtttttatcttctagttttttgcctgtataaaaactaacatataagacttccgaaatccttcttgtagcaactttataatactttgatttatgtgaatacagtttacttgaaactttaagagccagcttaataatttagtgaatagttcaaattaggcatcttcaggatcattgtcctaaactgccattactattttctggttacattcttttaaagcaaaaaagaacaaaacttcatttaatacagtttattccgtatttacaaacacaatctttctaggggaagtaaggaaggtagtgtggtgtagagaaaaccctagacagtgagtcaggacctgtattctggaccagtaggatttctgccattaactgggtttcatttttaggcaagacacttaacatctctgggcttcagtttcttt

SEQ ID NO: 124663 - DNA, 1032 bp, Homo sapiens
tgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacctacaaagtattacagtcttttttctttaatgttggttgtgcatttaataaatgataaatggttaaaaggaatcttaagaaaaattcggttttgtttcaattccagataacttttccaaaagagaaaaattgaaggttacccaatagtgcctctcatttgatactagggtaggagagtctgagtgcagagata

SEQ ID NO: 124664 - DNA, 1057 bp, Homo sapiens
cgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagt

SEQ ID NO: 124665 - DNA, 1033 bp, Homo sapiens
gtggagtctgtgaagggggagggggagatttttccagaggcttttcttctcgttccatttctcttttgtgccccacgactgggttcttgaatgtaaaactctcagaaaggtcagggcggagcctgttttatgccccgaggagtatcttgcccacccgtaaatgctgacagacagctgcgacttcggcccaggagacccggcggggactgggtccgaccagccctctctcgcgggcgcaggtccgggacccctgaagcgagccggccgggcgcagagcgcagtcagtctgggcgctcagaagctgggagggggctccacctgggcgcccagccgcggcgggaggggcggggcccggctttccggaggcggtggcacctcctcgcgcccgagcgcgcgctccccgacgtccggcgcacgcgcgaggccggctgggagcgcgcccaagcggcggcggcggcggcggctggaggaggaggaggaggaggaggaggaggaggagggcggctgaggcgcggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggtgagttaactggacccccacgccgctcgggtaacggtcgcgccgcgcgccgggccggccgggggcgccctgttgctcggcgcggcgcgccacgcggggaccctggcccgccccgcccccctcggcacctgggcttcggcgggcgcggggaagagggaccggcaggcggcggcggcggcgccgcggtcggggaggctgctggccgcccccagcccggcccgcgcggaaggggcgctcggccgggctcctgcctctctggctgcgggcggctg

SEQ ID NO: 124666 - DNA, 2167 bp, Homo sapiens
aggggaggaggctttctccaactaccgccgctacttccgaggtacgagactccagttgtttggccaaagtggctgtgggccgagcacaggctgccgcgggggcgttcgctgctgagatcgtgctcgcggattctcggtacgtttgtctgaaaccaaataggtgctggggcttttttattttggctgggtggagggtcagcaggggagtcgattgaggtatccgaccgtgtggtgacaggatgtggattggttggtagatgtttttttgcagaaggactttttaacactttactgggagtttattctcaatcctaccagtttctgggattgcagctcgagattacatttgttaaacttccatcagttgggtgtgcatctgtgtagggggtgggggtgaagcgagggagagaattgaagactgccggggaagctcagaaaattctccgcattacttataaacagccgggtaaggtcaggctagccacgttttattctttcctacgcctttggagagtgttggaattttactttgtgcttcaagtatattacaagtggtcttgtagtgtagctgagaacgtttggggtgcgttaaaatgcgtttcaattggagtatgatttagcagccatttcttcccgtgaaattttgcaaatcatttgtaaacttatgttggtcgaatataccaggcgaagtaacatttttagtaatgcggtatatagtttccgtatataggtatagcaacggacctcaagtaatattgcttattgtaggcatctactgtgcaatgatagggtagtgggtagtaggcctgattatagttatgtcttctgaggccttgttaacagtaaacaaagaacttttgtgggttgtgtcattttgaggtcatttgtaccttaaatctatcatatatttaaataggtgtttaaatgcgtgtttgcacgatgtgttactctttaaggtccatgtttccttcattctggactacggttacataatacacaaatggtaacacttttaattgctcaattttgtcctatggagactgcacaccatctttatgaaagaggtgtgtatgtgtccttactgatgccaccgaattcttgacatctggaatgtcaaaatgaattattttgcattctaggttaaatcaacactggaaaaattaaggtgtttaagcaagtctagtagctctatataagacagaatctttttttttctttaggccaactgttggatttttaaaaatgaatcatatttttaaacatttgagggagcagtttgcttctgagtctcattttaggctgaaattgttccagagcactacatagcctgcttctctctttctctccccactccccctctttttagcttgagataaccaagaagacataactgtgactctatgtgttatctttttaaaaagttgttttaaaattgaagttgcttgtttgaatatttactatccctttacatgctttactacttaataatggattagcagaataaaacagatattttaattaaatgtctttcatatttttgacatctgagctttgtaaaaatggagtagcatcatattattgctgagagagttacaaataatacaggattagtgctagtcaaaggctaattgtaaaaaaacagccagaaaataaaattaaaagaggtaagaggacgcatttatacttttgacatcactctaatataaattacctattgctaggtgacttttgaaaaagagtatcttgtaaaattcacattaggtatataatagttaataatttttccttccagagtgattcacttgatgagtgactagattttttttttttaaatcagaactctacttcaggtaagtatagttaaccatgtaagtgatgtgctgatgtttatttcaggaagaatgaacacttacccatttgataaatactgaactgtttgggaatatgtcagttattccttaaaacttaggcggagaaaaattatgctagttttgttttaactgtaggttctttagaaaagtagtcttcacatttataaatataagagcagataagcacaagagatctctttcctgatatggtgctagtattgaattaaagattttatttttttgttgtagggaccagttttgtttagtcttcctgttcagtctcacagaagctgcaa

SEQ ID NO: 124667 - DNA, 1065 bp, Homo sapiens
taccccagtactggtaaagttgtttataaatcaccgagattttccgatactttgtatccttcacacagcccagcactttgttacctacttagtagcactaagtaaagatttaattgaaggagcttagcttatcacctttttatagacccagttcataattcttatgtttttggaagaaatcttttataaaaagtgattttcaatttcatttgataaatctacttagaatatttattagaataggcaatagagcaattttttataaatcttggtttattgtatagcatattaatggaactttttcatagttgctttgttctgtaggatattattagatattagttgggtaggattaatatttttaaaagatagaatagggcagctggagatatgtgggacttttaaagaaaaatgtatgagaaagtgtggggaaaatgattctctgagcagactgggggccatatgcttaggaaaggaaaagtgaaaggtgagggattcgtttagagaaattctgtggtggaactcagaggggtacatgttgggagaagttttaacttaggaaaatactaagctgatttacttaaatgcatatttcaaggataaatactttatattttgttctgtaggtcatttttaccatgaagtgactctggcagggattctttacctaagtgggcatcagaatcctttggagctatcctacgctaaaggattctaatttagtaggtctggtatggggcaggagcatgtttatattgttaaaatccccaggagccaccatttgagtgtaaaataatacatcctgtggaatattccattttaataatgaaatcattcaacaaagcttttgaggttgtatataatttaggtaactctaatgctggaacttggtctctcaccaggtcaatacttctgcacatacctcattgatccccattgctttactctcttgcatactcttccctcctctgccttcttgtttcttttctactaatgaatattcaggcatggttctccaaggaagccatcattaggtggcctcatccataatttatcttttcagta

SEQ ID NO: 124668 - DNA, 1099 bp, Homo sapiens
aatatgtaaatatatattatatatttttaatatatataatatataatatatataatatataatatataatatataaatatatattaactatatataaatatatataaatatatataaatatatatatatttgaatgtctactgtgtgtcaagcactgtcctagtgccagaggagacagaacaatgagtgaatttttagtgaggggaaacataagcaaaaaataatttcagatgagtactgtgatgaaaatgaaactaaaaggatggagagtgacaagactgtatgtaagggtggtagcgtagtttagattgaatgcttgggtttactttctggggaggtaatagttacactgtgacaaaatgaagagaatattggtatgtgtgtggatctctgggaagagcatttcaaggagagagaacagaagatggtaaagatgggaaatgagagatgggagatgaactggtctagtttgaaaacagaaaggagcccagtgtgactggagacaagcagacaaagggaaagagttggagaagttgaacgcagagaggtacagtgggtgacaaatcatgaaggcgctaagcggccatggtcaagagtgtggctagttttctaagtacagtgggaagcctttgggtagttttagcaggagagtaacaaaatctgttttgtgttttaaaatgatggctctagccactctggggagaatattgttgagaacgagagtgaaggtaagggaactggtcaagtgactactgcagcagacaggcaagaattgatggtggcttagcgtagggggatagcagtgaatgggcaagggagtcagatggcttttcttcagtcacctccattgtgaccgaattgaagaaccagtttatcattggatctgttatgaattctaggtatttttgtaagtatatatataaagtattattttgaaaacagaccctatcaatgaaatttattctaaaattacatagttttgggattcaaattagaacatttgataaaatatctcagtgattctataatatttcacatttatgaatgtttattaggtgtgtaaaacattttcaaacaattttgattcattatactacat

SEQ ID NO: 124669 - DNA, 1263 bp, Homo sapiens
aggtgaggggagatgattacttcatgatttgcctagggctgcctatattgaaatgtgtgcaggcaagctattgctaggccactggggagatcttttcactgagtccaaatgtgaactacatcattaatgctgttttatcaaaccaaagtatataaaggaagttctgttaaagcagaaaattatcattatagaaaaggacttgtgaaaagttctacaacatttgaaacaggtattttcatgtaacttaaatttatgaaggacaagttattgtctttttagttcatatttttagttcattttattaccagtattttcaaaacgtacccagctcagtctttagttgttagaagtgaagggctaacaaggatatccagttgtctatagtgttgatgcttgctatagggaaatttgcagtgaggaaaacatattaaaatagtactgttgttcagttgtaatttcatctatttaaagtgttctttcactacattgaacaaattatcagattgcctaagtttcttataaccagaagtctttcatataagaaatgtgaggttaaaacttaaaataacctgttcattatagattggataatctgctgtttcactgagttaggacctctttggaattcgcaaatttctgaaactgtgctaaataaataaggctattatgagcaaggttttatgtgtacacacacaatcaaagttttctaatatttggactatgttttaatattccatgcaaggattctgtgtatggtgtgtctgtgtttctctgtcttgttaatgtgagcattcatgcccagaagggatgactgggagacattatgcctttgaagaagataatttgtttccaacttatttttactgtcaaaaatgttttttgtgcttatttttaatgcagtgctttgtatatacttttgtgaaatatttcgcccagtactttaaaggatgatacataatcaaaagtaaaaaacacaccgagtgttgaatgaggcaggaataaaatacagtcgtgcatcacttaacaaaggggatacattctgagaaatgcatcattgggcgatttcatgatcgtgcaaacatagagagtactaacacaaacatagattgtactaacacacacatagatggtatagtctgttatacatgtgggctatttggcctattgttcctaggctacaaacctgtataacattttacacttgtggcttaccatgaatggagcttgcagaactggcagttgctctgggtgagtgagtggtga

SEQ ID NO: 124670 - DNA, 1002 bp, Homo sapiens
tttcatcatagatttgcttgtaagcagatctatgaacattcctctctagtaatgaaaacctttcattgttggggttcatgttttcaaacttgttaagcagcttgttgaagtctgcaaaaacttctgctaaacccttcactgtacattttcttgagagaattattcagctgcattataatcttttggaaccactgttgtatatgtagtctttggtcgactgaaataatgttatgtggtacatgactgtatccaaattgatgaggtaattctagtagcttataaaatatcttacataacaagatccatgtcatttccccctgaatcaaggacaaagaagaaaaaaggtttgttattttaagtataacatataatattcaaatgtgaattatgtttgattgtaggtcaataatttttgagccccagtttcttatgagaatggaattggtagtgtgccagttaaggaaaatttatggtgacactagataaacatggcagtaagtagaagcagttcattttgtataagttaaatcgttacatttataaatataaagaatagccatttaactattttttataggtttttaaattatagtttttacatcttacgttttagttgaatgttttactgaaatatatttcatgtcatagtatagataaaaaagaatttaagaaaccatgtcatctaaggatgactttgtcttctccaggtttctgtcctcaagcgaaaaaatcttgcctgtttttaactctagaaaagtggttataattatttgatttttcagcatgcaaactagtaactatttacacatgatagatatactttttttttaggtttttattttttattaaaactattaatgcacatatggatgaaagactagaggtgctccccaactctatttctgtttcttcctcccaggaggctactacatcgaacatttttagctgactgttttggtatcatgtcagtaaatggtgtgcttatgttgctaattcttattt

SEQ ID NO: 124671 - DNA, 1069 bp, Homo sapiens
aaaatgtaacatttttgtgactgtgaaactatgccaccaagaagtaatgatgtcccagatgtggcctagttgttggggatgcaaagatgatttctgcactcataaaacttagagtttagaaaggaagttgcacattaaataccaaaaaatttaattatataggtttatcagaattatgaagtatagagtactatgaaagtatgtcttaggagaagttatcctaattagggcagttagggacattgatattttgcccttaaagaatgagtgtgaattaggtatgcaaagatggttgtgtataggtggtggtaagtgcagggagggttttgcatcagggctggggtaatactggtatgtttaaagctgtgggagtggtgcaaattgaatctagcaatatattaaaatgcttataagccataaaatcacattttaattcctcataagttatatgtagataccaggctgttggggtagtctgggtacgatatgataatggcaaggactcattagggggtgatggaaagaaactgatagattctagattctagaaatatttacgaggtagaatttactgcttctttgctgtgtctgtttctactcctaccacttttaagctttgaaatacttttgaatatttttgtacagtgtttctctttagctattccctttgttcatgtggttttttgccttaatactttgctgctgttttaatagagattgtgaagaaaaagaatataaactcaggtagtcaatctaacatattttactgaaccctaggcccactgatttgaaatgtcacctttattgtatattgtttcatttaactactctgaagatttgtctgttcctatgataatactgcactatttgaatatacagtgtttttacagttgatagcaggtacctccttgacatttatgctttcctaaaaaatcatgttggctagttttacgtactttctttttcaggtaaattttaggataaatttacccaaaatgcttttgggatttctattaggatttattcatttttttttaaagaataatttggagagaattggcatttttac

SEQ ID NO: 124672 - DNA, 1019 bp, Homo sapiens
ttggttttccatgttaatatatttatagctacagtttctaaaaaaacctttttttctcccttcaatttctgtattttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccaatttctgtattttctagtgagattctcttcttccatagaaccaaactgtgaggctgatatgaaaaaatcttcagatgtgcttgggttctttttctaacatgattctgccttctcacatgactctcccctgacccccaaccccttgccattagtctttccacattcctacttctcctcacccaatttggaagcattaggttaatacacatactaaggaatggagttttcaagtcattgatcatttctgttcctttacttctcctaaagtcctgaattaaaccaaggactactgttgtctaaagtactgttgctgatcatataacattttcctgaagaaataaatggtcttcatagctcttacttagagcaaaggagtgaaagtcaaagggacgagtggtattctgaaccatagaagtataaaataactgtgaggatagatacggtgtaatggaattaacacatctagactggaagagccatgctaatcagcaacaactaaattagactgactgagatgtatgtcatacatttaagtgaatgagaataatgcatcatttattggattgaataattaactgcaatttaatgttagagtggctctctatataaagatgaagtaaagtaagctttaa

SEQ ID NO: 124673 - DNA, 1050 bp, Homo sapiens
attccttgtttttattatgcttaatcatttattttaataaaatgtaacaataacatctagagtttgagccttgaccctaggaggtcgttaggaaattctcttggtggtaagggactgtaataggttttgtaaataattagctgacttgtccagttttttcatggtttagttataaaaatgagtttttcatgactttcaggatagaactagaggccaagatttattatattgcatgatatacttactgtaaaatctatatattgcctctggttgaagtattaaatttggtttacatgaattaaatctccaagtaatatattttaaaactttacgaaaaagaaataaaccatggtctggtgcaaataacaaataagtattactactttaatatactcttattttttcaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccaggtaactttccctatcactcaactctcaagttccctgtattcccaaagtattctcctttactttccagtttaaggtgatgttttcttcaaagattatttagggctataataggtaagtatgtaaattccaaccttggtattttaatgtcctcatatgctgaggatatataaagagacatatgtaacaataatgctacataaatgtacactgttacagaaatacatcacaatggatttttctttgtgccattaaagaaaacaaccttaattcaccgtcagaccacatgctggagccattttcctcactatgataatggatttttttcttcctcattcccattctgtttcttagtcaatactttttagtattgcttctcaagattgttgtgcagtcagtgaccatggaacatagagagctgtgaagtatagaaactattgtataacataatctccacaggtacagaaataagtatgattttagcaatggcctg

SEQ ID NO: 124674 - DNA, 1047 bp, Homo sapiens
tacaatgcctgaacataacagctgtcagaaatgtttactagattagtaattcaaagactttatggttcttctgatacctagctgtaggttactattatgccagggttcctggtgttaatgaagaaatctactatttcctttacaatagtaaaatagcattgtttaaaaattcaaaaattcacccatgacaaaataagccatttcagaacactcaaatcaattttttctcttttctttagcaaaatagtagcaactgatagttatttccaacactgtgattaaaaacatgaaagtatttttaatactaccaaaaattttattactaacctgttgaggagtaatggtatctctataacttggtaagatttttagggtgacacttccactaatatttttcagtaattcttgtaattcctttggattatttccaacctcatggccattgacttctttaattatatctcccacatgaagtagaccttgtcgatctatcattcccccatggaggattcgggcaattaccagatcattattttcaaccctaaatgtcacaccctatgaaaaataagaaacagatttctcattaattattagggagaaatgcttaaatattcatgagcatatgtaagaaaataattctaaaactaggtaaaatgaatcattcttacttttcccatgttctctcctgtctcaatatttcactcccattaaactgtgtactagtatagtttattacactagtggataggatgtatcttacaggctaaatggaaactcgagagagcaggaaaaggtatttgtgcattctgatggacttattcctggcttttccttttttgcactcactgttcttatagtcaggatccagaagtaataattttaccaaggaatagtaaacttcactacttagagagtcctagtatggcttcaatttttaataacaacttctttttatattttgatactgtcagtatttcttcaaagggtagttcatgtcttcaaagggtaggaagaaacataatagtcatcttctgaaattttttgcta

SEQ ID NO: 124675 - DNA, 1032 bp, Homo sapiens
taggactctctaagtagtgaagtttactattccttggtaaaattattacttctggatcctgactataagaacagtgagtgcaaaaaaggaaaagccaggaataagtccatcagaatgcacaaataccttttcctgctctctcgagtttccatttagcctgtaagatacatcctatccactagtgtaataaactatactagtacacagtttaatgggagtgaaatattgagacaggagagaacatgggaaaagtaagaatgattcattttacctagttttagaattattttcttacatatgctcatgaatatttaagcatttctccctaataattaatgagaaatctgtttcttatttttcatagggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggttagtaataaaatttttggtagtattaaaaatactttcatgtttttaatcacagtgttggaaataactatcagttgctactattttgctaaagaaaagagaaaaaattgatttgagtgttctgaaatggcttattttgtcatgggtgaatttttgaatttttaaacaatgctattttactattgtaaaggaaatagtagatttcttcattaacaccaggaaccctggcataatagtaacctacagctaggtatcagaagaaccataaagtctttgaattactaatctagtaaacatttctgacagctgttatgttcaggcattgtattaggccctgggagaggataaaaatgcagtccagatcacctccagcttagtgtttgtgtcatgggtgaaatgactgatgaggccagaaaagaggatgggtataaagaaaatct

SEQ ID NO: 124676 - DNA, 1030 bp, Homo sapiens
aatggggggaacctggttattctagggatactgtttgaaattgtgtttcactctacacagaaaaatcaagtaaaaggggacatgtgttcagtaaacatataaagatatattgaaaatcataatgtgatataccattaagttggtaaaaattatagctgtgaatcaacagcatcttttctacattgctggtggcagtgtgtattggtataaacacattggggagaaaagtttaatgtctcttagagttaaatattcacatatatcaagctgcagtaattccctagagcaattcttacgtatgtacagctggaaacatgttaataagcatataaaccccaaaagattacatgcatatagcatgatactatttttttacgtttaaaataactatataaagagtacgtatagatgcagtagaactataatcaaaatgtaaagcaaggagtttgtgaacccaggattcagggtgaagtgtgccttggttggggaaaccgaatgatgggatgggatggaatgagggcaggagaatcaagtaggattttaatgttagttttaggtggcaagtgcatagctgtctattatattattaaaactaattgaatcgacaaaagcagtccttgcacgaaccagtgatataaacttaagaattatgattagtataattttggcctaggttagtagttagtagattttttttttttttttttttttttgagatagagtctagctctgtcacccaggttggagtgcagtggcgtgatcttggctcactgcagcagcgtgatcttggctcactgcagcctccaccgcccgggttcaagtaattttcctgcctcagccttccaagaagctgggactacaggtgtgtgccaccatgcctggctaatttttatatgatttttaaaataaaattttttatttggctgaggcttcaatttgtggccctcaggtatttatcagaaaggaacgtggattgcccttcaaaacttttttaaccaaacataccttcttgttatcttgctgttatcaa

SEQ ID NO: 124677 - DNA, 1032 bp, Homo sapiens
tttattaccttaaaattttaatttttatataggtgaatcattcccatggtttgaaaatcaaaaaatgtaatatgtattcagttgagatctccctctgaatccttcccactaccaacctagtcctcatccccccaccagtaacaaactttgctattaatttatctttccagaatttcttcattcatatgcaagtaaataaaaattacatatcctttttcacctttcacctcctttttcatagaaaggttgcatagtacacatgctattctgaaccttattttttttcacttaaccatctgtcttgaggatatttccttattggtgcatacacttcctattgacaaacacacacacacacacacttttttaacgactatatatagtgccacatcatgtagacctaccatcatttgtttcaccagttcctttttgttaaacaattaggttgcttccaatcttttgttattaggaatgatgtagtcttgtgcataagtcattttggatgtatctgcataacatagctgttgaatacattcccagacatggattactaggtcagagggtttatgcgtttgtaatcttgacagctattgccaaattgtcctcccaagaggttgaaccattcttccacaagcctattaggaaaatgcctattaacccacagttcttttgtagaatgttataaaatacaaggatttctgctaatctgataggaaaaaatgttataaagtagttttaatttgtatttctactctgagtgaggttgttgaacatctcctatgcttaaaagccatttgtacttccttttctttgtactttaaatcattttggtcattcagttctttttagtaataagaatatgaaatagaaatattttagtaggtggtgtttagttaatgatgaatgaacagttaacatccatagcctataagtgcaacactttaaattgcatttaataaaatataattatactaaatctagtcatatctttaatggttttagagtcattacaaaatggttagatcaaaggtt

SEQ ID NO: 124678 - DNA, 1026 bp, Homo sapiens
tcatttttctgtcttatccgccaactaaatttcctttggttaaatttaattattttggttttttcccgttgtcaaaacatggagctgcatgacattatcaagttagccaattgtcacactttagcaatcttaatgtttgtatgcttgctttttagatctaaaattatatatcaggaaaaaaattattgacctactgatttaaggattaatatttagcttttctagagtagttgaaaatgttctgaatgctttctatgaaaatcatctaattataaataactaagattttattacatgttcccagatttcgttattttaaaattattttgtatgcatcgatcacaatacttttaccacactaataatataatatgtctacttgtgttatttgaattttgttggttacagaagtatgataaacaaatagaaaaagaacattgttattttgactaattgtgtactttcttattaaagtttacatgctgattaatgctaaggcaattctttagaagataacatttgaatttctataaatatatataaaacaagtctgttttaagaaagcagttgggctgggcgcagtggcttatgcctgtaatccccataccttgggaggctgaggtgggcagatgacttgagatcaggagttcgagaccagcctggccaacatggtgaaacctggtctctactaaaaatacaaaaattagccaggtgtggtggcacacgcctgtaatttcagctatttgggaggctgaggcaggagaatcacttgaacctgggaggcggaggttgcggtgagcagagatcacgccactgcactccagcctgggtgaaagagtgagactccatctgaaaaaaaaaaaaaaaaaaaaaaaaaaaagaaagaaagaaagacagcaattggtctgaaccttccatcaaataccaaaaatgcataatttaattagaatttaaattaaagcaaataagcaaaatagcccaaatttcggagatcataactaacagtgttaactgacatacttttat

SEQ ID NO: 124679 - DNA, 1052 bp, Homo sapiens
ttgtcttacttaatagaatatggtctcaaattttggtcactgagatgtacaattcattaatttgattctaggctagccatgtaaaagagggaggaagcgctggtctcattccaagccagttcctggaagagaagagaaaggcatttgttagaagagactgggacaattcaggtgatgagctcgacacaataagtaacaagcagtcctttgtgaccacctttctttgtctcttttgtctaaataagcaaatgcatttatttaaaatatgtctagaatgaatccctccctctgctttctctcgctcataagtaatcttttttgatcccgttctgccacctgctggtagagtatcaaaattcagtggcttaactcacctccaccctcttttgcttcctaggatgccacattggggagataattctcccacccctgtaaaatactatagggcaattttttcatattctgatatactgcttaagttatatttgttttatcatccttcaggacctttttgtggaactataagtagcaaaaaaaagaaaaagatgatgtatctcacaaccagaaatgcaggtaggttttaaatactttttgagaagtccaagtgaagtagctatatgtcatttagtgtggcataaactctgaatatacagctttaagtgagtgtaattcagattagtacctagttgcaaggggctgacatatgaacacatggtgcaatataatataaattatttaaaacccacattatatatactaccatgtgctttattttgtgagtatagtttacaacacaaaacaaattggttaagatttttgtttgtcttaatcaagaagcagtatcataattgaaactatttgtccagagaattttgaaatagtaatttatgtgccatttctaaaggatagaatgcctttgtcaagatgttaaaagagttatgtttagggcaactgtatcctgccataacactgaccatgatagttttagaaaaatagcactggaccaaataaatcttagtctgatctaatagaattctgtcttaaatctttta

SEQ ID NO: 124680 - DNA, 1024 bp, Homo sapiens
aatatatttaaaaagaaagaaatggtaactatatgaggtgatggatatgtttaatagcttgatcgaggtaatcattcacattgtacacattcatgaaaacatcaagttgtacactttatatacaattcctgtttgtcagttgtacctcagtaaagctgaaaagatttttaaaaacaatgtaaaataagaccccagacctggattggctactcattggctattaaaaataaataaataggaaagaagggaaagaatggaaactactatatttattcttcccagttgcagaggatgacagaaataaaaaacagctctatgaatcagaaatttctggaggcttaatcaaaggagttggcaattttaaaagtactttcttgacttcagagctacctctatgctggtaataaactaaatagcacaccataaaagaaaataatatagaaggaagaagtaggcttgctttctcttaatattggtttaatctactgtggggaaattgtgcaaagaaagagttactattaggataataagctaaggaaggagtgttattactacagattgagagttacagtaataacaggtaatataatatttcaaatcatcactttggccctattattcataaaatatatgcccataaggcttttttgcaaaatagaaaatttgtaattttcccatcgactaagattataattttgggttatgtttctagtgaaacagttggatctaaaatttattttatatgtaaatttcaaaatcttaatatttaaatgtatgttgtcagtaaatgtcagtatgttgaattctaatcaaactgataattgttgatttgccatacaatatttattcatttatataattggaaggtcacttgttctgtggaacttacttaagcaaccacgctaggtttactcctgtcctccgtatttgctacatgctttctatatatactggtttgtaatttgattatttatattaaaggatttttactggcaaattgataataagtttcagtggatagaat

SEQ ID NO: 124681 - DNA, 1038 bp, Homo sapiens
tcgggaggcttcattgagcccaggagttcaagggtacagtgagctaagattgcaccactatactctaccctgggtgacagtgagccccggtcttaaaaacaataataaaataattattatttattgtactttaccaaatttgtaaaaacaaatctatgctaagtgggtacaagtcaagtgatatttaactatcaagacagctaagccattactagacagaattgcagagatttctttcatgtatataaaagttgactttgtattcccatttcctttttcatttagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatgtaagttttctgtgttttccttgctatgcaattggcaggaaagagtatgggcatatggaggaaagggggattattatcattagttattgttattcccaaataagttttctttatggcagtgaaagtgaacaagtaaaagacattgaaaaatttagtaattctgtagctgtcttgaaatagtgctgcagtgctgttggcttgctgtctggtggcaagtgcttctctaaactattcagttcagaaatgttagaattaaatgcctacatttaagactcgtggcaagataggcatttaggattttcttgtactgatgtctatctaaaaagttggatttttcagccattttagtgtaaagaaaaggggaaagcttctgacccttggacatacccagtgtggcaacagctgtgtgaacttacgtggcctggcttgtagctctcagtcatgcaaggtcataaacctgatttttgatagcacataagagtgattcatcttttactgcaggcagcattcattaaggttacagagtctgatgtatagaataaaatagtactgatgagaagtataaccattaagtgaaccaagcactcattt

SEQ ID NO: 124682 - DNA, 1039 bp, Homo sapiens
gttattttagggagatgggctatgttatgcatcctgttttcaatttaacattgacatcttgacatcttgagcttagttaacaaatgaagtattactttgttgattgtgtcttcattatttgaagagcagctaaaattgagaattttgcctatcataaaaaattacttctaaaaaatcacattatgtagttgcgcagtatagaagtctaaggaatcagttgtagtcaaaccttcatgttctaatttctctgttctagaaatggaaagcagtttaaatatgtggcaacgtagattgttttttgaagtgttagtagagaataggattgtagttaaaattcacttgtaaactaaagaacatttctctaagaattaagattccctcagcatggaggtagaggtaatacatgtgcatatacatatttatttcaagcagcgcattcccctatatggtttcactgtaggacttcaccgaaaaaacattaatttttaaaattaatgttcacaatgttgaaccaagtcctattatgcatttatttggggagttacaagttgccttagaagtttttttatttttttatttttttaaggtttttttttttcccctcttattattatacttttaagttttagggtacatgtgcacaatgtgcaggttagttacatatgtatacatgtgccatggtggtgtgctgcacccattaactcgtcatctagcattaggtatatctcccagtgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattatga

SEQ ID NO: 124683 - DNA, 1087 bp, Homo sapiens
aacatgcctcaaacacttaccataattaagaacttcattgaaggctctgctgctaggtaaatatactttgagtttcaaagtgattttaagaagcatatttttggatacaaattttatttgggggactacctcttaaaatattcccctaaggtatcaagaaacttttctattaaagggccacatggtaaagttttaggcttcgcagtccatacagtctgtcacaattactaccaccattttaatgggaaagaaaccatgtatgatacataaacaaatgagtatggctgtggtccaataaaactttatttacaaaaataagaagcagatcagatctggtcatagcctacagtttgctgcacccagtggaaaaacgttaagccaccctatgtattttagtctattttttatgccctaaaatttctttgtacaaaaatctcaacactattttatttagttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagtaagctgcttggattccaaagctgttttatattttattttctgtggagtttttttcatgtgtgtcggggttgttgggttggggttgtttgttttgtcagggtggaaaggtgactccctccattacctttgggtgatagagaatgttattatgtatacatagctagttaaataaatctctgaacaattagccaacagaggcttgggtggcaatagaaactgtgtgattagatctacaatagaagtttagtatgtatttatttacctgttcaagtaatgcataagtgcttgtgttaagaaatgttaagtttaaaactcaagtctgcaatataaagaataaaaaattaaagtcactccccctcctacctgacacacatgcacacctctacactattcattttgtcactctatatttctgtcacctacccctt

SEQ ID NO: 124684 - DNA, 1038 bp, Homo sapiens
gagctttttttctttgtaattgctatatagtatgaatatatattcatttaaccactctccaattaatcaacattgaggttatttctactttttgagtattaacagaattctacaattaacataaaaaagagtttacatcactcttgatgatttttggatcattgttttatactttgttcaagaggaacagactgagttcaaaacaaaataaatggatcactgttttaagaaagtactatatggaatgagaaggacagaacagggataagtattaagttatgtcctttaattcatagaacaagtgcaaacagcctttgatatatactaaagggtagcagaattctagttctaatattgtataaattggcttataattattcttttacacaggcactgaaagtattgaggacatcagagtttatgccctatgtggtatttattgcggctccggagctagagacgttacgtgccatgcacaaggctgtggtggatgcaggaatcactaccaagcttctgaccgtgagctaaccatacgattttccttctaaaatctttccttttcttttgagcatgtttaactgttatctaatttatttttatttatttatttttgaggcagagttttgctttgtcacccaggctggagtgcattgatgcgatctcagctcgttgcaacctccccgtcccgggttcaagcgattctcctgcctcagcctcccaagtagctgggattacaggcatgcgctaccaggcctggctaatttttgtatttttagtagagacggggtttcaccatgttggccagactggtcttgaactcctgacctcaggcaatctgcccacctcggcctcccaaagtgctagaactacaggcgtgagccaccgtgcctggccaactcttagctaattatgcttatgaaataaacatgctatataaggtgctacagaatgaaaattaattagatgtagttaggatctggaacagtattcttttacttgaaaatcattgtacactttattttaaatcaaaagtttagt

SEQ ID NO: 124685 - DNA, 1012 bp, Homo sapiens
cttatgtactccccacatcattccaaaatgactaaaattactttatgaaatataaacagtgcctggacaaaaacataaataaaagtatgtgagtatgtgttttggtggaggatgggcagcatgtaaggttaatcttcaaaaaacacttctaagattctctgatcttatagagaggtagcaagtttggctttgagcttaacagccactgcaaattgggtaccatgttgtacatgggccatgagataaaaatctttcgaaaaggatgatatagtggagctggaaaccagtcacctgcagtaattgttttgttactgtagattcattccaagattattttcagcagtcttttaattaggaattttatcctaatataagtgaggcaaaagatgcagaatactcataaatgtaaacatgagtgttgttggaaagaataagacatgaacagatggcagtgttgtctttaacactatatggattagattttgaagattaataccagaattaccagaaatatatctaacctatttattatattcacttctagttggagtttgagcaagtaaatatgcattgtaatacaaacatttccttttaaaactcttcaacaggactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataat

SEQ ID NO: 124686 - DNA, 1976 bp, Homo sapiens
catgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaagaagtttatctgcaaaatatttcaatcatcttggtacaatagatgacttttacatcatgtatattagccttatgtgatataaaatgtattacttagaaaatatacttaaaggaattatttctattataaatggtattcatgattgactacttaattaatgcacattagatttctcctaatataaaatgaaatgatgcagtttagttcatttcagtctagatgcccgtactaacaagaatacagttagataagttcattgtatctcaatgaagaatcattgaacttgaaacccaagtcccaaatgaatctgcaggaatgagcagtgctctgcgggggcaaacagccccagaggtcccagggttcttcctaggtaatgagagtatagctgtgatcaaggaaatgtgaacttctcttttgggaagatctgcgataattagctttatggaagcgaaaatggtttagagtggtgttgagcaattgttaagagttgaaatagacacacacatgcatgtgcttttgggaaacatgatgtgccaacgtattaatgtgcctgagggctccttgtggataggtcagtgtccacatttcagcactcagggcatgactgtacacaacctaagactatatatatattttttcattttcaaatgtacaaatacccatagaggtgatgtgcctggataagtcatttaaccatagcttagtgaaataaatgtgatggccctaaaaagtagaattttcactttcattacagccatgcctttattatgcagtctccatttctgtgtgatatttggtaatatcacatgtcaaatacatcaggactttgtttattttggctaactctaactatacaattgctgaacatagctttctgaaatagaaattataagagaaacccagtatgcctacagcattagtagcctaaatcctagattctagaatccaataaatttatagtagttcttaagaagtttcctttaaagcaacaaatagattattaaggcaaatttagataataacccaagttagcaataaaaccatgtgacattatagattatgtccagatactaactgctttgaccataatatcccaatgacaataaaaaatgatccttggtttaaaaattattaaatggtacttatttttatgtataacaagtgtcatgatcccagtgactggagttgattttcaaggtggatagccatagagttaggtaaaattattttgaattggcaaactaaagataacaattttgaaaattgctcaaaataataatctacttaaattttacttttgtaacttctgaaacagtactccattatccagaaatcacaggctagagagccaataattttgtagtaatgaaccttaactaaacatgaaaaaggcaatcctgaagttttatgtacatagatagcagttcattttttaaatgttcgagttgccatatattatgtatgtgtgtgtgtgtgtgtatatatatatatatatatatatatatatatatatatatacagctatgtgtataatatgtaaaattctcccaaaatgtatgaatataaaactgaatgtattcattcatgtaattataactagcattctaaaatttttaattactcccatttctttgacattctgaaactttttttagattgttttaaaacgctctggttccaccttgaagctgataatctttctgaaaaatatatgagaaactcagaaagtagtcattattataataaatttaattttcttaggg

SEQ ID NO: 124687 - DNA, 1211 bp, Homo sapiens
atactcacaaaatttaagaatacatttgactaataattgagcatcttgtcagtttttatgcaagcatatattgtatacctgaggaagatgacagttctataatttttttaaggtaaggttatttttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttattttaaagtgtacctgtttctgaagtaatgtagtgaatggtgaatacttttcaggaattcttccagttttaaaatagccccaaagatacagtttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaactgtcctactttatccttatacctgaaatcactgcatacctgaaatcactgcagccctactgttttacccataccattaatttaaaaaggcatctatttctttatagaaagaaacattcacagtgaggtcttagtttgtgaacctcaaaatccagatattaatccactttagttattactttgtaattgcttctcagtcattggctgataatgcaatggtgtgataaatttgacttatctccacatacaaaagtcgatcagaagggatagttctcttcctttttttcccctcctactggctcttactgttttctaatctccagtgtaaa

SEQ ID NO: 124688 - DNA, 1070 bp, Homo sapiens
gctgggactacagaggtacacaccaccatgcctggctaatttattttttgtacagatgaggtcttgccatgttccctaggctggtcttgaactcctgggctcaagtgatccttccaccttaccctcccaaaacgctaggattacagatgggggccaccacacccagccagttgcagagaatttgatgctgtgtctaggctcaagtagaaggggactgtggtgctttcatgatgctggccctgtgttacctacttggcatcactgatccaggctattgatagaaatgctgcaataagtaatggggtatatgaagaaaagacctctcacaagtcggagaactctggcctgtgtattagctcctgacagaatgcctgttctgaaagactctaatacccggatgttaacattgggagaaagtctctagtggagttccgcagggctctgtcttatgtcctgtttcagtttaccagtcaaaactatatttatccatgagttggaacaagacagagcatatatttatcagcacatagagttgggacaggcattctctcagattaattctttaaaaactgaagattactgggtctgtttctgtgtggtgctagggaggaaccctgaatgtatcagaaactatgtgtcctgactagtgtcaccatgaagggaagctgtggggactggtttgccacaactggcttttctgagagggaataggaagcccagcttcctcgtgacaggcactgtggcatggcgagttccggatgggaggggtacagaggtggcagagattgttccacagtaactggatggctgctcccctgggaggccatttcaggaccagtgcagaagctgtgcatctgggcccagccacagctctgcctcccagcctagtacattggatggttgaatgctctccacagcccccttgccccagacaggagcacgcagggtggggaataacaagtttgcaaagatcagaaggactgaaatgctggaggagagcagttggcaaatgaaagttgctgccactcagctctgctgggactccggagtgaaccacagcctgtcaggga

SEQ ID NO: 124689 - DNA, 1078 bp, Homo sapiens
gctctcctgccttcgttgtcaaaaagcttacagtctttgaaaagggtgaatggagcctcccttggaggggaaatcggcagatgaaggaggcaatggtgtgtgtgttccaggattttaggggggcagttactgaaataaaactctgccatctctgtagactggaggaggttggttatcaagagagaagcagactttcccacttaatgaaatgtcacaaaggcaaagccaaggagtttacaggcaatgtctgtggacctaattttcctactctacagctggtgtgtgaacacacgtgtgatcctttgtaaactgtagttttagccaataaatcaaaacccttgggagaagttctggatttactaaagcctttatcatcaatacatatctctgtttctgtgggttagtaattcttgcttaatattccttgagcagcaggctggccaccaccttttggctctctgtcatgtccccatctctgtttctggggagatgttgaaaccagctctggcagtactgcaccatttcctcagtctgcatttgtacctttcactttttgttgttctttagaagagtgtagtggaaaagcacactggtctcagagtcagaagatgcagttcctgattttggcactgccactaacaggccatgtggttcaggtgggcctgtcacctctctggggcacattcttcactaatgagcagagacactgggttagatctaggtgatcagggccatccccctcccatgtccaagcagacactgccacttaatcacagctttcttcctccttactgtcttccagcccacactcagccttagaatccttttcctacagccaggcagtaatagctgatggattaatcaaggtgaaaataaagatgaacctgagtttctgcccagagctagataatccccttgggtcccttctagttttataatttctccacagcagactcaacaaaagctcctgctctgtcatgatgtcccctggggtttggagagccttaccaggctccccagggtttccattggaaactcttcctcgaggccattggttttttttttttttttttgagac

SEQ ID NO: 124690 - DNA, 1003 bp, Homo sapiens
attgacagtgttcaagatgctggctttcccttcagtctggatccctgaataaccataataaacaaaactctcttgtacccctgtattgtgcatgtagtatgagcaacaaataaacccttattgtaataaaccactaagacttagggattgtttctgaagcgtaacctagcatatccagactggtatatatatgttctttcaatatctctatttgagttctttattatcagctaaagtcaaactagagggtcttctaggaagaagatattctttcatgtgaactgttgtgaatagggagaaatacagtaattttagggaaaaaagccacaaaatagtaacttcttatttgattttaggataactttactttttcagataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccaggtatgtttccttgggtatattctataattagtctcggaaaggatgatcctttttttttttttttttgacacagagtctctgtcgcccatgctggagtgcagtggcgtgatcttggcccattgcaacctctgcctcccaggttcaggtgattctcctgcctcagccccctgagtagctgggattacaggcacccaccaccacgcccagctaatttttgtatttttagtagagacagtgtttcaccgtgttggccaggctggtctcagactcctaacctcaagtggtccacccacctcggtctcccaaagtgctgagattacacacatcagccaccatgcctggtcgatgattcttctttaatgcaagtattgccttgagtccagatactttataatgaa

SEQ ID NO: 124691 - DNA, 1039 bp, Homo sapiens
gatggatatacaaggtcatttattgcggcattgtcacattaaaatgattcaaatgattcaaatgtctatccataggaaattgtctaaattcatatacatccacgcaactggatattatgtggctattaaaaaatgaagatgtatgtacatccatggaaagatctgtaagatatattgttaaataaaaaataaaccaaaaccaaaaatcaagggatacatagcatgctaccatttatattttttaaacggagggagggataagaatatgtgttaatatttgtttatatacacatgaagaatctctagaaggatgcagaggaaactaataaagtgggttttctagggtgggagggtgaaggtggctggaattagagacaaggaagaaaggaagactttgccccaaattcttttttgtagatataatttttgaattatgtaaatatcaccaattcaaaaaaatatcttctctgactacttcaagatacggattaaacggttggggcggggtcttacgtataggagaggattttgaatatccagtcgtggacacatgcaagttgagtagtaatgattgttttgttttcttgaattcatatcctttcatttttttttcctcgatgcctcaggtttctagaggaagggaacttagaagaagctgaaatacaaaagcagaggattgaacaactgcagagagaaaggcggcgggtcttagaagaaaatcatgtggagcaccagcctcggtttttcaggttcgtgcctggattgagtaggtttttggttgataggtggtgccagcacgttatgcttctggtttgcagaaagtgaacagtactgtccccagataagagcattctccaggcttttcctgcttccacgtgggggtactgctcctctgtgccaggccctgtcccccgcacttaccttcaggctctccctcttgctgacttcagacaggactagggcctgcatttttgcattccttgagcttttccagtgccctcagccagtgagtttgcagaggagctcctcagtcagggag

SEQ ID NO: 124692 - DNA, 1002 bp, Homo sapiens
tataggcatgagccaccttgcctggtctacattgcctttcttgaacaaacactgggcaaaacccagttttcttctttgtcagtgtttgaatactagaaatgtgtgtcccctagttctttacagacattcccaggggttgggggagattatatttctaagcatcaatactctactgaaaagattggatacagaaataacctttacatttcatatcatcattttgcctgtgttaggaccaagatcttgctacactgttattctttgagtttatagtaaacatgaggtttttagagtgtttcctattaatttcttccccacagtgttgctgggcacatattaggacctgtctctatgctgggtactttggggaagttaagtgtttaagaatacagattaagggaccagacttccttggttagccccagctctgccactcagtggttgtgtgttctgggaccagatacttacttcctctatgcctcattttcttcatctgtgaaatggggataataatactgtttaccacaagtggtagttacataggataagtaggaataatgcatgtgaaatgcttagaagactgcctgtcacagaataaaatgcaagatatgtgttagctgttagtagtattggtggtgatgatggcggtggagtagcatgctttcaaaattcagattagtgtaatcaaagaaaattttttgagactacatgaaaaattgttttcaaaaatgactacaggcaaggcacagtggctcacacctataatcccaacactttgggaggctgaggcaggaggattgctttaggccaagagtttgagaccagcctgcgcaacatagcaagatcctgtctctaaaaaagatacaaaaactagccaggcgtggtgtagcatgtctgtagtctgagctactcaggagactgaggtggaacaattgtttaggcccgggagttcgaggttacagtgagctatgatcataccaccgcactccagcctgagtgacc

SEQ ID NO: 124693 - DNA, 1014 bp, Homo sapiens
ggttcaagcaattctcccacctcagcctcccaagtagctgggactacaggtgtgtgccaccatgcccaactaatttttgcattttttggtagagatggggtttcaccatgttggccaggctgttctcaaactcctgacctcaagtaatctgcccgcctccacctcccaaagtgctggaattacaggtgtgagccaccttgcccggcctccagcacactttctaaaatctgattcaatgggtatgataattaagtaacattgaaatatgtccaatcataagggatggggccagcatattcttcaaagcagatagaagcctggattccttaggaagggatttggccaaagagactccagacagttggggaggaggaggagatgctgtggaaccactggtcttaacagaagccgacagtgtctgtgacttccctctctgttgcacttaccaaccctccctccatgtctggaatgagaaaagaaaaagagcatcatttccagagcccaggtttgtcatctcccaggcatctcagaaccagtatcctcttggagagcattcaaggaaaaagtccagaaagtgcgctgtcagaccacgtcactaagagtttcatcaagctcttagagatcgctcctgcagggcccactgctgtgcttttctgaaacatccatttattaacagagccccactattttaacatgttccaggccctagcacaaaacacagatcttaaagaacgcttacgcagaatccatgccgagtctctgctcctcgactcccccgctgtcgccaagtcgggtgacaatctggcagaggtgggtaggtttctcgtctggtaatgtctccccagctgccgcccgctcccgtgataccatctgtcccattgcacgacctccctgcttcccctcatgggtgctgtccacctctctgccctcctcctctgggtgctggccacagctaggtcatggactggggtctcgggctcaaacgctttcttgagcgtatgctgctaattgcat

SEQ ID NO: 124694 - DNA, 1023 bp, Homo sapiens
ttgtacatgatgtgatcaaaacctaatgaataatgatttgtgtgtgtgtgtgtgctgtatgtgttaatgttttttaaaacttcagttcaggcattggaggccatagtggctaagccctcattgtacctgagggctcactagggaacagagtagctgaatgccagggttagagctgggggattctgggtcctgcagctggaagggctaacaagcaagaaggtagacagtaagactttgttttgaaacaattacaaacttacagaaaagttgcaagaattatacagagaacttctgtataccctttacccaaatacttcgttttaaatatttgccacatttattttatcactctctacacacacacgctttcactttttggaaccatttgagagtagaattcatacctcgtgttgttctttatggctttatactttagtatataaaataggaatactctgttatataaccacagtatagtaatcaaattcaggaaatacagcattgaagcaacttttatctattctacctcccatattcaaatgctgtcagttatcccaataatgcctttagtaccatgttgccccttgagtcagtttcattgtcattcctcttttgcctcctttaattgggaacagttcctcagcctttctttctctttcgtcaaattgacacttttgaatagtataggccaacttgtaaaaataaaatgtttctcattctggggttgtctgatgtttgctcatgatcaaattcagattacatagccctggctggcatacaccaaaggagatgttgtgtctttttcagcctattttacctagaggcacatggtccacctgactctcaccaatagttaattttgatcacctgattaaggtgctgtctaatttttctgctgtagtgttaacattttcccctggaaaaccaataagctttgtttttaaccctttccagtctttggggatacaaaaacaaaacaaaacactgatcactgaggatctagaagcaaagtgcaagtgtcaa

SEQ ID NO: 124695 - DNA, 1100 bp, Homo sapiens
atttctagggcttttggtttccccaccttcactgttgagcctgcctgtgctcttccctgcttgtgtttgtgccttgttttgtggctgcagttgctgtgtgctgtgacctgtgtcttccgctgatgctccatggatttgtcatccctctaagcccacaggcctgattctctgggcacaggacatggtgtagattctccttggcctcttatctccaaactcccaatccctcatccaggattcactgtgtcatgctaggagctttcccaatgcacagctaagccacaggccaagatttgcagcttaactgttgcatattaattgcaacagttttagaatcaacataaatctcaagcttttggttaggtcacctgatacacttgtgtacactctttggttcaaagtagtttatggactgaagataagcactttggaagtaaagaatgttccatgtacaaatgaaggtcatttgttttgtagaagccctaggtgcaaagaaaagcattttaaacctatccattactaaccgcctggatacatggatgattattgccaggaggaaggaattgagtataaatgagaaagcctggcagctttagctgtcattttcaacctatagctttaatgcttctatcatttccaaaagaatatgtgatttctcacccatttttagctcacaagaagcaagtttctgtggaaagtgttgtcttgagttctcattttttaaaataagttatcactcagtagaaagacctacctaggctgggcgcggtggctcacgcctgtaatcccagcactttggaaggctgaggcgggcagaacacaaggtcaggagatcgagaccatcctggctaacacggtgaaaccccgtctctactaaaaatacaaaaaattagccgggcgtggtggcgggcgcctgtagtcccagctacttgggaggctgaggcaggagaatgctgtgaactcgggaggtggagcttgcagtgagcggagattgtgccactgcactccagcctgggtggcagagcgagactccatcccccccaaaaaaaaaaaaaaaagacctacctataaaatgttttgtatttgtattaccatgtttc

SEQ ID NO: 124696 - DNA, 1044 bp, Homo sapiens
cattaacatattgtattagttcgttttcacactgctgataaagacatacccgagactgggcaatttacaaaagaaagaggtttaatagacttacagttccacatggctggggaggtctcacagtcatggcagaaggcaaataggagcaagtgacatcatctgtggatggtggcaggcaaagagaaagagtttgtgcagggaaacaccactttataataccaccagatcttgcgagacccacgcaccaccacgagaacaccatgggaatgacttgcccccatgatccagttacctctcactgaccaggtccctcccacaaaatgtgggaattcaggatgagatttgggtgggacatgggacacagccaaaccataccacatatactcctcagcaatgtattctttgttggagagatgaacaagtttaaatattttaggaagaatttactaattcattccagttcagaaaagattaatctgaaaagtctgaattataaaagagtttaaaaagaaaaatggtgctaatattttcagtagggatagagaagctggaattagagaacttggaaatgctttaagagacagataaatgtaaatttcagtttatttgttgcttaatataattggcactgttctgttttcttaaaaatagcataacaggccaggtgtggtggctcacgcctgtaatcccagcactttgggaggccgaggcgggcagatcaccaggtcaggagttcgagaccagcctggccaacatggtgaaaccccgcctctactaaagatacaaaaaattagctgggcatgatggcgcacacctgtaatcccagctactcgggaggttgaggcaagagatcgcttgaacctgggaggtggaggttgcagtgagccaaggttgggccattgcactgcagcctgggcaacaaggcaagactccgtctcaaataaataaataacagttggacttactcatagaaagccaaaatacatactttataaagatcatttttactctgcatttctttctcaaacttgttcccatagacca

SEQ ID NO: 124697 - DNA, 1092 bp, Homo sapiens
tcttcactatttcctagcctaactgtatctctgggtgtagctaattgtgtaaagcagggtttctcagcctctgcaccattgacattgtgagctggatgttttggtgtgggaggccgactttgtacagcaggatattgagcagtgtccctgccccctgccctctctctagatgccagtggcatccttctccagttatgacaacaaaaatgtctccagacattgccaggtgttccctagaggataaaatcacccctggctgcaaatgactggtgtgaagtatgggagggaaaagcctatatcttaagataaaaaagaaatttaagaaagaatactatcgttttttctgtttcattgatcagtctccactagaatagtttaggttatttcttcaggtacttccaatgaatcttagttctgtattttgacatggtcaggaattaataggttcttatttacccactattctggttaacaaaataaaagtaattatgaattcataatttttaaagaattagaatacctgaaaatatattgaatgctaatattgtgataaatgcagtttaatatttctctgtgtgatttgctttaagttctgtttggtttcttgttcattcttttgaacatcggttatgactcttagtgtaggtaagtgtagttatctgagcgttctagttattagactcagtcaggcagtttttaattgtgggctgtttggtcccatttattttatagataagggatcctgagtagcagagagattaagaggctgctcacccacggccctagaactgcttgagagactggaacaggaccctggacagttatttaataaagtgctcttattcttctaccttgtttaactcatagaaaagtgagtccagatgagtgcttgggcactgacttataacggcctctgagaagagatcagaggaaaggataacacaagattcctgtaaaattcctcttaaccacatctgggaaatgaaatacatttcaagaacacaatttaggggagacaaataggtgtgagtctgtttgtattgcttcttcctgtaaatgacacattaaaaagcccctgcaggtgcttccagt

SEQ ID NO: 124698 - DNA, 1072 bp, Homo sapiens
tgtctcaaggtcttggcccaccactattcctctacccaatgggatttactcctttttcttcatcagaatttacatacttaaactacagtaaaaatgcagtatgctataatatgtgacagaatgattaaaaatgtaagttctgcagtcaggtggcttcgtcacttggttttgtaacatcagggaagttatctaattctctcttcctcagtttccacatgcaaaaaaataaagaatactaataaatccaatctcaaaggttgtgcaggaattaaacatgatcatgtaagtatggtatttagcacattatctgacatatagaagatgcttaagtgttagctattgtagttgctctattctttcaacatatttattaatatctactatgcactattttaagtagtgaacaagacagaaaaggttcctgctttcatagagctagaaagtgttctccaattattttatattattattgcttatatagttaggtttatgtattatttcagccgaccccactggatagtatttcctgaggcactattcttttgtgttttaaatggcatgctgtacagaattgtggatacagcttaatatctctttgtaggccagctactcagtgccatttacttggtttgagaacttattttcttggtttgagaccccaacaatgaataaaccaggagaaatctcttagttcctactaaatatatacttagtactttactaggattctaagcaagttgaaaagatggtcactgtgatagcttgggaaaaaaagaccaaagcactggagataaaaatgaaagggaagaaaaaaaaaaaaccttagaagttaattaattgctaaattatttggtaatggacagtaataataatgtaatttacaggaatatgtgactgatgtggtttggataatttagaaatttcatggaaggaggtagaaaccaaactaaaatcctgaagagttcacatcgttggaaaagatcaagagaagattctgggaggccaaaatataagtaaatcgccaaagtggaaataaagacaaccattttgtcatcctcatttttatattgca

SEQ ID NO: 124699 - DNA, 3698 bp, Homo sapiens
tgtaagtttgacttttttagattccacatgtaagtgaaatcatgcagcatttttctttctgtgcttggtttatttcacttaacataatgtcctccagttcatccatgtgattgcaaatgacaagatgtctttcttttttaaggctgaatagtagtccactgcataagtatatgcaccacattttctttggaaatatttaatcttgtttctttatcacacagacacaaaggagccctacatgtttataactttgtatatttttgccatatttggagtgagggtggcattttgtatatttttgccatatttggagtgagagtggcaatagggaaggggcattaaatgcatgaacttaaaacaccatcttagctggaagacatggttttttaaagtcatttttacttaaattctcatccagtattgccaggtgaccttgagagtatctgtacttcagccacactagttttctttcactttctggagctgaattttctcttgtccttgtttcttgaactgaacttaaacttgaacctggtcttcctatctcagacctattcatataaaatctcaaggagctatgtgtttatgtagagatactgtcctacctatatacctatgttaaaagagcttgcttccttgaaggagaaaatgattgagacctaggtgttttcatttttacatctgacctaagacaaaatgtacaacttagggccatgaaaaccctaggaggagggttctatcatcttttaacttaaatactggggctcctgagattttaaaaacaataagcctcactttgccagtatgaaaacaacctgtcaataaaatctcttcaagataatttgaggagaaaggtatgcatagtgattagaacattaactctccaatcttgggtccacccattaattggttctgtgaccttaaactctccaaacctcagttttttcatcaataaaattggaataataatagttcttttctcatagcattgtggtaaggatgaaaaataagcacttattccagggtcagactcaggataggtgctgagtaaatataaatgtatgtttttatcattataattaacattaatttgaccttcaagtcttatttgtgaaagtcctgaatgcccatagtgaatagttctagctttttttctcccaggaacttttacagtatcatacgtgtatccactcatacctttttagtgttgtacaaaagcccactaaaatatacactgtatatgtgaatatatacttttaaaataaaaaatgccttactctacacattaataaaatgcttttgtgacgaatacaatagaatgtttaataattgggctacatttgacatctttaggcataacctatacctaaaacaagtgaaaaaagttgatgaattcttaccccatcctgctaagccttgcccttgcttgggtggtaaatgattttcccctctcgccctctatgccagcatctatctcttggtagtagctgcacagagcattgtgttaagaaggactttgcagctgagtctgcattcaggggaaagattgccgtgtttttagctgtgacttctgggcataaggcagggagagcacagcatggacattgtgtttgtcaccccttagtgatagagaagagttaaaatcaagagctctctgttgcaatctttatattgtgttattggatgaacttcaggcaagtgtaggttgtctcagttctccattcataaaatggaggaaaactcaactcctgctttttcctgtggaatgcggtaagagaaaattgagtgttttcagtggctaaaagacattgacagtctttggagaaaagtcctctgtaaatttaagaaactggtataattacggatgagctgcttttactttggccagttctggaagcagaactcacatgaccttgtttcaaaaaccgtgacactctacagaattggttctttttgaagtagatcacttttcagatatcgtgtcttcaccatagaggaatctacttttcttgtaggaactaaagggaccctgcttataagaaaaaaataggttgttggtccctcctgactgtcttaatcataccctattattctagagttctaagtggatcttcagtgttcttcctcatcccaggttttggctccactattcctttagctagaatgatctatgaaaccctgctgcccttttgaattatgtcatttccttagcaagaatttttatttattgcttaagcatttaaagtgatttttataaaaacaagattgctcattgtaaatcatttacatagtaaatgtgaattgctattctttaattaacttgtgtttaaatagctgctgataggtcaaataaaatgcctgaaaatgaccgtggtttgtgcaggtcattggtgtcattgtcaaatggtttccttgcagtcctggggatgaaaggctgattagagttgattcatgagagacaaggaacagaggaatggaacagcccagttctgccaggccccacgacaggatttgagagaagccttcacaaatgttctggtttggaaccttgagcttggctaataccatgcttaacactgccatcgtctttcctctttcaattgcttcattggttaaaaaagtatatggttgtttaagtactgggtcctgtttatacatccttttatttctcatagcacctaggacagggctttgcatgtagaagatacaaatcgtcggactgaatttattgaaaaccagcgacaaatatccttctattggggcaggtgagaatgtatggccaggtatacatggagaacatgcgggagcaaaaagcccacagattcttaagctcttccactccaatgacagttgtgaggatctgtaataaaatgaagaagggcttccccattgattttattctggcaaatgatggcatccataaatgttcttctatacctgtggtctgtgaaggaactactctattgaacgtctggaacaaaagtaaagacgcagctctagaaactgatgcttgttctcaccggttttgctttttgcctgctggataaccttgccatgttttttttaacacattctgggtctaagctttttagctgcgaaatttggataattttgcttacttttgagaactaaatgaaacagtaaataagaagcatctagactagcataggggaaacattcagtaagtgtagattaaattaatgaatgaataaacatgcagttgcttagtagaaagattaccattcacaaagtcttgtagatacattaagtgggttaaggaatatctaagtgggagggagaattgctattttaaaatgtgtaaaatatgagtaattgcaatttcctcttgtctttttcccactgcccccttacatttccttcctagaattttcaaagtaacacattccagaggccagattagcttgataaagatgaccaagtatgctttgtctttatcaaaagagtcctatagccttgagttttatttcttcagccaatatgtattgagagcctgttattaaaaggccctgagcagggatatacgaagctatgaaggacaggacagctgaacagttcatcataaataagaaatcaactctgattggaaagagtatgagtggtaaagagagcacagcctctattcagttttaaagtgtattgttagcatttggcatagaagttagcaatagagagtaaat

SEQ ID NO: 124700 - DNA, 1109 bp, Homo sapiens
ccatgcaagccagaaaggtaattgctgttttatttttacttcactgatgttttcttaattaaaaaaaattaggcaaaagaaaaaaaagttcaaaggagaaagtaaaatattacccaaaaaagctcaagcggaagataacaaatgttaacatttatttcagccatgcctctgtacatactgtgagagaggaacagaaggatgggtagataaatgatgggcagaaataattgtgtaagactgagttcaaacaaaacatggctttaaaagtaaaacattcaatttgatcttgaatttaacaaaagggaaagaaattgtccatcttctgaaaagtaattctgtagcataagagtatttgttctcttaggttcagaagagaggtgaaaaccatcacaaggttgggagtcaggatggattgagaataacaggacaacatgataaacatcgagtgccttctccctttgtccctgcctggctttctgatgtatgctgcttgttttatttttgttttgttaggctttatacttttaacactctgtagctctaatttcccctgggtatccctccacctatttattcctaatcaatgtactgttaaccattggtctttttactatggcttttcattcttaaaaatttaatgggctgggcatggtggctcacgcctgtaatcctagcactttgggatgccgaggtgggtggaccactaggtcagaagttcgagaccagtctggccaacatcatggtgaaaccccatctctactaaaaatacaaaaatcagctgggcatgatggcagctgcctgtaatttcagctacttgggaggctgaagcaggagaatagcttgaacccaggaggcagaggctgcagtgagccaagattgtaccactgcactccagcctgggtgacagagtgagactgtctcaaaaaaaaaaaaaaattaatgtttggtgggcaacatggtgaattttttttttttaaagaaaggggttttgggtgccatattccttgaatttggaaacatttcatgtttgaggattattatgtttggaagattattatttttgaaagacaacttttctgttgccaaactgtcttctaaagaggttgttc

SEQ ID NO: 124701 - DNA, 1034 bp, Homo sapiens
ccatcatcacattgccttctacatctcctgacgccctcttataaggacccttgtggttagatcagacctcccaggacaatccaggataatctccccatcatatctgagaagtcccttttgccatataaggtacattcagtgcttctgggggttagaacatggacatatttgtggaccattattctgcctaccacagacaggcacataacttataacccagagttcccaaattatctcttttcacctatagttctgaatttttttccaaattaaataacacttttcagtctgctcacaaacatttttgttagccattcatactcctccctctgtgccccacaatgaatacctccttttagaaaagacctattctagaaatggaaggaactgacaccaccccctcaaatgactgttcagacttgttggcttaccttgatgttcaggaagcaatggttgggaaatggatgtctgggagcatctgtcttcccacagctcactttttgcctctgaacacgtacttcctgtgagaatgttaaataatttttggaattaaaaaagtcatcttcacattctaccatgtatgtatttggcatttggattggagagaggtttgcctacttgtttttggatataggtcaagtttcagtgacaaaatctcattgatgaattcatttaatcagaaatccttcacctcaacctaggttcttaaacccttaaagactccacagaaggctttcagagagccagaccctttgggactgtgcaaaaccatataatcatttctggaaagactggaccataactttcattaaattttttaagaggttaacctggaaaggttaatgaccaactgaattgatggctttattcttcatttcccccttaggtaagaggccctttgaagtacactgcatatgtatttttaatatgtgatctttttttagctgcaactcagtgtcccccattcctattgaaatagacctcccactgaaacctgtgtcttttttgctgtcagcaataaaaagtttactttt

SEQ ID NO: 124702 - DNA, 1051 bp, Homo sapiens
gaaagaatggccggtggggaggcccctctacattcattcgtgttcttccttttagttattagatgttataatccagttaataatatccccaagaagtgttgctgtcaacagtactagagctctctacagtctcattcatgttggaataaaatgattcctttttatgttttaaaaaaaagaaaacatttgaggtctcactggaagtgtttattcatttgagctgaaagatgtaccgtgggtgttgtgattttggagagcttctgcagcaggtttatgtctagaatgttttgtccctgtttgtgtttgtttagactgaaattaatagtttttcttgcaagctatgaggatcattaatacaggtttctcccccgtggtgtgtttgtcagcccttacatggaagaacaaaatgaaagaatatttcttgttttaagctcaaagcttacgtctttaccattaaattggggaacttgggggaagaaaatcctgtgtgtgtgggtagggggaagggatttgtgtatatgcacaataattaagtttaagtcataaatactaatagtcttctggcttttgtaaaccagatttctttcctggatctaaaagtgtttttattttttgtgcccacatctgtagtcatggatttgatgtatatatttaataacattcagtgatttatttttcggttcacctttttcatttttcccctttctttttaccagaaggaatatgaagttacatataaattctgcataattgaaaaagtgattttgatttactttttacttgagcaaggagttgcttttacttaaaggcatttttatttttaagaaatttgaaaaaaccccacttaaggatccacttacattaggccactagcaaatatttttagataagattttgattgatttctttcagtctgattccataatctcaaatttcttcgtttcttttctcctactttccatcctcttgatgctacaatcaataatttgatttgggagattctttctttttgttggggctggtggtggggagggagatcgttgttttgaat

SEQ ID NO: 124703 - DNA, 1057 bp, Homo sapiens
tgcttgtaaagggatgtgcccaaaatcttaccactttaattgatggaacagacaatgaataaaaaaactagaaattcagtagaacaaagagaacacattttaaaaaggaatttcaacagactaaaagaactccatgagaagaaattaataatggttgaagggtgaaagagttaaaaaaggataaaacctgaattttcttataaagaaacaaaacagtatatctccattgaaaaataaaattttattaaggtaacacaagtatctaaaagacagatgggaaaaacctcaaaatgcagaaaaaggcctgttttacaaggaagaatacaaagaatcagaagtttgaggtctaacaatgagactaactttataaacagaaaatcttccttgatagatgtatatatgcctcatgtgcgtaagacaaaggaagatggccatttgatagtgaagctatgaacatggtaattctactgctttactcttccagtgttttactcttcagttcttcgtaacaacaaatacatggaatgggcaggtgggacataaagccagagtagagaaaactaatgcaggattggtttttaaaaattagctgtattcttttctgagtacccttatcccctaatgaataaaacagttctatccactggcatcctttgcgcatgtggaaatatctcagaacagggaagggttggttaactgggagccagttggcacctttgaggctgagtcaggggcaggctttgccctggggcaggctttgcagtatttcagtcacagagcagttttattgaagctttcatggctaagtgggtttatgcatgatgggaatcagcactgcgttcacatccagatgttgactgtgggtcactttcatcctgggaggagtcagtgagtattttccgtggagactgatccaggacctgatggaaatgggcattttcattagtgatctagaatataaagtggaaattatactcttagggtttgcataatctcatagctacaaatgagaaactcatagggtttcctcagcaggaccaagaactagtttgagtga

SEQ ID NO: 124704 - DNA, 1169 bp, Homo sapiens
atgatttatagttttggttatgttgaccttgctcatctggttgaggtagtgtttgtcaggcttctctaccatatggttattttttcttcgcctttccatactatactctttggaagtaagttattatgcacagctcatacttaaggagtggggagttacactgcacttccttgagggtggtgtagctacataaattatttgacattcttctgtgagtcggatttgtttcttcttctccatttgtttattcaatcagttttttttaatcagtgtggatccattgatatttattatatactttggattataatttagtagtactttattttgtttctgaagttcgtccagctttagctattaggagtgctttcggttggctcctgtatccctttgatgtaagtccatccttgtggatttttttttagcatgtcctttcttttcggcactacaaggtactcaggctaatcttgtatagtccttgtccctcctctagaatcatttttttgcatgggtgatattggtcttgatccactaaattgatttcatcacccactacatggtttactacccacggtgaaaaacactaatctgtttccactcctcacatgttaaagataagaaaatagacacctcaaaaggtgaaatggtttatctaaggttacgcctctttggtagcaaatcccaggctaggcccaggtcctctgaacttgtagtcctgccccttttttaccactccatgctatgctggcagattccaccactcagagtctggttcagtgtactcccatctcacccagggtccttgtgcataggcagtcagatgcgcactcagccagatgtgctactgtctgccctgggcagatgtcagcaaaaaagggaaagtgggttggccggattcttggtggaggctgccatggtgagtctgtgttgcctggttggaatggtgttttgtcatggtgaaccaattacagacccacagagtggcactgctgacatcagcattttgcagctgtggtttgaccacatgactggcctctgtgttctggggaagttggcagaagagtggcttttagactccaacacccccttctttggtttctgttcctttccatgggggaggatgaattcaagaaagaagtgaattcaagcagcaaacccctcagatttca

SEQ ID NO: 124705 - DNA, 1057 bp, Homo sapiens
aaacctaagtctttcaaagctgaactcataaactgcttttgtcagcataatctctctaaacccaatttcccagatcatttgtttttttaaaatatgagaaacttcccagttcagtttctgatcacaaactctgttgctgatgtccttccttccttcagcacttcttaccttttatcttcccctattcctctcaccctgttgcctcctgtgctagtaatgtattcaaacttattgcctcccttactagattttaaatgccttgaaggcagggtgagtgtgtattccttaggtttctattcctcacatcactaaacatggtgtcctatctatagtaactgctcaattgaaaaaagtattaattatatttgcttaaattttgttagagtattctgtgaaaagttaattggaatgtgacattttgttttctagttttctgatttgttttgatccacagtattttatcattttatgatgaaacaacgaatatgccatcatcattttatgatgaagcaatagaatatgccatcatcattttatgtcgaagtaacagaattccttgttaagtccatgaaaagcacctgttctggttgctctcatctttggaccaaggagatattgcaaggagatctcaaattcacacatgtagtaatcattgtctgtagaataaatattttgcctatgttatgtactattttttcatatctacggtaatgctgttactaaaaatgtactaaaattgttatggaattcaaatggaatttttgtgaatattttatggatcaatgaatatttcacattttaaagcagatttgaaagaccctttctgaattggctcctgcttccctgtctagactcatagctcaccactcaccattgagacacaattcacatattatacaagtcatccgtttaaaggtacaaaatttaatggattttagtatattcagagttgtgcaaccatcaccataattttaaaacatttatcaccctctaaaaaagtttgcacccattaccagtcattccccatactgcccgtccattcccctaatccccaccc

SEQ ID NO: 124706 - DNA, 1054 bp, Homo sapiens
agtgcctcgccgcaggactcgcctccctccgccctcccaacccatccggaatccggggtccctagttcccccgccgcgtcatggaatccgctggcttcttccgaggacatcgccccacctccttcccgaaaggcgacttctgattggtgagattgtgcatcactctgccgccctcccgccccctcggggccccgcccctgggcctctcaggcccctcccctgcgctcccgcccttgcgcggctcctcgggctaatcgccgggcggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggtgagtggcggggcgcccgcctaaatggggcctgggtgtcggggggcctggcggcggcgcgggctcggaagggctgctgtttgcggggcgccgcggttctctgccggaccggggtctgtccgagtcgcccggggaggctccggccctggggcagacccaagcctgggagcttgggtgccggctgcagctcccggggaaggaggacccgggtctcacccaccccaggacaccttccctcgagggacggctcagaggattgaccgccaggaggagccgagcgcaggggccgcggcgcaggtgcgggaggacgcggcgcgcggagctgtcctgggcagcggggaggcgctacgccggggctagaggctcaggaagcctggtaaattggggcgagcgcgaagctttaccacatccgcgggatggggcgcgccggagagactgagacaacgctcgcggggcaggcgctccgctcgcccgccttcccaaccccg

SEQ ID NO: 124707 - DNA, 1309 bp, Homo sapiens
atattgttccttgtctctcattcttatttctgttgtatctccttgaactcaccaaaacccctaggtcccgatcatactcttcagcctcccttcctcggccagcctctcagtgtatctcttccatcactgcattgcctacatcctctacctttgtcacttgtatttccttttgtggcatctgtcctgcaaacagcctgagaacagcccagcaatctttgcttccatacctgatctgaacaccgtaggagaaaatcacactgctgtccgtcagcaccactgtaaacttaaccgtctctgattcagctgaaccagcagaaaccttgcgcagctgtccttttatgtatccattcttatcccagtcttcattgttattttagatgttcatcatgctcctcatgattcttatccccactgcctttcttatagcagatggccttgcctcccatttcagatatgaattatttacttcctgactacgaggaaggtttctgctgtaccccatccttcactttgaatgttgttcttaattcagatatgtttcagaatggtcaatcacatcagaacagtcgctctacatattacaccccaacatggtcattctaacacccattctcaacccccttgtcctctgcctccctctcccataaaagttggaaggactacatgtctactttctttttagcccaggaactttgcatgggaagccacatttaaacaatataaattctggaaattaatattttctaattcagtttaacaaaattatagttgtctctacctgaattgggcatgtgtagtgcgtccagaccaagagatgatacatctttgcaatttggggatagcaggagaaatctgtagattttctaagtcacctgcactgagttggggcatgttgtgttgtcagtaagatgaaaacttctatacttgtttactggtgaatggtagaggaagacagcccaaggatctgagacctccactgacactgcataatggaaccttaggcacattaacctctctgtattttagtttcctcatctgtaaactggcactaattattttagcccttagggtggttttaaggattaaacaagagaatgtacttggcatgttgcctggcagtcagtaaacattcaaagattagctattcttgaactagatgggcaacaatttatcaaattgtttaacaattggacatattgcctgggagagagggtgctcactgagatgattcttccaagtgaagtgaacaggatggtttagtgggagagaagtgcctggaattagggatttgtattcctgactctggccc

SEQ ID NO: 124708 - DNA, 1089 bp, Homo sapiens
tatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctggga

SEQ ID NO: 124709 - DNA, 1114 bp, Homo sapiens
gctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacaggtaggggagttgggatgtccccgggggaccgtgcagcctgcccctgagctcccattcacaagttcgagtgtcaagctactcctgtgacctgggcagatagaaacagccaggaccgctttttaaacatttgtgtgctttgcgttatcctcagggagaggtggctttacattgtagtaagattaaatggttaggtctttttaaaagttgcggttgtggtgattttggcttaatgtgttcgcccttgagcttcagatctgtgacttcgtgaccatgattgtctcttctgaaactggagtttgaattaggttccctctttgcttgggctttaacgttccttcacgtatacacacaaaaatacgtttttgaggaggtactcctaaaaatgtttttggtattaaagaatatttggtataaagagtattaaagcaaaacaagattcattctggtatttaatgacataaattagcaatggattggtaattaagtggctagagtggtcattcatttacactgtatttgttacctgaggaaaaatttactaagttgaagctttcgtttttagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggtaagagtcacttgttaaataaaacaacacaaaatgcaggaatataacatgtggcaaactatcaggagtgtgaaataaccgatgcattctttcttgtttaggcatcatctggggagaggatacactgatggagtatttggagaatcccaagaagtacatccctggaacaaaaatgatctttgtcggcattaagaagaaggaagaaagggcagacttaatagcttatctcaaaaaa

SEQ ID NO: 124710 - DNA, 1048 bp, Homo sapiens
tcccaaagtgctgggattacaggcgggagccaccatgctcagcctctaccttcttttcaaatgagtaacctgagaatcagagaggctgaggcacttgctcaagtttccatagcttttaaatggctgattcctgttccttattatcatcattaatgatgataattattatagccacaatttgtgagtactttctagatgtcaaaaatttacatacacctgtattttattcaggcatcaaaggaattaatgttcacatttgatcagtgaaaatatgaaagattatggttaagtacattttctaaggtcacacagctagttggtgacagagtggagtttgagcttttcatcgttgtaaagcaatacttttttatgtatgtttcacaaactcttcctatgtttttactaatggcactattgttagaataagtgacttatttccatggtgattctcaaggacaacatttttcattcatacgataaactatggcatacttattaaagtctcattgctttgcagttgtaccttccacatgcttctgttgtgacctatatcctttggtgatctggcagtgggtcattttcgtggtgatcaaatatgtatgtatgtaaatacaaaattgtttgttttattcatctgctttccttccagtctaaacactgagctgaaattgagacattggacatgatagtttgttgaagtttgacatttctgtccaagatttgtttggccaacctttgaaagcctgagtttaaactattccacaagcatcagtcaaaacacatgagaatcatgggaaaggagggcgcttttcctgcacagctgctctgcagaaggggaattgcatggcaaggcatctcctcttggccaatgttaggagagagagggcttttccttcctcaggagaacagctccccttctcttcacatccctaaataatgcaggaatgtcacattgcttgcattcctttgatgcttgtcctgactttgattttgctctggtacttgtctgaaaacagagctgtcagcaccttcatttttttgctcatcc

SEQ ID NO: 124711 - DNA, 1041 bp, Homo sapiens
ggttctttcattcatgctttaaaaataaactacgtaattaaatggctacagatacttcttttgtggggaggaaaacagcagtcagattctttgcaatcatgccaacagggcagtaggtttcctaaccctttggcaaaattgagaatcaataccaataagaaaaaaaataataacaaaaggggaaatctcacaggagtcacaggcgataaaagatttacaatgtgaataaaacattacaggtcagcattaaaacagatgatacgtctctctgacaagacaaagcagccagcctctaaccagaggtgcaaaaccgcatccaggggccaatgagaaagccccagaccagccacttcccttcccctcaaggaaaggagcctccttctcggggagacattcactccacaagctgcattcacagtttgacagttcaccttgtttgaaagtaaaattctctggaagtacaaatcttgcccatgcataatttctaggactagtatatttggaatttgtgaacaaagagaccagacttgcttttgaaaaggaaaagatgcttatctgttggttcattttgtaggtgaataagacttttaaaaatacaacctggagaaattatgaagtcaaaaaaggtccataaagacaggctgaattctgactaaaaggcagtggaagccatcgccaactggaggggttttatgaacatggtggaggggaactctcggagggtgatcattattcagggctcattagttcttgctgagtggactctcaatcatgggaatttccatattccaaagccaaattcttgaaaagaaaactcagaaaacgatattttggtgtccagccattatcaagggaatacatttgacaaatataaatcaaattttattattttctgccaaatcatggagagtaggtctatatgctcaccactcgaaagaatgcagttcacctccaatcagagacagcataactggatgcccaggcagcctgatctcacatcccttaaagttgccagtggacacacagccatggccaacagtc

SEQ ID NO: 124712 - DNA, 1107 bp, Homo sapiens
atatgcaacagtatgatgtgtttgggaattagcaagtctttatgtgtggcaggcagatgagcaacaggtaatgaggctaggagattggcaggggaaaaccaggaagggtcttgtgtggtacctataaacatttgaactgcaccctggaagccatggggagcaacaaaagcctgtaagcaggaaaatggcctaatcagctctgcttttgtagaaaatatattctggcagcagaaggcagggtgagttgttgggaggcaaactagccagttatgaagctgttagagtcatggagagaagacatgctgaaagccagtggcatggacaggaggggtgtgggtgggcgtaggatgagagcaggaagacccactgacctggagcaacacacaggaacgttcagggcagtctgttcttgaggcccttacgtacattttgctgattagtactaacccagggaataaaattggcgctcagctgcattgtgtatgatatttcgaaacattaaacttgcttggctgtaatcccaaattaattctggaagtgtaatattggaaacatctctttaactctttatggcttattgaaaatttcaccctcattcatcaaatctaagaaattaaccattgccaaagcacgctccaaagggaagggggcactgaagagaggttgctgaaaggaatattacacagggtgtgggcagggttgagggaagccaaccaggaagagggaagtactctggtgctggcagcagtgggaagctgtgaccactcccagccatcaaggggcgactggagagaacagctcctggggggagctgaggctgtaggagagggctgcctgccaggagctggggcatttggtggaggaaaccaaatgccattgccaactcacagctcagcaaggggggaaccaagggagtgaataccctgatatggtccaaggagggtggcctccaggggttaagacggtggggtgtggacatggagggtcaaatgggaaattgccagcatagtttttggtttgtttgttttttttttttggtcgcatgtcacatctatgaatacatttaaaaaaacctataagagaaataagttggttgaagaattccta

SEQ ID NO: 124713 - DNA, 1104 bp, Homo sapiens
gcacccttagcccctggtctttgcaggttcgcagatgctgctgctctgattccgaatgaagggctactagtgctgtcgctgtggtttttaggtgtttaaggaagaagtggacgaaatcatccgtttggttatagagaatacctttccttgtgtgtgatggctggcaagagtagttcggggatggggaggggagaagcaatgcccactgtcttcgctcagtacctcatgtacactggggtgtcgttctctgggacccgtgcccgacctggacgatgtgaaggaggccgtgacctctgggaggatgcatgtttttaagaacgactctcccggcctaacgcaaggaccttcgccctgttttcagcccaattgctgttcgtttttgctgcttccctggattaaggagccatggtcagggtctattcagaggccagccggcaggcggtccccctgtgacctaaccatcccctgcacctagcaatcctccttcctggaatttgtgtaacctcttattagcataacgaaaacaggtaccttggcagtcacttagtgactaacaagttccctttggtttatgggtccaaacccttctctggcttaacttctttctgaaaccaagtttaccaagatctgttgcttgaaacatctggtgctccccatggaacgtttgagttcagtctaatgacactttaacaccagtttccacaaaaccactttacccaaagttccttccaggggacttttaaaattctgtcttggctcaaactttagtgtttgcaactggtaacgatcaaccagtggtgatcaactaatgttcttcgggtgttgtttttgtggggcgcattcttatgcaaaatgggaattggggctaaactggtttgtttgttgctcttcagaattgccgtttgtgtaggctgttgccagacaagcttctccaccctcctggaggggtcattgtgtggaagtgctcggtgattcactgttatgctgatctgagcccttcctcttcctggggaccggaaccaatggggtgggggccagtgagagtcttggagggatccttctgtgttcaggatatactgtgggaggttcttccccactcactca

SEQ ID NO: 124714 - DNA, 1006 bp, Homo sapiens
agtttggttggttattgaagaagtggggtatgctagacccagactgcctggttttgaatcccagctctaccacgtctgtgaccttggacaagttgcttatcctttctgtgcttcattctgtgtgcattcccatgcacaatgggaatcagaaggggcttacctcagagggttgatgtgagaattaaaaagttcattccatgtaaagggcttagaacttgcctgtcacttaagtgcttagttagtaaatgttagctactgttaacttcaaagagacgaagtgctttgtcccataggaacataatttttaattttaaaaaatagataattccggtggcttacatttgagttgcaggagttttatagtataattttccataatttatgtacatatgcaaaaatattttggagtaggggattttccaagtatcaaaaggagtactgttttggtttcacttcttactggggcttatcatgatctgaaaactgactctggaattccccagggctgacacgcttcccttcataaccacagtcattcacaacggatgaagcatgcattcttccaagtaacacacaggttaaacaaagaaatgaacagtttttgtagaattgaatgtgtaaacgtatggaacagctgcctacagccagcttcagtatttcagagagctgttgccactttgaaactgagagggcttgtagtcattttgatgtggtttcctatcctggtacagagaccctctgctgggtgaggggtctggtaagacctcttgattaactgcctgaagaaactgttgggctgggccgggtgtggtggctcacacctgtaatcccaacactttgggaggccgaggcaggaggattacgagatcaagacatcgagaccatcctagccaacacggtgaaaccccgtctctactaaaaatactaaaaattagccgggcacggtggcacgtgcctgtagtcccagctactcgggagcctgaggcaagagactcgcttgaacctg

SEQ ID NO: 124715 - DNA, 1073 bp, Homo sapiens
tgctgggattacaggcatgagccaccacgccccgccatattccttttataatcaggaaaatgataaatgtaaaacatctccacagatctatacttatttacccagataagtccttctaccttaatttactttataaataaggagacctaaataattaaaaggctagagaattcttctaaacattcaaatatggttaccatttagagtgtactgcatattcagatagtttcaactatcatgttaaaagctctctggatgtattttttccctataacattaaagcttgtcaaactttttcactctttctgtttcttccaggaacaggacacactggcacatccttttcccaccaaaccacagaaaaacatttttaagtgaaggttgaagaaatggcaatttacagatgccagaagaaaggataaaaatcaaggcaagataagaaaaaaggaggctgatgttctgctggtccacttggtttactggcttctctgtctgattgtgcctaactctgacactgtgccttccctctagacactgtagatgatgtttagtcctagctcaatcagtctctccctttgcacatttccgttacaaccctgctcatgtgctcaagatattgctcctgctactctcccctctcttctgcatcaacagttctttctcatctactggacaattcgcatcagcctactatcatacacaaatacccccacctttaaaaacccctcccttggtcccacactagtcttcagattccatcccattttttgctccccttgacagcaaaaacctccaaagagtatctgtactcagtgtattttctcttcacccatcagcaaaatttgacttagttaccatctcctcctggaaacagcttcttcacctggcatccaagtacctctctattctcctacctcatcaagaacttctgctttgctgattcttcatccccttgatatccaaacatagcaatgtcccaaggctcagttctcaggtccaccaagcactctcccacttcacagcccttgtatttgcagccctttctgcctgtaagctctctcaaccctcttatc

SEQ ID NO: 124716 - DNA, 1031 bp, Homo sapiens
ctagcggttggtaatcacattgtggagggtcagggataataaactacagtgaagtagtctggaggagagaggctgtttaaatgcctctaagcgctaaaactacaaggctattgtgaatattgctgcaataaacatgggggtgcaggtgtccctttgatacactgatttcctttcctttggataaatacctgataattcttttagttttttgagaaatctccacgctgttttccatgactagtctaaatttgattatacctttgggattatttggaaagaggaatgctatacatatttggttaattctaagctgaagtgcttctgtaaaaataagcattactttaaactgctgtgtcatccaagtaaaggagttgtatttgttcaccaaaaggtcagtgcagatatgttcctgcgaggataaaagccaaagttccaattacctccagtgaattttcaggctgtgatgaaagcaactggaataagtcttccagagagaaagaagtatctgtcccattcagatgtctctgtagagaaacacaaaaagtgcatctttcacataaaagactgaactggttggggctttaggctttatctttaaaggatcaccaggtattatttccacactggatttttatgctattatgttccttggttggaagttctactttttattatattttgagacggatctcactctggcccagaatggagtgcagtggtgcaatctcggctcactacaccctctgcctcccaggttcaaaggattctcctgccttagcctccggagtagctgggattacagctgtgcaccaccacgtctggctaatttttgtatttttagtagagacagggtttcaccatgttggccaagttggtctcgaacttttgaccgcaagtgatccacccacctaggcctcccaaagtgctgggattacagacgtgagccactgcagctgacctatttctctgattatggtactcagtatttcaacatgcatacttaaaagtccaaagctaatcagtatttctat

SEQ ID NO: 124717 - DNA, 1527 bp, Homo sapiens
ttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatca

SEQ ID NO: 124718 - DNA, 1895 bp, Homo sapiens
tgtgttaagtattggggtaggggggtggatttgccttactatggatttggcatactatgttgacctcaatttggcttgagtctgagcagtttgctatgctgccttatttgttattcacctatattcctgaatgtggatattttggaaggaaagtaaggtaaatttggttcagattctgtataaaagggaaaagttaatttttaatacaaatacaaaatttatttccatagaaagcaaaatttataagttaaatataaagattaaaatagtgtttgaaaagctcactatagtgctaacaaactaaatgaaaataaggctattttgcatttaaaactgaaatacctcttaaaataatttgatccccagtgtttgctctttttgaagtaaccaacttactcttaaaaaggatggctgccaagatggaaagtcttactgggttttcatgttaacctattctttggacataactatgaattttgtatacaatgcacttcatgaaaagttgtggctcccccagattgcccacaagtgtgatcttgaagtcctaaacatttgtccatgtaagcttcaaaacagcgttaactgagttattcaagtagcagtacttaaagatacaattcttgaagcagtttcaatggtttctgatccaaataatcagtttctgaacattactacttcacataatagagtccatcttcagtttcttctcactttctctttcccttttgggtttcctttttgtggcctgaggccaccagttctttgggtactatcaagatacttccatcatgggtacactggagagcatagtggttgggattgactggcctaccttggtcatctcttaatctactaaaaatatcatgataaaggtcatgcagtttctgtttcattatgttaatagctttgttacattgtgcttgctctctcttaagagtttccttctttgcttgcaagttacatacatcatcttctaaattcaaaattatgtccaatttgcgtttacgacagttctgcgcagcaactttatttttccctcttcgtctgatgtcacggataagtgagacttgtaggtctgtcagataatatctacttaacatgctattgaaagaatcaacaggcatgccgacaatttcatctacagaaaaagggatatgcaaagctttagcacgctgttcatcacggctcaagtttctatctgtgtcttcaaggtatctactccttatcttctgtgacttcccaggccacggaaaaggttcagaagtagattctggtgcagttggctgtaagtggtaagtgtggttatgaaatacgtgttgaaatgtaagatctccatggaaatcagaatcactttgatccaagtgacaaagcttactgggttctgggtagtagccacctacagcaccttctaagtcatgatgggaactagattcatggtcagtgcaataacctatagcaccttcatcacacacagagtgagaggaattagacttgatgacagaggtattattgtgacttgaatctaaagaaaggccagaatcagaatctggttcatcaaaaagctgagaaacatcgattggatcaaagttgtcttctgtggccaatgacattaagtttatctcatcaaatatatttatgtcaaggtcatacagtaggtcttggcttgttagattcctcatatgattgtcaaccggtgaaagaaatcctgtcaaattagttccaggaagggtttgctcaggattggtggtatgagaatttaactgcagaaatggttcttgtgactgtgaagtccttgctgttggatctcttctaaatgtattgttgggacaaagcaagatggcctcatgaagattcacatcctgacttatagcctggctgaagtttacatgataatg

SEQ ID NO: 124719 - DNA, 11790 bp, Homo sapiens
caaaaagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgtctcctcggcgagcgtttcggcgggcagcaggtcctcgtgagcgaggctgcggagcttcccctccccctctctcccgggaaccggatttggcggccgccattttcatggctcgccttcctctcagcgttttccttataactcttttattttcttagtgtgctttctctatcaagaagtagaagtggttaactatttttttttcttctcgggctgttttcatatcgtttcgaggtggatttggagtgttttgtgagcttggatctttagagtcctgcgcacctcattaaaggcgctcagccttcccctcgatgaaatggcgccattgcgttcggaagccacaccgaagagcggggagggggggtgctccgggtttgcgggcccggtttcagagaagatatcaccacccagggcgtcgggccgggttcaatgcgagccgtaggacaaagaaaccattttatgtttttcctgtcttttttttcctttgagtaacggttttatctgggtctgcagtcagtaaaacgacagatgaaccgcggcaaaataaacataaattggaagccatcggccacgaggggcagggacgaaggtggttttctgggcgggggagggatattcgcgtcagaatcctttactgttcttaaggattccgtttaagttgtagagctgactcattttaagtaatgttgttactgagaagtttaacccttacgggacagatccatggacctttatagatgattacgaggaaagtgaaataacgattttgtccttagttatacttcgattaaaacatggcttcagaggctccttcctgtaatgcgtatggattgatgtgcaaaactgttttgggcctgggccgctctgtatttgaactttgttacttttctcattttgtttgcaatcttggttgaacattacattgataagcataaggtctcaagcgaagggggtctacctggttattttctttgaccctaagcacgtttataaaataacattgtttaaaatcgatagtggacatcgggtaagtttggataaattgtgaggtaagtaatgagtttttgctttttgttagtgatttgtaaaacttgttataaatgtacattatccgtaatttcagtttagagataacctatgtgctgacgacaattaagaataaaaactagctgaaaaaatgaaaataactatcgtgacaagtaaccatttcaaaagactgctttgtgtctcataggagctagtttgatcatttcagttaattttttctttaatttttacgagtcatgaaaactacaggaaaaaaatctgaactgggttttaccactactttttaggagttgggagcatgcgaatggagggagagctccgtagaactgggatgagagcagcaattaatgctgcttgctaggaacaaaaaataattgattgaaaattacgtgtgactttttagtttgcattatgcgtttgtagcagttggtcctggatatcactttctctcgtttgaggttttttaacctagttaacttttaagacaggtttccttaacattcataagtgcccagaatacagctgtgtagtacagcatataaagatttcagctctgaggtttttcctattgacttggaaaattgttttgtgcctgtcgcttgccacatggccaatcaagtaagcttcagctttcagtaattgttatcttagagattatgccacgtgaatgtattttattgtacatatggttaagctgagtaattcatattctgtattgtcatatatcaaatatagacatgtccaccaaaaattaaactttttaagcttcgagtgctgctggtcataaaaattaatttgtcctggttataagagtaatttttaaggttatttctaatgcatatctttaaatattttcgtaactgagagtcatatggagaaacttagtgtttgttgtaaaaagttgtgtttttttggctgagatacttagaatcaccaccagagggggcagttaagggaaaataaatgatacttttcagatattgaatagtgaaataaaaactttgggtcataagtaatgaaccaagagttattttctgatgtttaaaaatagaaatttgcgtttttaggttgtagggttgaaatttttggtaaagattctttaataatcctttgataatcacggtctacatttgtttatttttccttagaaagttttttttttaattaataatttaagataatttaatgttgagtaaatttatatcaagcattaatgactttgaaacttgtgtagatcagctgaggcaattttttggtgtaacacaactaatatgcagtttaacatatggtttaaatttgatgtaagttttttttttccccccagaaaactttagaaactgttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtatgtaaattactgaattgttactggatattagtcttttagctgtatgttaagtgaatcatggaggaaataactatcagcatagtaaaaaattctattatgacttcacttataagctataatgagattaaatgctaaagtttaccctttggtttgaaaggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggtaagcaaacaatgactgtcttgtgcattaacatgaagaacgctgccctgctgaaaatcagaaactatttctgaatttagttttaactcaagattttttctcttattaaaggtgtgttgggtttctggaccattttcttaagctagcttatttttcaaaagctaggtccctaaaagctattttatatctggtagttttaaggtggatacaagcgaagtatggtactacggttgggtgctttgaattatgcttgtgtttttttctgtttggatgacttttaccccaccactattttaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtatgtaagtgtctaaccacaaatgtactgtttttttccagtgtattcaattttgtgtatgttaacatctgtaactttattgaaaggtaaacttttgaagctgcttaatattgttgatttaatttaaaaggagtctgaatttttcattccagtgcagaaataccataccatcaatggtcataatgcagaagtaagaaaggctttgtctagacaagaaatgcaggaagttcagagttctaggagtggaagaggaggtaattttaattctgtttcttctttatttttgttcatatataagggcttgcttctaactggggcatttattgtaggcaactttggctttggggattcacgtggtggcggtggaaatttcggaccaggaccaggaagtaactttagaggaggatctggtgagtttcaagttctacgtgtttaaaggatgagtgtgcttttattttaaatatgattaggttttcattagtagaatcaagaaatccaacctaagtcaattttcctaagacttcaaatagattgtatcctggcaagctcttgtgatttggccagacaagaagttaatagagttgtattaataacagttgtatttatctggattaataatgtaacatgaagtgtcatccgaaaagctttgacccccatcaagtgtcattcttacgtataaataggatggaatctctaagattgagacttgttaagagtccaaaatttaggcggtagatttaattatatgctttcatgttttgtgggtaaactggtagcactggtgtgtccttttctgcggttcttaattattgtgctgaggtagtaagagaactgaaaatgaatattagcaataatgctgaacagtttatagtaaacgtaatctttttttggcccctaacagatggatatggcagtggacgtggatttggggatggctataatgggtatggaggaggacctggaggtcagttttcctctacgttttggtttgtttatgtgactaatacttaactatatcgtatatttacttcatttatattttgagtttttaaacattttatattagtgtctataaatggcttgggtgatagtggtccagttatttctaagtagttttgccatcttagctgttatagcctaaggaatagagtgccattttaaatgaaaatgtaaagataaccatcagagtatctcatcttttctcaagcaaaatgattggatctagatatatctttgtacgtgcttctctggaaaagtacagaatactggatttaacagagtaaaacctaagggggtggtatatgtaggaaaaaatatgaaatatgtctaaacccgtaactagatgggaagcatcccaggataactttcaaaaagcgtaacctacggaaatgttccaaaatgtttagtgtgctcctggctgcagataaggttgtgaactaccattaaacatgaagtgtgatatatcattggcgtacagaaaaggctgatacacactgacagattttgtaacaagggacatttaaaactgagctggtaatagacttgatttctggtgttgccactcaataggcatgactaaatagtgtatctcactgttctactttttataattaaaattttagaggaagctgagttcttgtatttaactacaagttagagactcagcccacaagctttttttttttttttaatatggtttcttttttttttttttttttgagacggagccttgctctgtcacccaggctggagtgtagtggcgcgtctctgctcactgcaatctctgccttcccggtccaagtgattctcctgcctcagcctcctgagtagctgggattaccggcgtgcaccaccacgcccagctaattttagtatttttagtagagacggggtttccccatgttggtcaggctggtcttgaactcctgacctcgtgaactgcccaccttggcctcccaaaaacgctggggttacaggcgtgagcaaccatgcccagccttttttttttttttatttttgttttgcagtatgtgaaagtgtaaatttttgtttatgtccgcacttctatttacagtaaagaacatactgtgtggagtgttgggtctgttttttttctttgaaatggggtctggctttgttgctcagactggagtgcagtggtgtgatcttggcttactgcaatcttagtctcaagccatcctcccacctcagcctcctgggtagctggaactacggggtgtgccaccatgaccggctaattttgtgtttttttgtagaggtgtgggggttttgctgtgttgccctggctggtcttgaattcctgggctcaagcaatccacccgcctcaacttcccgtactgctgggattacaggtgtgagctgctgcgcccagccaagaacattgtttcgttttttgagagggagtctctctctgtcgcccaggctggagtgcagtggtgtgatctcagctcactgcaacctctgcctcccgggttcacgccattctcctgcctcagcctccagagtagctagtactacaggttgctgccaccatgtccggctaatgttttgtatttttagtagagatggggtttcaccgtgttagccagggtggtctcaatctcttgacctcgtgatccgtccgcctcggccttcccaaagtgctgggattacaggcatgagccactgtgcccaaccgagaacattgttttaagatatgtaattcgtagagagacataatagaaactttatcttttgggccagtaggaggaagtgctcttttactttccctctagcccacactactagtctagcctcacagtccttacccacaatatacatgaagtatttcaagatacttaagatttttagttttgagggaaagctgtggaattacaggtatttaactgtgtgcacatggtgttatccatttggctgagtaaccccagccaccaaatgtttaccaaggatagttattcagtccttgaagctattttagaggaatttcattaaatatttcacatggaaacttggaaagctggaaatggatgtgaggagacagttcaaaatggtattgaaaatattaagtgattacttaaaggcttattttataataggtggcaattttggaggtagccccggttatggaggaggaagaggaggatatggtggtggaggacctggatatggcaaccagggtgggggctacggaggtggttatgacaactatggaggaggtaataaattcacctgcaacctttatgtgggaatttggaattaatgtctttgtaacacttgatcttttgtttccatgtttgtcactagatgcccataaaatttgtggataagtgtttgcttttatttgtttttatgggagctttgtcctaagtccttggtttaatgtttgtattgttctgagtattccaattttttaataggaaattatggaagtggaaattacaatgattttggaaattataaccagcaaccttctaactacggtccaatgaagagtggaaactttggtggtagcaggaacatggggggaccatatggtggaggtaatttataaaaattgaggttattcagatttttgtgattaaaggattagccttttgtgacttaaagggaagataacatactaagtagtttgtactgtgggcagtgctccatgtacggtcttagtgaaaataaagaaattttgcataaatctccacagaagtactcagcaagcagttatgacatcaaattgggattagggatgttggaggtgggggtgttcagtagtttaatttctggtggggactcataaacagctaaatacagttgcaacccacattgcaagtggtatacattggaatgagggtctttgaagttaaatccttaaaccatgattcaaaccattgcttagcttatttttgaggtttttagctaggagtaaactagctttgtcttgggcttgatgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcattatgcactgtatattcagcgtttgagtactcctaaagtttctggctttacttttacgtttagcaatactggtggcattttgaaaatcatggattttaaaggttaaccggctggagtggtccagattaagtggctttgcagaagcactgaggtttacaatatgtgctagattgtcaaatgtcaattagttttattgtggtttacactgagtaaatgaatatcagtgttgctttttaaatgtgtttatttggacatttatctgaattaagaaaaccaaaaagaccaggttaatttgtttctatgataatttgttttggttttgataatgtgaggtatctaacaggtaagtcaaatttaacagcaggtaacacatagaaagcagctttctgtttgaaatagctgagttcgtcaattaaagacgtacaaatatcccaactttaagaaaattttgaaggtttaaaaatgtgtggatgtacaaagacgttgaactttgaaatacatcaggttgatatgcataacctcaaaataccaactcctatccagccaaggtca

SEQ ID NO: 124720 - DNA, 1059 bp, Homo sapiens
cttgcttctctgtatcaccctttaggtacttcctgcatagttgtttgttgcagtgttgttaaaatgagtgaaaattagtaaacttggtcttttaagactacagggccgggcgcagtggctcacgcctgtaatgccagcactttgggaggcccaggctggtgaatcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggttgtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgta

SEQ ID NO: 124721 - DNA, 1051 bp, Homo sapiens
ttatttgcaaaattgaagtaataatgatacctggcctctggggcccttaccaggattagatgagataatacatgttgcaagctttgcacggtgtctgggacatagtaaacaattttttttggccttattgctattttggatttttaatggcataattttaacattattccccagtctcatcctccacagtccagtggagttagtttaggaggaaagatagaaaacagaggccacttcactctgcgttgttgctggctaaatgctttctttcctcacaagacgaatgattaaccatgagtgggctcacaggtgggctggcccgagaggcgggcgactgtcaacccatcttcccttcccaggtggttgggcggcttagaaacttgatggagatgcagaaatggagaaaaccagctggaactcattcaatcaaatttaatatactgcatattttctgggcactgacaatatgccaggcactgtgctaagtgctaaagttgtaaagcataaataattgggcaaggtccctgccctcaagggacttttcagaggacatataatcctcaagaaaatagattaatagataaataataaattaatatagactgcgacaaagtccgaggagaaaatgaaaggatagagttcctaggggagtctgctttagtgggtggttagggaaccctctttggggaggtggcctttaaaccaagatctgaagctgggaaggagccaccttggtgagttgggggtggggaggtggaaaggggagaatgtcgagagtacagcagcacgaggggactgaggaaggatctggcgaggaacaattttttttttttttttgagacagagtctcgctctgtctcccaggctggagtgcagtggcgccatctcggctcactgcaagctccgcctcctggggttcacgccattctcctgtctcagcctcccgagtagctggaactacaggcgcctgccaccacggctggctaatttttttgtatttttagtagagatggcgtttcaccgtgttagccaggatggtctcaatctccgg

SEQ ID NO: 124722 - DNA, 1122 bp, Homo sapiens
attgtcagggtgtgtggggttgaaaagagcccctggtgatttagacataccttgccttccatctcttcaaattgagaaacacagctcttcacagaatccatgggcatctgggaacatttacatctcttacttttcaattaaattttgaagggttatagaggcacactataggaacatggaattctgtcaattgatgagaacattggctcagccctctgaggctgagtcactgtttaattggattactgtgtggcccacttaaataaatactgttttggaatagaaaagttattttattttgaaattgtatgaacaagactttggagacatcctttaagattttcacgcacgtggatgttgcccttttgttgagagaggcagtgtcgaggagataagagaacagctggcattgcatttgtgtctgcaccaggctctgtggctttgggcagtgatttaacttctctggtaaagtaggacaaataagtcttgcactgcctgcctcgtcagctgtcatggaacagtgctttataaattacacaatatcagaaaacaaaagttacttcaaaaaaatttagtttctgtacattatggcccatagcacattatggcaaggatgtaattcatgaccatggaacagaacttttcactgttcacagatgactggtctctagaaaaatctaaaggagaatatttttataactttggagtaggagtggtctttgtaaggatggtgcaaagcctggaagccataaggaaaaccttcataaaattcattatctaataaaaagtattggcatagcaaccaccataagcaaaacaaacagattacaaaccagaaaaatatacttgaactttatgttatgtattaaggattaacttccctaatacaaaaagaactcctatgaaccaataaggaaaagaacaggaactctgtaagaaaatgattgaaagacataaacaatttgtataaaagaaaatagtggtgccgggcatggtggctcaagcctgtaatcccagcactttgggaggccgaggctgtcggatcacaaggtcaggcgttcgagaccagcctggccaatatggtgaaaccccgtctctactaaaaatacaaaaattagccag

SEQ ID NO: 124723 - DNA, 1025 bp, Homo sapiens
caggatgcttgcctcagccttgctgaactcatcttgtggggtgtatgagtgagcatttgctccagctgcacacagtccctttcatggagtcggacattcttgcccaagcgcctgctccctcctccataagggcactgggctctttccttggcacagggctcacttggtgtaactagactgttcctccctgtgtgatgtgacctgaagtgtgggctgaaaccccttttgaatgtatgtgtgcatgcgtgcatatctcccctgctctcctggatcatgatggctgcattctacttttagagattcatccctttaggataactgattttccccttcccaaatgcacatgcttcatactaggtataacagcagcttctaggcaactccagttattgacaccttagcgatgatatatccatcacttctttggcagggaatatcctgagtaggacaggccgaagtgggccccagagagttgcacaaaccatgaggaccccaccactgagggaggagatggggcactatggggagagccggcagggagggatgtgttgccattttggatgagcagcccctaaggttaatattaatatgtctaagatatgcttatgctgacccatggtaatattttggacttcctctaggaaagcatgcttttgatattcggaaactgactggaaactgactggtctggaactgatgaatacctttaacaaataaataatattagctaggatcctgtgatgctgggtactttgatgggaagcaacaagacagaacattttctcactccccaaaacctaaatttgttgttcctctctccctcctttcttcctccctttttcccctcccaccctccctccctccatttttctcagtctctgttatactcagttattaagtgttcctgtttgaaaaaatagttaagtttccataagaggcaatttacagtcttctgtaagcaaagaaaggcagctgggaatattgtcttcacacatacacaccaggtttcagagaaggctgttacc

SEQ ID NO: 124724 - DNA, 2165 bp, Homo sapiens
gcagttctgaagaatatttctttgtttatgatgccattacaggaatttgtaagtgtctgggttcgagatcctaggattcagaaggaggacttctggcattcttacattgactatgagatatgtattcatgtaagtatgtagtcagtagaaatagtaattttgagggacttttatgggatacattttatgggataaagttgacacttgtaaaagtttttctcattcaaataactgaatttgaatgattacaactaatgcttttatcttacatgaactagtaagatggttcctaaagttgaaaaattacttatttgaatcccttattgttcctttgttaatattaacattttaatgtttattgccttcacatgtgaagatgtgcacgcatctaaaatgcatgggtaaagagtacttatagctcattaatggcatttcttatgatctgctatagcatatttctggataatataatgcctgataaccttcaagtttgagaggatatagagttctttggaaaagagatgtgtggtgttttatatatagaatcagaaggtgggaaatggatatgtgcaattattgtgattaatttatctagaatctgagtaattaatgtaacgagtaagcaactagaaatgatgtgccttgcgtggatgctactgtatcacaatctcttgaaaatgttgtgtggtgtgtggccttctgtgaccatcttaaacaagggtaagcaaacttctctgtaaaggtagtaaatatcttcagtttgtgggccatacagtttctgtcgagactactcatttctgctgttgcaggtgaaaagcagccacagacagtgcataaatgaatgagcataattgtattccaataaaactttatgtgcaaagacaggtgtcagaccagatttggccctcaggctgtagtttattggccccgattttgaggataatactctttgcatctaaaccagatgcatatcagatgcaaactaaattagttcaactggggagcatagcaattgacccagattgtatccgtgacttcatagcacaagtgaagtaaaatttagccattatttaatcttcccattgtaaatagctaacttggtatattggacacccaaacaccagctgtagaacttttctttttttaaattctcctttcttctcttttttctttgaagtttccccaactttgaaaataaaagaaaaactcagaactgcttttttgattgtgttgtaaagccattccaggatatgccatgtattttgattctgttttggttttacttataagctcacactagagttgcattctgtgtggaaaattatgactatataagaataagcatttgaagtaaaatgaaatagttttagttgccttctaactttctgtaaaaaaattgtgcgtccttatcacacacttcatgataggcatgaaatttaattattcccaggaattaatgaaagtatagattctgctctgctctataaatagcctgatgtaaattcagaaatctccatctggagccagaaatgatgggttccacaaatactatttgatggtgtcctggcacttttctgaaatgctaataaattgacaatggataagccttggcttggtggacagcaaaaacaagcaaatagatttattagaggaacttaatcagttagtgatctcagtatcctctaatcttgaagagacttccacctgtcatacaattaaaagtggatggcagagctagggagttctggttggcttctcttagttgttaacccatagagctttggaggtagagaagctggtctttaacttgtttaaattaacctcaagggagatgatgtcacacaactctgggatcttaacatttacttggaattttaaattagtagaccctagagctgggtagccatcataaatactcccctgaacctgccctgcaaatgaaggacttatggatcgaccttagtctggtgtaggtaccaggtggatttttagttattgacaaccatggtggttgtgagcagagaaattaaagggaatttaaatggacccagcctgtgtgtgagatgtcaggaatccctgtggtggtctgggattctttagggagagggtaccgggaagataacctgctcaagccttgttaggggactagttctggtataacatgg

SEQ ID NO: 124725 - DNA, 1510 bp, Homo sapiens
gatgaagatttctgcaatgtctcataaagggtcatgaggaggtgtctctaagccccaaagtttcctccagcttacgtggatggtggtaaaatgcaacggatgaacctgagctcctacctgtcatttatatgttaggatttattttttatgatttattcttgaaagcagtgctcataggtgagtaggaggctccttcaggatgcagggagtggccaggtcatacctcaccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctt

SEQ ID NO: 124726 - DNA, 1944 bp, Homo sapiens
gaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatc

SEQ ID NO: 124727 - DNA, 1530 bp, Homo sapiens
aaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattca

SEQ ID NO: 124728 - DNA, 1046 bp, Homo sapiens
tttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaactttgccggatcacttattttatacaagagaatatattctgccttagacccaaactcagtgttttttattttttatgaggaaatttggtaaaacatggtttaatattagctatagttgtacatatttgaggcttttagccttggtttagttgtttcaatgtccacacactggcttcttaaaactgatttcttgcagctgagatatttagatgaacttcagttcccagtggttttcttgctttgtctcttatttttctctggcatattttttataaagctttctttaggaaaaagaaaataattactgatgtagctaacttgaatagatgtttatttaacactatttttaatgtgacttaaatgtaaagaattctaatcctggattctttatgattacaatacagcaaaactgcattttccctggctgattcttaaagggtaaactattcacctataaagccaacttacgtgttttgttgtagaactagatttatatataacccaaaggtgtcaacagcactgaacgtcaacaacctgttacttcggcttcttataaagtctcacttagaagaaagttacttaattctagttaaaatttcaagttttaaaaattactagggacaaacaagtatttatttttaagcagatactattccttaagatatgaagtatcttgccagtttttcaaacctagtccacattttattgaataattaaatacaaacaagtgatatgcagtataaagtaaaagaacaaagtttcttttatgacaattaagaagttaaacaac

SEQ ID NO: 124729 - DNA, 1036 bp, Homo sapiens
atgcacacgcttctgaaagatgattagatcagcacggtttaagataccccatatttttactggtagacaagagaagccggctatgtagagaatcctattttaatcctttcataaagacaagaatcttagatcttagggaaacttggcttattttcacaaatatgcacgttctgggttccactgcttatagaggacccggtactggggagcatgtgctctaaaacctgttttagaggtaaaacacaggtgctgacctgccctgggatccgtgcagtacaatcccagctctctgcatagcggtgtactgggagccctgtgctttcgtttaatttttttttaaacaaaagaaattacagaaaagtgcaaatttaacgtgtgacatttaacattttgccgtggcaggcagcctccacttaaatggggcctttctgcggaacaacaggagccaaaaggccttgtgtcatggagtaatgtaagacacaatctgggctgcaaacgcacaatgaatcgggaaggatttatgtaattaattgaccagtcttaacctgttatcgtgatgtaaggaatttggaactcattaatttgggctctgacagatttcatattagagctggcaaatatggattgagcctcttattcttgtagcagctggaatttccatgacagtgaggcttagtgaagaagacctattgctggagtcaaactgcctcttgctaatcagtagccctgctctgtattaaagggataatgaaagaaaaaaaaaaaggaaaaagcatattacctagttgggggagtggaaggggcttgtgttcattctgctagtacgtgggttgagctcaagcatttgtagctgaaccaaacattaattgcaatcatagagttaggtgatttctcaacaccttgagagaagagaaggtagaatggtgtcagggtcaggtttgatattatccaagttaaagagggattaaaagacagagcctctgaatttcatctgtgtgcacatagagactgtatgaagaaagaggtagaagtctta

SEQ ID NO: 124730 - DNA, 1046 bp, Homo sapiens
agttttcccttattgctgtactatgtgataaggttaatataacagctgccatacagatcattaatacagggagataagcaaagttgcatgctggaaacatttgcagggtatcatttgccttcttctgctgataaagaagccttaggtaacaaatacagatcacaggcactgaatatttaactttttagacagaaatcccaattgatctttcctaatatgttattattcataaatgctctttaaagttgggtactgactgctctcaaaatatgattttttaaaaaaaatttgtatgttacctaccttttcaagtttacagtcaaacgtaatttactttttaatatgacaaatagttataactcttgcaaaaacaaagatttccatgcccccctcttcattcttatttttcttttttgaaaattgtcttaaattcaaccaaattccaaagtaaagaattttccttttagttagtgataatgggatttgatctatcaatgaagtgctcagtataaagatttgtttttgattatcttgttaacaagtgatttctttagttttggctctatttaaatgaatgcataaagataaatgctagaaatttgcatcaatatattaatgttatccttcacattgagagcaaagagggagctagtatttgttattggtagtattatttcagtgagaaggcaatgaggataaacaattgataccagcaagacttggataactagtataaaccatgacaagggcgattaatagtgtatataaacacacttcaagtttgtatacatgatctcagctctcacctagtgatttctttgtatttttttaaagggtgatttgtaagttggcagttacaaggctatcaactcatgtgctgtgtgtactgtttatatattagaggtatggaatagacatactgaagtgtgatttaccggagagagtgttgatttggaaggatgtctggtgaatcaggttctggctctgtggctggcacgtacccaaaggcagttcccaacctctctggatgtcaatttcctcatcag

SEQ ID NO: 124731 - DNA, 1072 bp, Homo sapiens
tcttgagctccttggctcaagtgatcctttcatctcaacctcctaaaatgctgggattataggcatgagctgccaagcccagccaacttttttaaagaaatgaacttaaacatcatgagcatatatgttaatgtaatgttacattatttaaatcttaagtaagaatatttatttatccttgccgaattaatggattaaggatatttaacgatcagttactgacccagcaactccacttctaggactctatattagtgaaacagttgagcaagtgcataagtatgtatgttcagtatatgcggcattgtaaatcatgaaaaatctgagacagcttacgaatatattaataagggaatggataaatgagccaaaggacacctctaaagtggaacactacattgttgtttaaaagttgagctacaaatgtatgtgctgatgtgggcggtgtctttgatatgttgttgagtggaaaaagcagcctgcagcagtgtgtgtagagtgtgagaccatttctgagaacagtgggaactctctctccccacctcctctgtcttcgtaggaacacagaaaacagtctggaaggatacacaccggacaacctttgagtgtgaaggcatgggggaaataagacgaaagacctgatcttttgctttatatacctccatattatttgaatttagcttctccagtgtttatggacactatgagttaacttgacaacctgattaaataatttaaaaaggaaatttcatgtcacagaaaggattggatgaaaagagataaatgtagctacttgaaatttctaacaaagaagcgtggtttccttccattcggttaactctggcactcaaagaatttgtgtctctctatgaattttaacaaatagaacctcaaaatctgggcgcatatgctgtcaacccagagtctatgtcatcctgggagcggctgtggtcctcagttgatttcttggtgccgtatttcaaatcagctcataaattattaatagtacatgtgtaggtcagagacacactaaccctgacaatcatttcataatattctctctttagcatta

SEQ ID NO: 124732 - DNA, 1099 bp, Homo sapiens
agggcccagctctgtgtccagttcagtaaatgttttagatgattgaatggatgcctgggaggaagggaggtgtgctccccagcaaacaactgagtgaatgttttccaggggtgagtcaggagtgatctgtaagtgctatcctctactgctttgtcttctgctgtttttctttcattctttccctcctgcattgcttctcttatactcatttttaaaatacatctttctaaaatttttaaaaaaattttttaataattaaaaaaataaagatgggatcttgctaatttgcccaggctgatcttaaaatactgggcttaaggaatcctcctgcctcggcttcccaaagttctgggattacaggcatgagctactgcacccagccgatttttttgtgcacaaatttttagaaatacctgccatgcaggggtttgtatatttggggcatagatacccaggtaatacccccatcccagaacagttacttcagttgttctgtggatgataaatcagagacctacaatgtagatttctcttttatatgtctttattgcctatattaggattcattagttacaatgaaaaggagaggtagaaacaacataattcagtgttctgacacaaggctgtttcctctggtccacaggctaatttttttttttctacttagaattagaaactgatgatacttccactttttcccttaggaaaatgtttaaggatttagtgatcttactttgagggtaattctccaatgatgctgcctaaatgtttctcctttaatttcatcccaaggccaagctttaatgcttgaaatgattagttcacactgcaactaatttagaatttgagttaacacaaacacagtttgcatgtatattctcataagaaaggtttgaaataaccctttatctgcaaggtttcagtattaccaacatgcagcatttcatccaaatttgtcaccattttacaaacaaagggctcaagaaatcaaggccttttgaatcatcagggcctactaaattttttaaaagactaaatgcttatgatgcatgaataggtaatggaggcatttacaaatttcaatttttagtccattaat

SEQ ID NO: 124733 - DNA, 1049 bp, Homo sapiens
ttggcctcaactttctaatataaaaatatcactcctgctagagtaaaagcaggtgccattttgtagcttgaactgcaatttacttcttgtttgaggaaagtgtcacacaggtactctcaaaggagaaaattaatgacactagtgtatgctggttaaagacagctgctttcgtggaggagaaaattccaacaaataagcagattctcatctactaccctcccctcccagctcccatgggagtctatttagaaaaccttgtgttctttatcacatcaaatgtgatgataacagtttaagtcagactagtaatagtaatagctaacatttactgagtgtttactatttgtcatgctgtgcacttttcattcaattcttataacaaccctatgaagtaagttctgttattcattaccattttcccgattaggaaacaggctgaataatttgtccccaaagccttagggtagtgagttacctaaccaagcctcacaccagcctccttgccctgaattgaacactgttctgctgcgcagtactgtgatgaattaaaaccaaatgcttatttggattctttgcatataataggcacacaacaaatgcttgttgaccactgatgaggtcaccatttctagaaaataatctgaagcatgtgaaaagaatcatccaataattgacaattggatagctgaatttggctcactagtcaggaaagcataccatggttatcatatcagatccaaagcagctgatccgcaatggagacgaaacttttatgcaggaacacttgacgttccagtccagatgaaaataggaagtcaatcaaagcagcagagtccagagaggacaccaagccaaactgacccttttctaaggaccttttcccatccttcccacctcctccaatgtgaagcccagtaaagggaccagccaggggagccttgaagaggactgcaaatccagctgcttctgtctcaaatagttgttttttaggagatgggttttaattgattggtttaaacacataaaggattgttaacaaactgtaccat

SEQ ID NO: 124734 - DNA, 1030 bp, Homo sapiens
aagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctt

SEQ ID NO: 124735 - DNA, 1736 bp, Homo sapiens
tattcttgaaacttgaaattcattttactttgtttgtatctcactacacataaataaatttgagataaaaatacattagtcaatctggcagacatatgagaccggttatggagtattcacaatgcctaaagcagtggtgtatctgtcaaaggaggaaaaagtgggagaaaaggaggtataggtttgtttatctcaagttgcaaagtaaatgcaaaagtgactcatcgaccactctgttttagaggtagattaatattttgcctttataccttgagatacttttatttcctattgatcttccactataagggtgactctaacagcacctttaaattccttctacctattctttatctaaggtagtttatggtcaataataaaggaataataaatgccttagggaaactattttaaaggaacctatttgtgaattattttttaagcagttttttggtattattagtgtttccgtattctctaatttatctgttaaagtgtgtatattagattttcttaagaaggggcacacatctatcaacattctaaatcattttaggtcatataagtttaagaaataagtagtttattgtaaaaaaaattattttatccttgctagatgataagcttcttgaaggcaaatataatagcttaaggatcctggctttaaccttctatagcctcttacacatgaaaggtatccccaggctctgtggagagagagagtgtccccgagagaaggcttcctgaggtagtttcattttctaggttttcatcatgagtgattgtttctgtgttctgtgcccaataataaacaggctttgtgttataccttaatttaaatcgttgcctaacagcattttaaagtgtccagaaacaaaaagatgaaaatgtttacatttgcagctcaagctcttttaactttataaatagaaataacatttctaagaagttgcatacaaacgacattgtacttacaccagtctaaaggttaatattgcatattgttttcaattaggaatacaatagatatggctggtgggtaggagaaatgaagggagccattggcttggtgcctaaagcctacataatggagatgtatgatatttgagagtcctgggtaagtacattttaatccaatattctgtaatagctcatatgttctcttggtctcttcgttatgagtctttgcctttttaaaagtctttagagttttctgataacacaaagattgtgccccgaaatcttttttgttttgtttgatctggtttaatttttaaaataagaatttttaaaataaaaactttatggaatttactttggaaatgaatagattatttagagaaagttcttttgatagtaaccagctgttttcccaaacttcctccttttcagtaaaataccactttttatggcctttctgaagagttgaattgacaaaatgttgagtaaaaatacatttttccttggctaaaagtgtaatttttttaagcaggaaaaatcaagtttcagctgaatcaaaaattaaaatgcagctttccctttctcctgcagaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaat

SEQ ID NO: 124736 - DNA, 1029 bp, Homo sapiens
caataagcatcactacacctctggatcttgatagcattactgcaggaggagaaagcagctttgtgttagtaattacctaacattgtcagaagctgactgcaggcctctttctagtgataacagaataaccgcataatgtagctttatagcacatgattaatagaaaataattacacgtcctacaaagggatgcaatatttcttataaattgactagaatggtttcctgtagattaaaggactcttcattattttatcagtcctcctgaagtacagtcacttgcctatgttagcatttcagctgatgttaagagctgaataggtgaaggataccagatggcagacctccttgtacctgaaaccttgtgttccataaagattacatgatgcttcctaacatttcaaagatttagacaacagcctggtatggattgtctattttttgtttgctaagaagataaagtttgagagttttcctttttgttttttaaatgatccacttgtgactttatagaacaatactataattagtttgtggactgcaaaacaacattgtatcagttgcattattttccactgtaagtaatatatcattcataatcacatttgtttgggggtggaaaagaggaaaggcatagacaggcagattttctttttcagaaggaaaccttgtacaatattgaatgttcaggccaaagtttagaatactgtactccaagaagcattttcattccaatttataggctgcaaatggtttaattgggattcatgttgctcaggaggctcatacagagaatagtaatgataaaagtaaaaagctcctgtatttgcagtcttgtcaacactctaatggctgcagtgtaaatccataaatttgcctcctgtatttttacctcactatatttgatcataatgcattaatttcaaacaggaatataatttgcaattctttacaaatataaggtaatattctggtttttagttttaccttttctgatttaaatctgatattttagagtatttttatcaa

SEQ ID NO: 124737 - DNA, 1082 bp, Homo sapiens
ggagaatcacttgaacccgggaagtagaggttgcagtgagctgagattgtaccactgcactccagcctggtgacagagcatgactccatctcaaaaaaaaaaaaaaaaagaacaaccagttaaaattgtaataaaatgttatattcctcaaatacttgttctctttgggagaagataagattctctttggaagagcagggtggagacctgctcataataatcagattgccttatagtgcgtcccaaagtactctgtttttttgttgttgccataatactttgctataccaattagtgggcagggagtgggggagggaatgaaaaagtgtttattgagcatttacaatgtcctgttctaggtacttaatatgctttcacacatataattaatataataaccctgtgaagtagatgatgttataattttacagattaggaaactgatgtgcagtaaggttattatggaaattatctgaggatacgcagctattaagtgccttctccaggtatcaatacaggtctgaccctaaagccttttctctttctactttgctacggttaagtgggacttgattaggactttaacttttcttctatatcagaggttaattgtaattatcacatcccagttctaaacaacagcgaaccatgttattgacagtatcttttacataattaaatcttgtatagatggtcaaaattatttcattttctaatcaacaaatatttggtgaacactcatgcaaagtactattttgagcaggatccagaaaagccacaaactgttattcaaggagactgcaattaagtcgaagagaagaccaatgcataaaatagataatagcaataaaacacaatgtagggtatcagtgttgtagtcctggagaatcccagaagaaagggaagtcagtaaatactggagtaagtaagtaatgaaagattcataggaaatggaacttgaactggaactttatgtataaatggagtttattcatttaacaaatatgaatgcttattttctgtgtctattacatataaaacctagaagaacggctgtgctatggaaaggggtggatggctat

SEQ ID NO: 124738 - DNA, 1046 bp, Homo sapiens
cctcagcctcccaagtagctgagagtgtgccaccacacccagctaatttttgcatttttagtagagatggggtttcactgttctctggtcaggctggtctcgaactcctgacctcaggtgatctgcccgcctcggcctcccaaagtgctgggattagaggcatgagccactgcacccggcaagtgttttaattttgtaaatgtaatggcagaaaaacatttaactagcttggggattaggttgttttcatttaaaaatcactacagaaatatagttttatttaaaaattcaatatattattttctgttttgcaagaaagccttgatggaatgttagctgtgctcagtcaacctgggggtgatttatttattttaggcctcttttgaaagttatacaaatctaagcctttatttttttttttcttctggtgcaaatcaaatgttgcaataaagaaagaagagtaggcagatactgtgcccttcctccttccctttttaacattttccaattagcagctatcatgtgacccctggctgagatagcccctccttcaaagtgtccagcatttccttaggtttcacctttgaacctcactaataataaatctaaacaccgcctgccttaaaaggcaagccagtactttttgctttatacttctattcacatagggttgctgctgtttttttatgtgttaaaattaaaagcttcagtagttcagtggagatttggaaatctcttttttctcttaaaaaatggatcaaatttataatgactgatgaaagcagaatttgtgattttaatgacagttgtattgttagtgaattaacaattggtttcagattcatttgatgggggaaaatcatatttgagatagaaaacctgtatttccttaagaaattgggttgtttaaaataatgctaaatatttttgttagttttcatttcatttttattaccactaaataaaacaggaacataatattatagctaacagtattttcctagaaccatgtttttgaaattttatcattttaatagcaggatcca

SEQ ID NO: 124739 - DNA, 1879 bp, Homo sapiens
ttgagctgtgtcttgactcccagaccagtgcttttccctttgttttctttcctgtgctccttctttccttccttccttccttccttccttccttccatccatccatcataaagcacctgcagtgtgccaggacccactctgacaactgtgataaaataaataaagccaactgtgataattgctagttagggtgcccaaagctaaggctggtcacttatttctctcagtcttctgctcattagcatgggtttttgttactgttgttcccagaaagatgttttaagttcttggacgctatagatagtcacatcacaactcttgattaagcctgttattaagcattaaattgtcctgagttaagataacagctttttggttaactacttaataaagaaatcaaactgattagtttcagctcctgtcaagaaactttcttggaatcattcctaaatttatatagctcacagtctttttaaaaccaatttagctgcaattgtgtataaaactaaaacgttgattagatttcacttgcaagttcagattataggagtgagtggcatatagctattatactccttttgtaaatatgaaatttataaagcccatgtggatctatttgtaaaaccctctttatgaatcaggttgtctttgttgctgaaagcctgggtagagcaccggcttccagaactggctgtgaaacaagccaccataggcatctcttgtttctactgttgcctcaggaaataattttcagttaacatgaaattaaaagtataatcataggtgtgtatcatacttttaggattccgaaggaggcagttcctgttttgtggagactaattttatttgtgaagcctgattagagaacaaaggttaaaggtgttccagcccatgggaagcacatacttccatctaacatttttaaatgctattatttgggagagagctgatcgaaagtacttcctctgccagtgttttgcaaggcttgaagtttcaccatcatgatcatatttattaagggccttctagagatgtgtaatttacctggggttcattttggagtttgaaaaaagagccaagaaagaagaccctgttcgccagcatgttattacctttggctgaataaggttcagtgttcatcgttactcagctgtggacctagtggaatcaacctggtaaatcttggtgaggataaaaaggagaagacatttagctttccttgatgagatttggacatattctgggctattgatgggtgtcttggctgcgagtagacaggttgctttgggttgagtatatgtttgtctttgaagacttacttccttaccttccttcagacaaattcagctaggaatctcttgagactttctagtagtctttattgacttggccttccagttttattgaaactttggcaaactcagactgtaagttaataccataaattcatttaatatgtgaataactgcaattttgaatgcttgatattattacaaattaagtacaattagtatagaaaccactagcatttttaggtgcctcgcagtgtgtttaattgagtttctcagagttatattaagattttgtggtgatgggatgaaattttacctttctgtttttttttacgccatctagtggctcagaatgagtggtgcaggtaattgcagctgttgtacacaatcaaaatggtgtcataaattcaactttaaatccagctatgggttattactttcctattccatgtcaataaaatattagcattaatcatgaaaaactttgttcatcattctgaattaaatatagaaattgtatatataaggaagaatacattttaaggattctaaaatagtatttgtagagatacaggaaatgtgtactt

SEQ ID NO: 124740 - DNA, 1051 bp, Homo sapiens
tcttcctccttctctctccactcccattgtcccttgtttttttaattcttagaaaacaagagacaaaatttaatagagggattttactaggttgtatattttctagtccatctttattttcttataagcaaaaagtagcattctatttgctaaatattcagactccatattattcagattctcttttttttggctttaaaatatttcttatattaaagagaattttaaaattttctagtaaacctaacactttgtataaatcacaaaaaatgtgtaataagatgaacaccctaatgacatgctaatctgactagttgtgttggaatcaccaaaaagcctgctgtttgagagccatgtaacaatactgagatgacaaccctggtccagcctgtgtctccacagttatcccctcagaattcaaagatgacattccagtgatggaagttgttagcacgtatatattctgcctggctagtgaacacacggacatcttattgatattacttgcattctttttgtgttaactcatcaaaactcaattatcatgaaattgaaaacaggaaacagttcttagtgtaacaaaagcgtctagtgtgtttagctgtgttccgtgtttcaggagatctgcactgtataagtgacaaagcatttattacccatttattgtggtcttacagagtggaaagtgctaaataatcaatcagttaatggtctgtatggcagtttgagcacatcacatccattgtgcttatgctgttagaaggatgagctgatactccagtgtatgttgcatgtttatttagagcctaatgtcctaaaccggggctgacaaaaatcggttgaaaaatgcagcttcaacactggcaatttcaaagttgctaaaaattttcaaagataactttggctttgggtacaaatgtccctaaagaaaattgctgcaattactctttataccgtttccacgttgttgtctttcattaaccagctctagggtttagtattttttttttaattttggttccttagttttggttttatatttgtacattag

SEQ ID NO: 124741 - DNA, 1035 bp, Homo sapiens
tttaaaagcaggagtaaaaacattgttttaatctttcacaggctggctaattaatttttttctttcttacctttttttaatcattcatgcttctcaggacaagaaacataatgtagtttttttttgtaatttttaaaatatagatcatgatgtggatagaataggaaaattaatccatgtagtaaagccaactaaacatacttaatttgtgctttaaaatgtatgtttatgatatttgcctcatcccatctttaaaaatacatatctcaactggattatttttcagtgtttaggggtgaacagtgttaacttttgcaaacctgcgcttttgaggctgtcggtgcttaattttttgtgtatgtttagctacactttaaattttaaaaagtaagctagaggagattgctgccctttaaggaacaagactcttcctgatttttgtgtccagatttcatatcaagaattcaaacattacttccctgagactaaggctaataaacatatactgccagggttttttttccccctacttacgattttttctgctttatagctagtattgcatgctgaaatagatagactagtaaatcatacatgtatgtagctgtgtgacataaacaaattattctttaacagagctctcatacgggacacaaaaatgaggttggtctttgggtaacatcatcatcaagattatagaaagcacagttgaaaatgcatctttttcccatattgccaaatcactagctctgttgcctctttacagcagtgagatttaatgaaatgctcatgatgcacatctagggagagatgcatcttgcacacggtgggggtctctcttcccctcatgtgctcctgtaactcccattagtgttaatgggagtttcagcaagcgtatcgaggggaagagagaccccaaagtgataaggattatgtgttagaaatcaccatatacttttcttttccttctttctctcccctcccctttgagaatctattgaataaaaactattgtaagagaatctgaaaaaaagg

SEQ ID NO: 124742 - DNA, 1591 bp, Homo sapiens
ggacagtttatagatacaacatgcagttgctgtcaaacctataagaatgtaatatagacatctgtgtatactttgtgcttgagcagaacagacttctgccattcagagactaacaggggacaacaagttgcccaggggactggcaatgtagacatctctgaaaaggtcaacttgacacaggctctgacagtcgacccacagctctgtcttctttgataaaaatcagataaacttaagactgctaattgatctgcagcctgtttaaatgttggccatgcatatcttcattgcatatgattaacacagaaagcaaatgaattgggtaagaaatgccagagtccagtgacagcagcttaaaaattggaaaaggacactagtggcctaaaaggctaggaaggatgttccccttatccatttccacttggcacatatccccaagtactaattatgaatgagactggaaaaataattgcacacactctgtacaaaatcacatgatacggacaacttttcttgcttgttgttatttccaaatagcaggagataaaccatatctgtagtgcaagcatgaggttagttttgataaaccagcaattattttacacggaaagaagagaaagactgccttcttatcaggactttacacctcttcatagccacatgtcagctggggcaaggtctgccatatcatctctgtgtcttgcaaaaagctagagttagggtcaccttcccctctctgatatgtccatacatcactctttcaagctgtcaaggccgggtggacaagaagtgtgtgttcaggaagtagctttccagagtccttcctactgtgacatgtggaaaggaaacagaggcctgattctagacctggacaggaaagcagaagtaggttgctacaaaaggttttggttagtgttttttcagaaaggaagcgagaacaaaatctttacatgttagcactctagtcctataaaatgaagctataaaacactgaggcttagtgaaaccttgaggactatgttcaatagtagtttaagtatatatgttttcggtttatgtatcatgaaacttctgccaaaaatatgtagttttctttttaagaaaatttcagtgcaggtatagaaagtggatacatacagatggttcttccacagatacaaatattttggcttaaagcaattgtatttttcaaaagcccttttaaagtaaacatctcccaaatttttgcctttgagggtaggaaaaaaaatcagttttcctcaaaggaatgcatcaaatagatctagcctttcatgcaatggctataaaacactacaataattcttatctttagtgacatgaaattcttttcaagcaacagttttaatgcttttgcatagaagtgacctttgctcttccctaggctgtcaaagatgtaacactagaagtttgtttgccatgcagggcagtgagttgacaagggtattactatcttgctgagcatcacatgacatgaacttctaaccttactcaagaatgttatatatatttcacattgactgattttactaaaccccccaccacagacttttctaatgtaaagtatgtaagc

SEQ ID NO: 124743 - DNA, 1348 bp, Homo sapiens
gcctattacactctctcatataccagatagcctcatttcacttctgttagcagcctgtgttttctttcagaaactaccttacttctcagttcttcctggaaacctagcctgataaggtgaaggtcatctgtacccataataaaatatcccatctccctatgttttatacttataagtataaaagacagtaacccaacacatgtagatatacatgtctagacactttgtgaatttgagcctaggtttttattttatactttctaagagctcagcattaatttaaaagtattctgcagagatcatctaatattctaataaatcaactgaaaaagaatactaaagaaaatgaaacatgaaatgagaaaagcaaaaagaaaacacccaatttttatgtaagcaattcaattattcatgcaacaaatatttattaggcagctattacatgtcaggcactgtgctagacactggagatacagtgttgaccaatatgactcagaatttattaattagaaataaatataacaaatgataagaaatggttatgaaaagaggccgaagagagactgatgaagaacaaagatccaagccaagtctatggcagtaaatgagatacctaaaagggcttgtctgttcagtgctactcatacccagtaagaaatatgtggttctgaacaccacctatagaacatactgaagatgaaagtaaaaggattaaggttggggagtttactaaatggagatccttttgaaaaatgtttaggtggggtaactattggtatatacggaagagaccagattatagcacattcaatgttatagggaaacgggagttcatattcatgaagagatttaagaaagagttaataagaaaaagactttgaaaaacaccccccaaatcccttcaacatttaaacccattttttttgcccctacaataataaaaaaagactttccaaaggaagtggtggaagaaaccccattgctcaagacattaaaaaccagatggtccaaagccccagcaaacattcacgtgggatcaatccttcacccagtgaaagcaaagagatgggaccagtgtaataatgtgttttgaatctctagcttagaaatgctatgaaaataacaattcacattgccttggacttttccttaatgtcttagctcttctctgtgctccttcagctttcagggttgacttctgttagagctggccacacaggaatttgcctgtttacttggaagtctcttctgctaggtccatgtattgtgagcttatcaggttttctccttacctctatgagagtgctgtatgccctgggttctggaagtgtttttcttaagtgcttct

SEQ ID NO: 124744 - DNA, 1126 bp, Homo sapiens
tcctcaggcctccctaaccatgctaaactgtgagtcaattaaacctctttcctttataaatttgccagtcttgggtatgtctttattagcagagtcagaacagactaatacagatggtttcagctctaaaatctgcttagagggttatccgaagttataaaaaaaaatgaaatcattcataaaatagggtcactacacacatataatatttattatttttatctttgctgaatataaatgtgtctttgctgaatatttgttcatagtattctttatgttgtttcataatatagtatgaagctttggaatacagttctgcctgtcttgtagcttttctctatgttgccattggcattgcaaattcctttcattacaagggatggcttaacacatactaaaccgaaaatatctgtgtgcacacaaaacatatatttccactggtggtgagataaaatgactcatttttgcaaattggagctacatcagtggttcccagccagggaagatattgaccccagagtatgtttggcaatgcctggagacacttttggttatcataactgggatgtgtgtgtgtgtgtgtgtgtgtgtgtgtgtgtgtgtgtgtgttacagatatgtggtgggtaagggccaaggatgctgttaaacgacctacaatgcacagggcaacccccacaacaaagaattgtctggcccaaacgtcaatagtgctgaggttgaaaaaccctggccacagggatgtaatagacaacttttggtttatcacctttttattcttatcacttgaattaataaagattcataacctaagctccatatgagttaattcatttttatggacacaggttttcttacatacatgaaactaggattacatagaatgtttctaggttttaagagatcagctggacttgcctatcacgtttccttcaaggagtagtattgaaattctatccatcttgtagaaatgagcaagccaggaagataaaaaatgaaggaagcattttctctattttcatgagctactatcttggaaggaagaggtttctaaaaataccttgtagatgtgtgaatacttgatttatcctattctgatagggttgttcttttgaggctgaaggaaa

SEQ ID NO: 124745 - DNA, 1799 bp, Homo sapiens
tgcctcgtatttctccttgcttgtagtatattgcactgtctcagaggaatgttgttgaactataaacaaaggccttttgaggcttcaagtcttcctgttgatattttagcatcaatatggaataaaaaagttttcttattccaaatgctcagacctagtttagtgtttacatgcctgtctgttatgtaacataaaattaattatctattagctacttgacttgcggccatgaggatcaatctaaaataaaaagacatctgaaatttaggaaacatatgaaaacatttaggaaattgtattactaatactctaggctgaaatgagcttttttggctattaaaaaatcagtagttagagaagaaaaaggtatcataagcaatataagcaagatttaactagtacatctcatgtagagaggccattttgctctgaatataacaatttaatgatgtaatgttaaacctttaaaattgatttcaaaaatacttaaaatgttccaaattaatgtacaaatgtcattttcaagacaatacagcataataccaagagtatggactttagaagaaaaaaatttaaattctggctgtaccattgactagcttagtgactttataagttaatttcttcatttataaaatggaaataatgtcattgggaggggtaggtgaagtgatttatggaaggctttcagcatagtgcttgatcccacaattaattgtaacatcaccatcatttttgttttattattgtatctggtgaattcttgcaagtgcttatgtggtggtacagtaatggttttctaaccaagtaaaaagtaataattttaacaatattataaatttaaggtataaaaactatgtatgcatctacatattgtattttactaccccagaagattagtataaaagtataattttatggggaatagtgatctgtgtatttcagttgtttagtggagctacatgtttattaaccccttcctttctggtttaccctaaggaaatggcatctgctgtagcatcagttatcctcaagtagggaagaatattccctggctgcttgtttttggtcacaccatatcattaatacaattattttagtatttaaaaatgtttaaaagaacttgtgagaatgtatactcataaaatggaagagtggaatacatttaaacacgatattactgccattacatccttttaaaaccctgcaatgaatgtgttacattacaattgttgaaataactgttaagttctgtattttttcaacttggctgttctctccccacccctaaagaaaaaaaaaattgatcaggaataaagaccagatattcatagttattttcataacaaagacctaaggaaggtctgagtagcttgaaattttaaaaatatgaaacatcttttattttttcttactggagatattattcttcattcttccttgcccccctcctcacccaccctcacacataattgttggaagtaactggttactttttaagtagtgttacttcttgctgtggtactgggagaaatttaagctgccctggaatttcttttcccctgcttgggatccccagttgctctgcaaagtgatcgagcttgatggagcctgcacctgtgccccgggaaggaagccgttgtaggcagctgtggaatgtctagttcccttcttccccaatgtaactgagagctgcttcaacatctgcacggttcagcaagtttgtcaagtttgtgccaacggctacagaggggatttttctagtaaaggccctaaaggtgtctcagagttagaggttt

SEQ ID NO: 124746 - DNA, 1050 bp, Homo sapiens
tatctgctgagtgagcttttcaaggtatatctgatctgattttccacaatgttagttctactttttatcacttctaatacatcatttgttttgctgctgcattttccacttccttatacagcatatttgttccttattttgccagtttcattttaatttctacttgtctcagcctttcctctttttattttatattacattgtttcatctttcatctctttcagaatctgtttacttttataaaatatgcaaagcagttggctaaagtttaccttcatttctcctacttcgcttgtgctttctacttctcaagtgctatgttatgtttctgttttacataatatttttatggcatctgtatttgctgttcctcttttcttatcctcgaacaagtacatgtctatgaaatctgagatgcttacctataaattggatttgtggcttctctctggttcatctcagtagaggctgatactgtcctcctcttggactgtatcagaagttctgatacatagccccatagcatatttctagggggtttggctaaaatgaatctgctagtctgagttggggttgcctaattttgctgcctaattgtcttatttctagattattagataatctggcccagaaagatctgttcccctcagctcttccaaactaaatctttatagtgctgattttatatctccaggtgtagactcccactcctcatgcatttccacctgcattcaagttacattgatgagaattttagaccgaaattggaggtagaaggcataggttttaggtcagatggacctggtgagtggagcgattgaacccttgcgcagcaagggagcagctttcctctaaatctggtccctgaaatttctctttcttctggagagtttaaggaactctctcaaaattgtccaatatggctttgatattttgcctcacattacttccacttttcgtagtgaacattaagttccttttgcaatttagtagatcattgggaaggtggcgcgaaagatctgataaggtgttctagcttttatctcggca

SEQ ID NO: 124747 - DNA, 1007 bp, Homo sapiens
cccccatcttgattaccaaatagtttgtatagaattgccggtacagcccttagacccagacaagaggagcccctgtactttggagggccctaattgggcccttttccagttgtgccctgtcccacaggttcagttcttggggtgaaggggaggtgcccaactcatgtctgcatctcatttcccctcacctcatcttctagactatattccagttcccagggtccctgaaatccctactgagatggccccaagcttgctcccagggcctgtatgggcctcttcaatggctctgtcttatggtagatggagcatattactgctgtgtatgtctataggcatgggggtaactatggattgtgtgcaggggactgtggacagggcatggaagggtgggcatctccacaagcctcctttgggtatcagatggagccagggtagggaaaaaagaaatggggatttcttaggagtccaacattctaaatttgagcccagtcttccttattattataatggtgtatatttgtcaagtttggaggatagaccatgttttggttaacagattcattagcttgatataaaacttcttaatatttagacatatgctctgtgggcctccatttatattcttgtgatatgccctttgatgtcaagggaaggtttgagtgttgtatttaaaactttgtttcctcggccgggcgcgatggctcatgcctgtaatcccagcactttgggaggccgaggcaggtggatcacgaggtcaggagatcgagaccatcctggctaacatggtgaaaccccatctctactaaaaatacaaaaaattagcccggtgtggtggcgggcgcctgtagtcccagctactcgggaggctgaggcaggagaatggtgtgaacccaggaggtggagcttgcagtgagccgagatcgcgccactgcactccagcctggacaacagagtgagtcttaaaaaaaaacaaacaaaaaaacactctgtttcctcacaggatc

SEQ ID NO: 124748 - DNA, 1058 bp, Homo sapiens
ttataaatcctactagaatagaaggtttttggacatcagatattattgtgaacttaactatgtaataaaaatgtttgagctaaaaatttttttaacctaaaaatctttaccttgaaatttttagatacgtaaattaagctttcttatgttcattatgtcagaatatattactataatggaaaaagaatgttttcctactttccaaattaaactttaataaatgaaaagtctatatactctaacagagtagaacaaatacattgtggtcttggattttgctagtgatacttaactaatggttcatactgtatttgaagtgtctgctgccattttgtggcattagctcacagagtattatactgtttctacatcaatggtagatgtgcttcttagtgcggagtcattttacattctgtttataattattccgaagagactatgttcagaaaattgtcagtctattttgtataccatagaactttgcgattaatttgtgtgtgtgtgtgtgcgcacgtgtgtatctgtgtatacatgtatatggtattaagcatataattaggggggagtgggatttaggatttggaaaaaattacaagaaatttacatgaatagaatttcagtttttcaacttacacacttgattagtgctagagttgcattttgtgctcatagtaacaaaaagtcagctttcttacctgatttttcttttgagctattataaaggggtataagattaatacattgtttggtgtttatatgctcctttattttcagttagaacagagccaatttaaattctgacagttttgggttatttaatttatgacatatttacatttcttaatttgtaatgtaagaaaaataagctaattattacttggatttatatactagttttttttttccttcagaatgctaagtgctttctgatttctcttataacatttttttctttttcttttttttcttaaccactgcgaagatgaagggatagaaaggttctttggcttaagatcacagccagtggcacagctgttgtaagaaaccaggacttgctt

SEQ ID NO: 124749 - DNA, 1052 bp, Homo sapiens
attgaaaagacattgcctgcagggaaatcatttaattgaactaaagtgcctttatttctgtagatcttggaacagctcactcactcttattttcagattagataatttatatcagataattttttcagctctataaatgataaaatattaagaaaagtaatcttctttttaagatattttgatgtttcatagttttccatttatatctgagttagaatttatggttcttaaaatgcaaaatcttatttttcaaataaaagtttttttgttcattagactaaattattaatgtgtttgggatacacaggtcagtggctccaaaataaatgtatgtgagatatatagaaatgagtcaacttcttttactcaagatcttttctcactgtcctttttgtttttagatcaggtttatcaggtataatttacatacaataaaattcatcctttaaaagtgaacaatgtgatgagttttggtagctatatgcagctgggtaaccacttgcacagtcatgataagatatagaacatttccagcaccccaaaaagttcccttgtgctcctttgccatcagtaccctgcctccacacccagcccctggcaaccacttatctgatttctgctcctgtagttttgccttttccagaaggtcatatcaatagtattatacaatatgtagccagagaaatctggcttcttatacttagcatgatgcttttacaattcatccatgttgtttcatacctctgtagttccttcctttattgttgagtagtgttctgttgtatggatgtatcacaacatatttttctactcactaatgatggatgttttaattcttttcagttttgactaataggaataaaactactgtaagtgttggtgtacaagactttttgaaggccatgttttcaaatctctatggagtggaattgctgtatcctatgatacatgtttttatcagaaactcccaaaatgttttccgcaatagctataccattttgcatgcccaccagcaatgaaaataacagttgctttgcattttcacctttctt

SEQ ID NO: 124750 - DNA, 1041 bp, Homo sapiens
tctgcatatgaagcagttcattttgcaagtatttatcatatttgattgcatttatttttaatggtacatgataaacgtcttttagaaagttttaaagtagttattttagaacacaataaacatcttttacaaggccctttagaggttttcattcatataaaagtgtttctcttgagtttaaatatttaattagaatctgttaatctatgttgcattataataatggcaggatactgatgtgttggaaatatttacactgaatctttttttttttttttttttgctggtgtaagggtgtttgaagttcctaaagagtgatttcgctgggattattttaataccaccatattagaagcctgctaactacaaactggactttacagaatattagataaaatatacagctaaattgctgtgatttggttgtgatgtgatttcatttaaagtatgtaaagaagaggagcagtaaatatctctctgtaagaggagctaaatcagatgtcagtgaaatgattcatgtgccaactggaatagttaacatgcattttattctactgtctagcaggaggaggtgggctatagaaaatgaattctccactaaataatttacaacaattatatcaaattttaataatgagctaagaaggcatacatatgattcatgttctcacagtttcctacattagagattaattgtgcttttgttaaacaaaaatgtactcttataaatatttttaattagtaaatcatgattagttttatatttatagagtagcatcgtttgatcaatttttagctgtagcttcatatgaagctaaaatatcacagctaaatctgttgtctcaaatgccagctcatgagaatttgctcctaatatcaagaaacgccctgaattgtttgttggctttatcttaactcaaatatgtaaaggggacagtagaacatttttctttcgaatcacagagagttcagtgacctttctgtggcaaattacatagaaagaaaatatttatattcatttaaaataacctctgtgaagaa

SEQ ID NO: 124751 - DNA, 1064 bp, Homo sapiens
tagggataattaatagtatttcaaaagattgtagtagggataggtacataggacatgccaatgttagctcttggttactgtaatgtcacaagatgaccaagggatggaataattgacttgattttagtacatattttctttggaatttttatccatgtttgaacataagtagtttaatttgtgttggacaatattttatttaatcatatcatattgtgagtagctaaaagataactgattatttttatgatttaatattcaactttttgctaataaatatggcaggcatttttacgtggtggttcataaatgtcatgacctgtgtgttgacctatgttaaatttctgtgatcttttttatttgggtgaatcgtatttagcttcctgtctgttagatagtaggaaagtaatgaaacaatagcatatgagaatttgatcaaaatgaaccttaatcctgagaagcattaactggattattttgttagaaatatgccaatggatttaaaatgtagataatcttgaaatttcaaatgatttcattctttggttggttgtttacctacttgatgaccaaaaaagccaagatatgtagttactgtcacattaaattcagaaaatattttataaataaagcttcattttaaatgtactaggaggtaacttttgagaaaacttattagtagatactgttttacaagtggaaggattatgttttgtgacaattattaacagttttaaaaatcaagttcttaaatatttgattttttaagagataagatctcacaatattgcccaggctggaatagtggctattcacaggtacaatcatagtgcactacagccttgagttcttgggctcaagcaatattcctgcctcagccacccaagtagctgggactataggcatgtgccagtgcgccaggcttatatttgatttttttaaattttctgagcacttttattttaacttttatgaataatttcaaacatacagacatagaatattataagaaaacttacatgtatccatatctcagcttgaacagttatcacctcgtagacagt

SEQ ID NO: 124752 - DNA, 1018 bp, Homo sapiens
ctgtttttgatactttcacattttcttctaagaatatcattattaaaattaatttttaaactaccacttggacatttaatattcactctaaaatatcatctcaatgtatcagtttttctctcttcaacttagattttgtgtgtgttctctttcctttgatgaataaatttgcttcattatgtgacctcagtccaataatatattaattataaaaaagataatgcatttaacaataagcataaccgaattagcacaggtcaccaaaaggccttttgtcaaatcagattgttgttttgtccttttgacttttaccttatggaaggcactaagaaagtatctaaacttcaatgggttataaactctaaacatgatatgtatttttcataatgctaatgtaattttcaaggtactgaaaaggtcaaacctgcacatctctatgtgcattctaagtctgtcttttgctttaatatttatttttctctattcctctggttcaaaagttcactcagttcccaaatggccacctaattttccagttattcccccaagccatatgtgttttggtttctttatggtttattaggtactgtaggaaagcagcataagttatatcttctaatgaaattcaagcacacttcagtgatgcttcgacttgattgctggtagcaattaaatcatagccaaggagaataatgcataatcttacaaggtccaggcaccgtatagaaattgaatggggatgaaaacaacaaaaagaaagtttccaaaccctgccaggtacgttgttttcagcctgcctttttttttttattggccaactgcctgattgatagcaaaatcataacttgctgcatgctaacaggcagagttcacttgtaggttattgtgagctgataaagggttagatgcagttttgattttcgcattggaccttggtacaccagattaatggaatttcaatgagagactagagtagccacagctttgtcagagaaacagatggagattctatagtcat

SEQ ID NO: 124753 - DNA, 1074 bp, Homo sapiens
gactttttgtgtgaaacacattttccctatttaggaagccattctcagacacaggtccatgatagattcacttgggcaatgctttgtatagtctatcatttttactgtttattgttaaagttattgaaattgattataagatggaaagtgtaataaagagaagttaggagaaatacattcttatttctcttgtttccataacaaaaaccaagaagtaaatcaaatcatactttacattctttaaactagtcatattaggttgaaaaaaaagaataataaatgtaactttaaatctcaacctaagagaggtaatggcctccctaccattctacaaaggagagactagactctgataaaatcttatgatttgtcttcccaaaagtagatcctccagttcaaagatatatgtatatatccctataactgaagctaactgcctttcttatgttcttcaaaattagcttaggggcactgaataagtattttcccacaggcctaggtttaagagaagctaaaagagcaccgaagaaaaatagaaagtaagccaaacacaatttacttttctcagcctctcatcttcatttttatttggctttcataggcatgtggaagaaagattatatttatacttaggcattatattagctatctattgctgaataacaaaattgagtagcttaaaacaaacagtatctcacagtttctggtggttaggaatacatgagcagcttagctagatgactctggctcagagtctctcataagaactgcagtcacctgaagacttgaccatggctagagaatctgatttgatgatggctcatctacaggactgctgactagagtcctccattcctctttgtctgttagaaaaaagcctcacttgttcacaacatggacttctccataaggctgcatgagtatcctcatgatatgacaactggcttcccaaagcaattaatccacaagacagagcaaccaagacagaagctgcaatatctttatgacttaatttcaaaagtgacatgactttactgctgccatatttaattggtaacacagaccaagcctgct

SEQ ID NO: 124754 - DNA, 1390 bp, Homo sapiens
tgctctccagttggtgggaaatttgtactagaaataaggaactcagcatctcactcaccttagtttgtccttcaccagcccgtctttctctttctgagagcctttgtctccctctcttcatgtccaacaagcagagaaaaattaaagtggcaccaggaaatttttctagcctctatatccaaataacctcttaaaaacacacttgatttacaactacaacatatgcaactgagtatctaaactgtaaatcgaatgtaaccattgttcctttggacatttccttaatttaatgagtgataaatacaccctttaaggactatcagttctaatcatttccaaatgactgatttccagtgtgctgctaccatacatttcctttatgtaaataaataaatatttctaaattgcttccattaatgtatagaaaaacatttgttatttatttgtaaatggtcatgggaggattataagcatattgccaaataaaattctataacaattctcttagtatattatgtttgaaaatgcaatatttatatagtagaaaccataatattaaaacccaacaagcttctataagtttgtcctttttaaatttaagctattaaaatatttttgaatatgaggagaaatcttttaatgccaattccatatcaaaggttaggattttgcatttatacagagcagagttcatgaactcctgctaatcatgttaacaatctaccaggtttctaaaggctcagcaggggttagaattagaaggctctgccatcaacatcaataacaggaacagtgacactcagaagagtttaccaccgtgctctcctaagagggttcagcacattcaggcactgtagcccataactgaaggaaatctatagttagtgattccaaaagggatctagagggacacattatttcagattttgttttaaatagtgagtcttaaaaattatatatgtgtgtaggtatacatattgtgtgcgtgctagtatatatacaatattatgatagtcatactttttatttgaaagagccttaccactcaaaaggattttgagttcaaatttttgttttggtaacaagaaagacgtgaatgaaatctcaaatgtttctctgggaggcaagaaaatggtttgaatccctaattcagaatgcagcctgttggacaaatgatgactcaaacaatctcatgtatcctgggcccaaggcaggtggcaaatcaattcagaaacacataaaaacaaagtgaatacctttgagtttacagatatacattaaaagctaatttcaaagtatttttaaaaataaactttccacaatatgaatttgttatctatggatttccacaggcaggaaaacatgtcctcttccacccctttttcaaatt

SEQ ID NO: 124755 - DNA, 2393 bp, Homo sapiens
aaccagtccctccaaaacaacacctgagtttatagctgaatatcagaagcaatattaagttttctttcttaaccacgcagatcagaaaatcttttgcaacattaacattttaaaatatcaggctgagcacagaggctcttgcctgtaatcccagcactttgggaggccaagatgagagcatcacttaagcccaggagctcaagaccagcctgggcaacatagggagaccccatttctacaaaaaataaaaaattagctaggtgtggtggcatgcaactatggtcctagctacttagcacgctgagatgggaggatcgcttgagacaaggaaattgaggctacagtgagccataatgatgccactgcactccagccttggcaacagagtgtgactctactcatctcaaaaaacaaaacaaaacaaaaaaaacttacatttcactgtcaatccctaaaatcacatttgtgtaacactggtgtaaattatatatttgcgtttttcagctatattccattttttaaagtacagtgatgatctgtgatagcttacaagctatttcttatttatcaacagtatgaaaccatgaatccatatcaaaactatgacataaaatcctacatatgtgattattaaccttagaatgcctaagatgaaactgttccttgatactgtcattaaaagaagcatttaataaagtactaaacatcacatgtttaaggtatttaatttcttttttaaactctttaccctttgctgaggttttttatttgacatgtgtccaaggtaaaaagacaaatctactcttttgctctttgataaggtgtcagagcttacttaaaggtttaggaatagagttgttgaactaatttttttgtactgcaagttatatatgagaattggtagcagtctgttgaaagaagtttacctgtggttaatagcacttatctcacttctatctatcatgccatcaatttctttattacaagagtttacctttgggcagctcatacaccagctgtcaatctgtcctcaccccgagactttgcagtaaaccaagctcaggtgtgttgaggtttcaccatgctagttgttttccttctttctccaactagaacaggtgtagtcaaaatgcaagcctctggcactccagatgtgccccatcacaagacagagccagaacttcttcattcctgcctcctagatcacaacttcgtatctggagattttctagatgttgcttcttgtcttaattttacctttcctgccccttcactgaagcattttaagtggtagctttaaaaagactaaaaaactccaatgtccatcaataaaggactggtccaataaagtatactccacgaaacgaattactataccttgtaaaaaatgagaaaggaaaaaatgaaaatgctctctaagtagtaatatggaaagatttccaagatacaataagttaaaaaagtaagatgcagaatagtattaccttttgtattttaaaaaaaatcataattgcttctatattcataaagaaacttgccaggagcagtggctcatgcctgtaatcccagcactttgggaggccgaggcggacagatcacgaggttagcagatcgagaccatcctggctaacacggtgaaatcccgtctctactaaaaatacaaaaaattagacagttgtggtggcgggcgcctatagtcccagctactcgagaggttgtggcaggagaatcgcttgaacccgagaggcggagcttgcagtgagccgagatcgcgccactgcactccagcctgagcgacagagcaagactcagtcttgaaaaaaaaaaagaaactctgaaaagatagaatacaaactaagaatactgattattggggttggggtgtttaggaactaagcatgatgaaaggagtggaaaggagaattttcatgacatgccttcttattctttttatttttgaactatattgcctattcaaaatattcaatttaaaaagaaagagataatagcttcattcagtgcaaggaggctaaaagaaagaagaactacactaagtaagaaagtctcattcttactcaggctattggcactatagtttgggggaaagaataaattatcaggaaactgaaaaataaaatttagaaaatcaccagtaaaagcagctaggactggttctggttgaaggacaggctaaaagacaaaaacattagctaccaatcttatggctttgctgattcatctgtgttttaacagtgagcaaaaagtattttgaagacaaataacattacagcaggatcaaatgctctctccttaagcattttcttcagttttctaaaagatatcccatgtgctgcttctctcacatcccagattacaaaggcagcatggtgaag

SEQ ID NO: 124756 - DNA, 1049 bp, Homo sapiens
accagcctagccaacatggtgaaaccccgcctctactaaaaatacacaaaaattagctgggtatggtggtgggcgcctgtaatcccatctactcggcagctgaggcaggagaatcgcttgaacccagaaggtggaggttgcagtgagctgaggtcgcgccactgcactccagcccaggcgacagagtgagactccatctcaaaaaaaaaaaaaaaaagggcagtagaacagggtggttaagtaagccaactgtcagtcaaacaacctgagttcaaatcccaaatccactacttacttacttaacctatgtgatttagggttgcttaattttgctaaattgcttaactttagtagcaacatttcctaactttggtagcaaagttgcttaacctgactaagcttcattttttgatctgtaaaataggggcgaatagtagaagaatgttgtaatgaataagatgcttgtaaaacaattaggaagtgcctggtacaaagtgagcagccaataaatgctggctatttcagtattgtttcaaaaggcaagtttattaggttacctagttcctaaggcctagagaacaggaagttaaaagtgaaagaaagtgaaaatgtttctgtagcatcaaacagtagcacattcactggcaagtgagataagtttcaaatgaaaccttatgaactattttagataagttaaacatacacgtagaaagacaatgactaaatactcagtcactaaatactagaatcagagctctatttggattccagctccatctattaatagctctgtgcccttggctttatgcctctgttccacatttgtaaaatgaggatgataatagtatatacctcataatgttggagtaaggataaaaataaatgaggcaatgcctgtctcagtacaggccttagtacagtcactaccaatgaaaagtacttaataattagtaggtactgtttcctttattacaaaaaaaaaatcagagggctatttgttaaccaaattgaaagcctaactctctgaacagagaaagtaaaatatagtg

SEQ ID NO: 124757 - DNA, 1008 bp, Homo sapiens
aattgatagcatgagtaataaggaccataaaaaaaaaaaatcactgctttctggccaggcacagtggctcacgcctgtaatcccagcactttgggaggccaaggtgggtggatcacctgaggtcaggagtttgaaaccagcctggccaacatggtgaaaccccatctctacaaaaaatacaaaaattagccaggtgtggtggtgcctgcctgtaatcccagctatttgggaggctgaggcaggagaatcacttgaactcaggaggtggaggttgcagtgagctgagatcacgccactgcactccaggctaggcaacagagtaagactctgtctcgaaaaaaaaagaaaaagaaaaaaaaatcactgctttctcttcaaagagtgagtattaagatcttccatattctctatggctacatgcattaggtgaagaaaaaaataaagcatagtaataggatagccaccctcaaattgcttccttccaagttgagttatgtttatgatatgacagtgatgcatggtcatttgtttagactaactgggttagatctgtgacatctaaagaaaagcaacaaatgaataagtaggcaagtggaaaaaattagagaaaagcactctcccaaattaattattcatgtgttaattacatgttctgtttctcagttttttctcagtgatatttaaagatattcattacacttttgcctgagacaggtaataaaagttcaggagctgaacactaagcttaagatatgtacagatgaacaggagggatgagaggactatggtaacagtcagtcattgccagaaatttgaaactggcattaagaggaagtcagcagctctattcaagtgacaaagcagtggtgtggttcttggcatcctggcatgtatagccaaatggaaaggtgccaggtattggctggaagagcataaactactgattttctcttccataaattaagggaaggaagagttttagcagcacagcatcaatgttttatgtag

SEQ ID NO: 124758 - DNA, 1044 bp, Homo sapiens
ggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatcctagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaggataaattgtgacgaattttatttacgaagttagactaaaagaagaaaaagaacccgttatgagccttgaaaaaagagggggagaaaaataagctacttatagcaaaggagaatttattctacaaaaaatatgcatgacaatgcatccca

SEQ ID NO: 124759 - DNA, 1072 bp, Homo sapiens
ctgggcctgaagggcaaggagcccgtggtgtacccctggatgaagaagatccatgtcagcgccggtacgtggcgccgcttgggaggcgcgggaggtgggccggggctgggcctgggttcgagggtcggggtcaggagggagaggctcaggggaagggggcctcgggaggggagcccccatctgacccgggctgcggtgagatgtgggtatgtgcgcgccagccagccgcctgatcccaacatgagaacccttttgtacccagggtccctttatcaggagatttacgagacgccaaactgttagggcagtaattatagcccccataaatttaattgccctggcagaggcttcaggccatgtgtctttgaagcttttcttcagccccaatgcccagcaccattctttatggctctcgggtgtttcccgttgtcaatagcctgtgaaacattttctttgccgttttatgtatcttgcgtgaacttggtgtcaggttattatataatgatgatgtccaattgctcttccccaccccaccttctctctcctcctcctttccctctcttccgctccctcctccttggccttctatttcggggttctgggttttcagttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacc

SEQ ID NO: 124760 - DNA, 1054 bp, Homo sapiens
ctgaagtcattgtgtgtaacctattaaagtaaacattggtatttcagcattcaagaagatgtgtccacatcttagtgggaacaaggatataaactctacatgggtatgggttctcttttataatgttatgtgtctgtgagaatactggattccttgttttgctgctctgaattttgggctccttattggaaaatattgcgttatggttccattttagttactgatttggtgatcttgcttgagtgatttcttggtgattgaaattagaaaaaaaaaagagtgacggggattctgccagtttaatttgagttacttacacagaaaatatccacactacttcatggccatattccaccctggggtgtgggaatgagcagaaagcctgttgaagtcatatccagtaccacagaacatagagaatctttccaaggaatgagaaaaattacaggctgtaaatattgtcagcttgcttatttctgtctgttttaatcttcacaaaacttaagtagaatttaagagagcaggcaaacccacatggccacatggaattaaaatgactttaaaaatacatcatgcagtcagacctatgtgttactggaagatttttttctttcttcctattttcataggaagcataataaagaggatggctggttttctgctcattctgtagataagttatttcttttgtggattcttttgggttgttcttgcagaggaacttactaagaaaaaatatgtctgtcactgagggctttatgaagacatccagcctcagccggtggcagaagtgcgtgtctgtgctcctcctcagcggcaatgtgcgggggctcgtttgttcccacaagctgaagagacaatatttctgaactataaatacaacaggaagcttctggtcacacttacttagtggtttgttagggtttccatggtctaatttcacaacattatgccaagattccctttctcctgctctttcccctgcttcattgttggcggctctgagagagcaagacagaatttcccaccaaaaaacagagtcctgttcatttgt

SEQ ID NO: 124761 - DNA, 1355 bp, Homo sapiens
ctacacaatcacataatctgagaatagggactcttttatatcttttccctcaatctatatgacttttattcctttttctcatgatattacactggctgggacttcaatgtgacttggaataggtgaggtaggagtagacattattgccttgtttctagtcttagaggaagaacattcagtctttcactattaagtaatatcatgtgacttgtatagtcacatataagtaatatgtaatatgttattacctgtaggttttttaagatgccctttatcagtttgagaaagttcccttcttttccagtttgctgagggtttttaccataaatgtatgttgaattttgccaaatgctttttctgcatcaattattatgttcctatgttttttcttctttagactttttttttctcagccagctgtgctttattgacaacgcgccactcgggccttgactgcgtacttccgcaggaggcacagcctctccttccgctgccgcttcttggtcttcaggttctccttgtgcttgttgaaccggcagcacatggcgcgtgtcttcttaggccacaggtccaggggcttatacttcttgcccttgtagaatttcctgagtttctctttctgagtctggttaataaccgtgagaacacgtccaatttgcggacgactcaaatcttagagagcttggaggccgcgccgcctgtcactttggcgacgtgcagctgggacagctccaccttcaggtcatccaactgtttcagcagctcctccttctcgtgcaggtctcgagccttgatcttggccattgctgcataggccaccgccgctgcctgctctgagggaaagagctagactattaatatggtggattacatgttttaaactgtggactattaagtcagccttgtattactgggacaaactgcttggtcatgatgtattattctttttatatattcctggatttgatttgctaatattttattgaggattttttgcatctatgttggttacaatactgttttataattgtctcactgtctttgtatgattttgttagcaaaatcataaagtaggttgagaagtattcctgctcttctagtttctgacaaagattatgtagaatttgtatatatttttaaattttcttttctttctttctttctttttttttttgagagggagtctcgctctgtcactcaggctggagtgcagtggcgccatcttggctcactgcaagctctgcctcccgggttcacgactttctcctgcctcagcctcccgatagctgggactacaggcgccggccaccacgcccggttaattttttgtatttttagtagaggcggggtttcac

SEQ ID NO: 124762 - DNA, 1004 bp, Homo sapiens
ttaaactacaactctgctaaaggctatgaaactttattgttgttctcagatcagattgcaaagaaattacccattaataatacgcttcatagcaaactctactcttaagtatccgtcatacaatcagaaacccttggaaatcttagagcaaaatacacatcatttacccctctcttttttagaatcactattagatttaaaaacacttaaacataaaaggcttttatatcaatgtattcatttattctcttcaagtttactaagctcttactcgatgaatagtacagcatttgagtcccaagaaggccaataagaagtttatatccggttaatgatactgacaggtccctgcaccaaggaaaaaaaattacttttgagagtgcaaaaagcctagtgtcatttacctttctaccaataattccttgtgagtgctttcaaagctagaaggagaaagctaaccatactgaaccaatattttgtttttgagtttgaaacaaagtcaaatgcaaaagcatagcaatctgaggtaagctgatcccctctctagggataaatggagagttctcttttgaaaatggtttgcaaataatcatactaacagtacagctataagtgaaaagaccttgaaagatgccttcttaccagaggactgtttataagattcacaagtgcatgtgctcaagtacgagaaatgcctttaagtttccctttattattttcaagaatcctcctaaattgggtagggaagcaagaatcaaagccgggaaattcttttttaatttttagacacagagtgcagtggcatgatcatagctcactgcagcctccaactcctgggcttaagtgatcctccagcctcagcctcctgagtagttggaacaacaggtgcacaccatcatgcccaaccaattttttaaaaaaatatttttagagacaggagtttcactatattgagaccaggctggtctcaaactcttggcctcaaaggatccttagcctcagcc

SEQ ID NO: 124763 - DNA, 2886 bp, Homo sapiens
gtgagccaccatgcccagcctcaagtgcatttatgataccgctttcgagatacccctcctccttctccctggtttgttgatgtctcatcttcctcatagcagctgtgatctcacatgcccctttcccttttgttttttaggttttcaccttgaagatgccatccctcccccgttaggtcagaagtatatcaagaatgggaacttgaaatcctcacaccaaatgtgacgtggtagaaaaacagagtggtatagtaatgcgagtaggatctggactcccaatttcctatcagaattcacattcctggtggacttatttgctgtggtttgtgggatgttgaacaagtcacttgcctctcacagtctcagcttctgtatctgtaaaataagacaagaattatagtgaccccataggcttgctgtgaggatcacctgagccatacattccaaagtgctccgtgaactcatcagcacctcacagaacatcacttgctgctctagtgatgccagtaggtgctcagtaaatgcaagcccccatgcagcccctggacggggatgctggaggctccagggttagccaacagcattaacctgcttgtccgtcaagacttttataagagctgctaacaggcaggaaaattgcaggatttgagtttcacctcctccccttaaccaggtcaccttctggaggaggtgctaatgagcagcaaaatgaccaaaatgtgggcagtaagggaggcagagaaggaaacagccaaggagcttggacagccctctgctagctacccagctcttgaagctaggcctaacaggcatcccagagcccagcacaaggcccctcttggcaccaaggggagaataaccatgcaagggccagagatgtggtttttgttccggtgaagctttgggaaaaaacccacatcaggcccctctctctctggccatataaacttggagtctccagcctccacagtgggcacagtggtgctttaataattgctctttctcttaagcaggttccattttaactgaccaccttcttgacaaatattgagccacagaatgttcttgacgagtggcaacctaagagtgccatcagcagtggagggtctcaagtcttccattccagacccacggccagagcaggcaggtccaggaggggcaggcacgggactggccgcttcccagacatccatgaatagatgtggcctcctgtgagtcttcccttaccatctgcggtgtcagcttcagggctccagggctccagggagaacctgaggccttgaaggagcaggctggtgagccccagcattcactaaccacgacatctgccaacaaacttcacccatcagtggctctcaagtctggctgcacatgagaaccacccggggcggcaatgctgctgccaccttggaaggttgctgtgtactgaatcgaggtaatgcgtattcaatacttggcacttagtaaatacagcaggtcctcaaataatgttgtttttcttcttttcttttttgagacggagtatcgctcttgtcacccaggccagactgcagtagcatgatctcagctcactgcaacctccaccctccaggttcaagtgattctcctgcctcagcctcccaagtatctgggacataggcatgcaccaccacgcctggctaatttttgtattttagtagattttgtatttttagtaggttttgccatgttggccaggctggtcttgaacacctgacttcagatgattcacccgccttggcttcccaagtgctgggattacaggcatgagccaccatgcccggccaaataacacttagttcaacgttattttcttacaaaattgatgagaaaagaaaaatcaattccagctggggccactgtctatgtggaattggcacatgctcctcacatccgcgtgggttttctgtaagtactccggtttcctcccacatcccaaaggtgtgcacatggcatgtctacctggtcccagtgtgagtgtgggtgtgtgtgagtgcgccctgagatctgatggtgtccgggctggggcaggttccgtcctgcagcctgagctggttccggccacctgccaccctgaactggaataagcaggaaaataattatcttgtttctatgaatttgtcttaagtgtatgtattgctcatatttatttcagtgtttaatgtcaggagcattctggtctttatttagaagtttggtgatgcttttgcgattagaactattccaggaacttagcttccgtttatagcaattagcttatgggaaaatggattttgttttatggcggttcacctaaacttgcagtttccaagaacctattggcaacgttaaatgaggacttacttcattccttttttctgtatttgtgcctctatatcttacaaatagcagtatataaaattaatatagtctaataaaaaccagacacaattggaggtgacactctagggtgctggtctatactttttcaccctgttgtgattctactgatattaaatcagaggttctcaactgagaggaaaggaagcatgctcccttaaggaggaacaaaggaaaggggtggaaggcgcgggcacagtacactttgcacacatcatgaactgagcttgatgctaacagacttggattggatccagcctccatgttttacctaagatagaaagtgtgtgacactcacactgatagcccatgatcaaaacgctttttgtttgtgtgtttttttgagctggagtctcgctctgtcacccaggctggagtgcaatggcacgatcttggctcactgcaacctccacctcctaggttcaagcgattctcctgcctcagcctcccgagtagctgggattacaggtgccaccaccatgcctggct

SEQ ID NO: 124764 - DNA, 1043 bp, Homo sapiens
aggtcaggagattgagaccgtcctagccaacatggtgaaaccatctctactaaaaatacaaaaattagctgggcgtggtggcacgcgcctgtagtcccagctactcgggaggctgaggcaggagaatcacttgaacctcagaggtggaggctgcagcgagctgagatcacaccaccgcactccagcctggcaacacagcaagactctgtcaaaaacaaaacaaaacaaaaaaaacacacacatacacaacaaaactcttacctgctccccaatgcaaatgtcagtttaagtcaggaaataaaaaaagtttctaaatttatttactgccagacctattctagggagagaaagaaggaaagatgagtatggggaactaaacattgattttaaagacgttttgtgggccagttaattttagggacttatagtaagacaaaaaactacatacctgggaggctggtgagagtaagtctaaagaattgaaattttctgatatattatgtagaagacaggtaccccccttacctctcttcaaagagcctaataacatagctgcatttatgaagcctggaagaagttgttagagaaagtttgagagttttaaaattattactgaagaaagatctgaatctttatcaggaatcttagttttcctacaaaaattacaaatctcagggcagatatgtcagccatctggggatcaaaaactaagccttttgggttaggagagaagatggccgaataggaacagctccggtctacagctcccagcgtgagcgacgcagaagacggtgatttctgcatttccatctgaggtaccgggttcatctcactagggagcgccagacagtgggcgcaggtcagtgggtgcgtgcaccgtgtgcgagccgaagcagggtgaggcactgcctcactcgggaagcacaaggggtcagggagttccctttcctagtcaaagaaaggggtgacagacggcacctggaaaatcaggtcactcccacccgaatactgcgcttttccgacaggcttaaaaaacggcgcac

SEQ ID NO: 124765 - DNA, 1008 bp, Homo sapiens
tcaaaaaaaaaaaaaaaaaatgaaaagaaaaaagaaaaaaagaaaaatgtcaaaagaaagcctttgcctattttgatcacttaacagataacaaatggagcagctcagtagaaacaaaaaatcagaaactgcttaattgtgactttgaaaaatattaactttgaaaaattttaactttgaaaaataagcagtttctgagtaaaacaaagtgatctccgaagttttcaactgacttccaagcatgcagtgagctgccgggggacagtgggtgcttctttgtctggcttgcagcagcagcatcctgcttatgggagacgttttttaaatattgtcaacgttggcaacattaacttgctcagctagaaacgtgtgtttaaatagcaacctttggcctttgggtcctgccttgtcaaggccaaggacctcagccttaccctgcttcctagaagcaagatcaaatcagcactctcctgtaaatgtcaccttggatccattgcactcaggaagacacagtgcagctctgggaagtgtcaggagagcctagggacaatttcatactggcgtgagcaagactccgggtcctgtccaggtaattcagatggatagcgggtgtaaagggaggccatgccctctgtctctccagatggatttgattaggctaaggaggaagaggaggccttgttagtctgcttgtgaagatggctagggagagcattctagtaaaatctacttgagaccaggtaaaacagctgcaaccctccctaagaaaactgggggtattctatatctctcaaggcaccatgtgtgaggcctcagagggccttgcagtccctcttgctgtcacctttccccaaccccactattttctgatgggaagatctcttccagcttgcctttgtccacatctctctcaacttccatatgggcacagacctgcgtcttataggcagggacctcctgtattcattcatcttaagctgttttatgtaatagtattgaaaagtgatt

SEQ ID NO: 124766 - DNA, 1296 bp, Homo sapiens
ttgtattcatcatttaataattcaagaatatctaaaggggatgaacacttctttattcagattagagcattaataggaaaacacagtaaatcagaagccctttgcaaccagcctacagggagtgctttcgaatgccttggttacaagaatggttcccgggctgggagacaggagacgtgagctctagccctaggtcagcactaagctgtgtgtgttgtagatctgtttccttctctttaaaatgagggcatcccattgatctttaaggtttgttttagctctaaaattctgattccccatagttaagggtttaagaaaacatgaggcatgtgcttctgacagtttttggactctctctggttaggtattatttattgctcatatagccatctcatttattaaggttttttttatagccaggaatagattcagagatcaatacatttttattaatgatagtccgtcatgcctggtaaagagatagcaagaaagctcatctagaatgagccacttgaataaacctgacacataagcttagcttcgagctgcattttggcaggcctctctgtgaaataatgacattggcagaggaagaaactatggaaaccttcttcacagccagactcataaaatcaaaagcaggtttggggtgtgtttctcagccctggctgtatatgcaaatcccatgactttttgagtgcagcattttatcttcaaaaggacaaaatttggcatttgctgtagtcattaaacatgataaatgcctaaaatactttagagtttggattactgtaggttagaataaatattgtgtcaatactaaacaggattttagagtggaaaacttctcatggacattgtcaaatcaaaacttaaaatcttttcactattttccctttaatcatacgaattgagcataattgttgccagttctccttgtaaaaatgatggtctgggccttttggaagtgaattactcctcccagcaccattaagagatagccttgtgccctgaaagagttaattcacttccagatggagcttttcagcccctctgagttcagatgatattaagttcactagtcttttatgtttgttttgagcctcttgaacttcgtttatataccatttatggatagaactgaagtattctatggtaattttagactatttgagacctcttccagaaatttcacttcagagtcccaatcccagagactccagagcaaatgcagctttcatctcgtctctctctccctccccttaatgaccttaaccctgacctgaggaccactct

SEQ ID NO: 124767 - DNA, 1068 bp, Homo sapiens
ctggttttgtggaagacagtttttccatgggtggtggttggaggaatggttttgggatgaagctgttccacctcagatcatcaggcattcgattcttgtaaggagcacacaacctagatccctcacatgtgcagttcgcaatacggttcaggatcctatgagaatgtaatgcagctgctgatctgacaggaggcagagcttaggcagtaatgcttgctcaccggctggccactcacctgccccgcaacccagttcctaacaggccacggaccaggtcagtactggtcctcagcccgggggttggagacccctgatctagggcacttcagtatctgcagcgacaccttttattttccctaacagctttttaaaggtatagtgtacatacaatgaaatttgctccttttatacaatgaatggcttttcgtaaactgagagttttacaaccctcaccacaattcagttttagaacattccatcacccctgcaaaatcccgtgcatccatttgtaatcactgctcattctcccggcccccagccattggcagctactaagctttctgactctagatttaaagctgcttcttggccaccagcctggttttatttcccaattgctgagcactgctgcaagagaggtctttctaagactgaaatccaatccggccaaccctgtttagaatgtttgagcctaggatacagtctggtctccaaagccatcctgctggggcttctatttcaccagcaccactgcccacaatacttgtcttttcccaaacgtgccatgctttgcacacctcagtacatttgcacatgccatttcttccatttggaatgccgccccttctggcaccgtgaccggttcagcactgttgtcttctaaaaagccttcctcagcaacttcagactcagtcgtttccactctgttttcacagcagtttgttgacatctttctcatcataggacttgccctgttacattatatttgcagctttgctcatttgtcttcctcaccagactgtgagctggacggcacagaatgtgtcgtatcagctttgaggtttgcgt

SEQ ID NO: 124768 - DNA, 1888 bp, Homo sapiens
tcctcctatccaattataccatgcttatttaattgtctttctccttaacacaatgtgagtttgggtgggctgtggctgttttgctcatcattttatcccagcttctggcacattgtcagcacacttcaaatatttattggatgaagtaatatttgcaactgtatttcctgttttgcagttttatttctccttgttttcatttaagaattttttaaaaaaaatttatgtcttaaagatttccacagataagattacacagggaaattttttttcttcaaatctgtggaacaaaacaaacaggtattgtggaaggtggaaaaatcgaagagacactcagaaatcaaggtttctgtctggagcaattttgcagttatatgaaagcgcttatttaaaaatgttaacttaccatagtatttataagtatcttattttttcagattacatttttccttctttcaaaccaaaacataaggaaccacagttccaaagagcctttaccaccagtctcagcgtgttctctcctcctgtttgatttaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgttcattcttactacgtattttttgacttaagaatgacatctttagatgcatttcagagccaatgatgatatttgctttagataattattatattattataaatatagccatattattttgaattcaaataaatttctatactggtaatactttcttggtgtttttgtttcttccccatcatttggtgaactaatgttctgacaaactgatgttcacactaatggggaaaggatgggaataaagagaaaggaggggaggtcaaaaggaacaaagctctgagttggccagtggcaagctagtgttttgctgctttacctgaatccttattgagtattcgtttgaatgttttttaggtcatcagttctctaggaattcagccagcattaagtgtaacatgccccaatatggagcacagtcaccacttttcccacctcagcctctagaaacattccaggtaatagacctagacaccaaatttggcagaagtattactactttcatcattttactggtgataaaaaattccaggcactgttataagtgctggggatacagtgatgaacaaga

SEQ ID NO: 124769 - DNA, 1035 bp, Homo sapiens
cttgattcagtgatacctagcaaaattgtgcttcccaaactgcattatatctttagaatccaagtaatggagcattttgattctattattttttctagggtccacattgaacagccgtttatgccatcagcccagtgatagaacaaatgatgtttctgcttgggcaagctttgttttatcaggatcagtaaccttatcagcagttgacccagaactataatgcatgtctctgaatagatagcatatgtcacaactctgtgcagacttgcttcataagcaagattgtctaataaagatttaataaataaggaaaagtttgcagcaaaaagtcttcttttataataacttttcttaagctcgtttacagctcctggctcatctcttgcatttattctcataaaaactaaaggaataaacatacatataaatgcattcacacagactcccatgatgcatcgtttatctgtcagtatttctttctgaaatatatcatttgtgggtaaagaatgtagaatttaaattatcatattgttttaaggttcttatgtgacatataaatgtagtaatgtccaaagactagaaaacccatgagtgtgataaaccaacaatatttttatgcaattgtatattattttttcttaataataggataacatagaaggttttctccaaatgcaaaatggtcctggctcaaaaatattcttatttaaccagtagtgtttagtactctataattcaaaattggattcttcactctcgtatcaacctgcttagattttagaagacatataataaatggagagagaagatggagcatccccatacataaataagtcacgcacgacgtgtacattttgacacttaacacttcttttctttgacctttgacaggttagggcttgacccaaaactactggctaaaatcctaaatatgagctcaggacggtgttggtcaagtgacacttataatcctgtacctggagtgatggatggcgttccctcggctaataactatcagggtggatttggaacaac

SEQ ID NO: 124770 - DNA, 1065 bp, Homo sapiens
ttgttgatttcgaatggaaactcagtcttctccagtgaagcatgacgttctaggatagactctgaatgacaattactgtgtattctagctggtttcagaccattacaagccttgggcacagtggaaaacagaggacttcagtaactgattttaatatcatgtctaattttaactgtcagttatgtatgtgccagagaacgaatcctcagaaagatgaaatgcaaaacacttctaacttgctctttttaatgatacactttgctgcgggtgggggcagggggagggaagtggagagggaataactatctcctgaagggaatcagcacggtggggaagcatcagatttgaaaagtgagaatgaaacaactgccacctgattttttgtgtgtgcccctcaggatgcttctaaatagtaatgtgttcaccagaaagggtttccatcaatcaataccagtacttttccttgaacattcaagaaaaatgtagggttttacaaagttaggataattagctttgctcaccattttgttgaatattatagaaaagagtgaatttccttagctgtaaaagctcttgtgagctactactgagtgtaacctggtagattagaaagaaggaaggaattctgctgctttaaatatgatgaaccatcttaaaagatctaagttaggaagccctgaaattatatttcaaatggagagagaaagtgacgttttggagtctttaaaagtattttctccttatggagcatattagatgtatgcattcttgaacatttggtactttgcagttatagcaaattaactaattgttaattgtgattttacttttcacaattattccctaagcacactggctttatcttttcctaagtgatatactacagtagcatactgatagcctaatcttatttaaaaggagaaagcaagcatcagtagcatactatgcatgcagtgaacttggatctttataaaagaatgaatgaaactgttgggtttctctctgggaatctacagttgaacagaatgaatgatagccaatttagactgaatttctgtatctgtt

SEQ ID NO: 124771 - DNA, 1980 bp, Homo sapiens
tcttcacggtttacagacatggtttaaagtgacaggattgttctctaatagagtatagagaacggccacgatttattgagctttgcaaggtgaaagagaaaattggcatcagcaagcataaattcccaagtagtaaattcccgcaaagtagtatagcatcaaaatggtgtagccacatttatattctgcccactctgaagtgaaattttttcagagtattaatgtcaacatttacaaattgagtcacccattcctgtgaagtgatcatttctgattaattttattctaagtcagtggtttttctggaacactgttccccttttttaaaaaaattgaagaataaaatcttacagtttaaaattcttattgaccctatgctcttttacagtgagtctttatggatgttagcaaaatttttaaatgttgttaaaaaaaaaaagtaaagagtaaaaaatatggtatacaatatattttgagattccttttttattagacctttctgctttctaattggattcctacataggcattagaagcatagttttatggtcctgaaagtaccctacttgtattagagaggttttgttcctgtgtatcacatagaaataacattgatgatgttttgttgttttaaattaccagctccactggaaattgattttaaaaaaaaatttttggtggtataacaagttacttgcattgccaaccaggcccaggctcctccagcaaccactgtattgtcttccgccaaaagaagcttgaagcagctgaacttctggaaagctgttcaagatgagaactttccctccaatgtagttttattaatagtttcttgcatactgcccttagaagatgttgcttttgcatttatgtgatgactggagccttagttgtttaccctaataaatataacagatggcaaaggtttgtaatttgtaaatggccaaaaagcttgttctttgtatgtatctatactgtctggttttacataagaacaaaacaaattatgtcactaaactgggatgtttgtgtcacaggaacagatctggaaatgaaacatctaagaccatgtcaatccaaatcattcacttatccatcatacaaatttcttaataaactcataaaatgccatcgtactggctagttgttgactattaagtttaccacctacttaatagtcaactactagccagtacgatggcatttgggcatacatgtaggtctgcattcaagctgtcccacagacttaagcttttctcatttataaaatgacaaaagtgattacatctatccactgggttgttgtgaagattaagtgagttaatccatataaaacttattaaatagtttctggcacatagtaggtgtcgatatgtggtaatgatatttgtggttgtggtgaggtggttattgtttgaaattaaattgtactttaatctttttcttcctaacatgtctcactagctggcattacatatttatttgtctgtttattacctgtcttcccatctagaagctccatgatgggaaatggtttgtttactcattgccatatcttaagaatatacctggcaggtattaggcacccagtgaagatttgtcagataaataaggagaggagggaggaggtaggggagtgagtgagtgaggggataagatatggcacttctcttgccaaaggtaaaagttatccaggtgggtcttaactcagccctcctggcagacaggcacagcctcctcttagcttccttcttactgtctccttcgctgcacgtgtagcacttggatatagcagatctgagtaaacattgatggataagtgattgattaattaaaactgacatggtcttagatgtttcatttccagatctgttcctgtgatacaaacatcccagtttagtgacataatttatttcgttcttacgtgaaaccagacagtatagattactcacagataatataaacaaacatttttggccc

SEQ ID NO: 124772 - DNA, 1041 bp, Homo sapiens
catgaatactctttgccatagccataaaatgtattgcctgtgcatttgaagttgtgcatttgaagctatattatcctttttatgtgggacccccatttcttctattatgttgaaatacaagaaacacttttctgtaaaatttaaacatactttggcaatgttgggacaaatttgtataagacatggttttagtgtgtagtgaattcaagtggtatgctaccatgtgactagtttatgtaccttttaaaaatatagtcccccaaatctgcactaaaagtgttcttggtggttcattctcaggctaaaaactggatagcattcataaagatgcaattcatatgcataactctttcattttattttgcctgtggtttagttactttgcattcgtatgtatctttctattaaagtggcatactttgcttaaagtgattcaggaattctgtttttcctatggatgatcatcttttaaatgcttaaggttaatgtcttaattttagcctttaatcttttgggttagtaatgctacatatgattaatcacctaattaatttttgaatgttttatatttcatgaaaataataaatatacatttcttactttagaaaatgcttaatgagcaggatgctttactcagttgctttcatcacattccccaaaactgcttaccaaatatatcacaaaacagaatagtgtttcataccatagcttttgataaaagtaataaaaagagccaacatacttgagatatttttgaaaacacagtaatggattcacatttcctcttaattaccatatcaagatgctgttgttttattgaattgcccttgtctcagatgtttaactatcttgacctattaagttgtcatgttgtaattgagataaaagaggaatttgctttgcgtcagcactaattggtttatcaatatcatgtaccatttacattttaaaattgaatgtccataagatggtaaagcatgtctgtacagagccttaataaaagtggtagtatatagggaccttttcagtgttatgtttgta

SEQ ID NO: 124773 - DNA, 1156 bp, Homo sapiens
acagtcgttgtctgtttccttgagactttccttctctcttgcctcctgagaatctcttatgtactagagctagtggatgtgagtgaatgagccaacaatcactgccctcatggaggtagtgttattctaggggatacagaccagaaacaaatgaaactgttaaagaggtgataaatgctatgaataaaattgaagcaggaaaaggagagagtgatgagatgctattttagattgttaggttgagtggtcagggaaggcctctctgaagaggtgaattttgaacagaggcctgaatgaactaaactataccagtcatgagtatctgggggaagaacatttcaggcaaaaggaatagcaagttcaaggctttgagatgggaacatacttcacctgtttcaagaacagcaaggagtgcaaggtggctggaaagcagcaagtgatgggaagaatgatatgaaatgaaataggagaggtagcccagagccacatcatgtagggctttgtaggacttgggattttatactgagagggctaggaagtctttggagggttgggaatagggaacaaacatgagctgggtgaactagatttatattttaagaggattcctctagctgctatatggagaacagactacagagacaagaggagaagagaaataaagtaggagactattgcagtaatccaggcaggagttacctgtagctcagaccgtggtagtagggatggacagtgagagaagtggctgaatcaccagtgtgtaccttcttaggagcagggacatttgtgattcatccttcacccaagggcttaccacagggcctgattcttagcaggtgcccagttaattgtgttgaatagataaaacaaatgcagatttcttgtctttcccattcactatgctgccagagaaagattttgcaagaagtcttcacagtgatgtcatcttaacatagtggctgtagaccactaaagttcttcttgacctgtgccagcctacttctgttatttataggtgcggcccaaacccgctaatacttaaaaagaggggctaaaattatcccagagaagacaatggcttaagtaactaaataggaaaatgcccacttcacaaattcaagttaaaaagtagtaagcccttacatttaaatagcat

SEQ ID NO: 124774 - DNA, 1045 bp, Homo sapiens
gatgaaaaattgcttatttcttcatgtatttgtgtctgtgtttatttcaggaaaagctaactaaactttgtttatctgactccagaagagtgctgtgagtgtttttgcttttctgtttccagcttggataatgccagaaatagtgttaacaaggggttatgttatgctggcttatgttaaaccagatcacccctaacatgtgcaaagccattcatctgtgtcaccaaaacccaagagaacatctgacatggactctgaaacagaaacagtgatcacttacaaatcaaacatggcacgctctaaactgattgtgcacggcaatcttttctagaaaggacaactaattgaacatgataaagtgtaaagttaattaacacccttaaatttgttgattactttcacgggattatattgttcgttgagtagcagctttctgtcccagctgtcgcctttttctgcgaatgtcgctggtaaacaatagagacaccatagcaagtcgtaaatggtccctgtgacagcagccccttgtgaggctgcatctgtagaaaatgattagaacaattgcattttaaagatggctcacattgcagcccaagtcccattggtcctcttcttgatctcttttgatggcacactggttaaaacatttaagttcttttgagtaaattaagtgatttactatgtttggctatatatcaatggaagtgctttggtggcaatgtttttacagtattaaagacaaatataatttgaattgtactttttagttttccatctcttccctctttggatttgaagccttctttctaatagtcatagaattgaaaatgatctccttatttgtaacttgggagtagttcgtctaagttatcagcacctgcatcatggtttatctatcataattctttgggtcagcttttcagtaaggctaaattccaaatttcagctctttcctactgttagatcaaagacttcgacatgtttaagctgaatgaatttacttgttatgtttaaattttttataacatttgtgtaatagctatat

SEQ ID NO: 124775 - DNA, 1806 bp, Homo sapiens
tggttagttacctttccttaatgttatgttaatgcaccatcagaaatggttgcaaaaggctatgcattggctgaggggctaccaagaatggcagagtggaccatactcaactcattgtaggagttggcaccctcttcaactgtaccccaaccccaaaatatgagagtccacattttcaagggattttcacatgaaagagataattcctggttagccaagtgtagcttattagcacagccttctcttaatctttagttttctgctgtccccagttttctactgtttgctgccgggttatcatcttgccttttgcttatttcttcttactctcttccctctctcctctgacagccattacttctgtatacctaccctcaaagttataacagaactcatgtgaataatcagttctctttaaaatagagggcacatgattattatgcctgtttttcttctcaagcaaactagacagggaatagggatgggaggatacccagaagggtgtggtattggtggtaattggattactgagaatttggttattggccttgttttactttgtgattgttaatgctgaatgaaaggatgcatgtgaaacttacaggaaaatagccaactccaatcacagaaatgttacaaaccacgtgttgcctaaagaaagtaaaatagaaggacataatgattacaagctatttggcttttttttcctcttatttggcttttaaaaatgacttttggctgggcgcggtggctcgcgcctgtaatctcagcactttgggaggctgaggcaagtggatcacctgaggtcaggagttcgagaccagcctggccaacatggtgaaaccctgtctctactaaaaatacaaaaattagccagctgtggtagtgggcgcctgtaatcccagctactcaggaggctgaggcaggagaatcacttgaacccgggaggtggaggttgcagtgagctgggatcgcaccactgtactccagcctaggcaaaaagagcgaaactccataaacacaaacaaacatacaaacccagctacttgggaggctgaggcaggagaatcgcttgaatgcaggaggcagaggttgtagtgagccaagatcacacccttgtactacagcctgggcgacaagagcaaaactccatctcaaataaatagtaaaaataaaaatgacttttaaagctgaaagatacgttatttgcaagacggagttttaaaaatcatattctccaggggcattaagttaactgtctttgtgctccagctatttagctttcaggagtttagtgttttattgtaaaccgacattgtgcaccatcttgatctgaggtgaatgccaaggaattgctttttaaagtgatttttagaataaaagaaaaccatttcatctctgatttgccctccctttaaaaaccccactctgcatttctgtcttacggcttctgtactgcatcagtcctcctcaagccagccagctccatgcggaacattctgttgctctttcagcataagcaggtctattgtgatatttatctgaattcaggcaaggctaattaaaagagctgctgacagttgttgtgatctgactttgactgcagcttgatggtcattatgggtaaataatgaaccaggtctgcaaatgtagcagctgccaacttgggatagaagaacggctattgcttccaatttaaggatctatcgaccgcttctcttctccctgcagatcttctgcagaaaactaatgttttctgctgctgtgtattgtggtttcagctgtttcagatatagcctataattt

SEQ ID NO: 124776 - DNA, 1008 bp, Homo sapiens
gtcaattgagaaatgtttttaaaatttgttttgatttctaatacagtaaataccaatagatataatccacataaacaaaagcttttgtgtcctcaaaaatatttaaagagtataaagaaatcctaagaccaaaaagtttaagaaccactggtttaaaatgatgaggccttggaaataacccaaatgtccaataagggagaattgattaaattacatattatgaatcagtgatgtagataaatatctgacatgaaaatattttacagtgttgtgttagtagtaaaagcaggttttgaaacaatacatgaattaatgtcacaaaaagttattaatatataatatgcttaatattgtattctataatacctaggtattaggtagctttttcttgaaaaggaaggtagaaaaagtttttttgaagttgtcataacagtattagactgcatcatgagatactgtttccttctggcttttggtgaaggtatttgctttttactagttttgtaacattggccaagtctgaattttgttctccttactttaaaaatcagatcaaggttgttaacagagtaagctgttcaatgtattttacttccctctaacatctccttagcttttaaaattctgtataatagcggtgtatctgtgacaattaatgcttaataaagcttcccttgaagtcaaaataagggtcttttgaaaacaagaacacatcttgtaaatatcatcttatttctgtgaaaaaaaagttttgtggaataatagctgtaatacagaaagtaaattatcatcatgcagatgcttattggtaaagataggtaaggtagcttatgattatacactaagtactaggccaggtattttgtaaaattgctgagtactttacagacatcatctcatttaatcctcacaaaagccctgtgaggtcagtactgttgttatccccattttactgatgtggaaatggtctcataaagaggttaaagaatttgtcctactcatttgtag

SEQ ID NO: 124777 - DNA, 1052 bp, Homo sapiens
tgtatgtatatttttacaaatatatataatttaccaagtaattccactttaagaatttatccccccagagtaagaatatgtgtaaagatttaactataagaatgtacttttagcattgttaagaacattggttctcagtgtaccctccatggatccctaggaggccataaagtgaaaattatttttctaataatagagtaataatactcatggtgcaaaaggaatggtgagtaaaactgctgcccttagcaagagtcaagacagtggtatcgtattcttaacagctacacataaagcattccacttaatgttccttgatgaagcattaaaaattattaattttattaaatcttaatgttgagtacatgtcttttgtatattttatttgatgtaatggaaaatatgccccaaacgatcctgctacagttggtattggggttgtcttgagaagtatttaggtgattgtttgagttgccagctatactatctgcatttttgtggaacaccatttttatttcaaagaataacaagacatcttatagaaagaaaaaagtgagtcttacttcaaggaaagcaactgagggtatttgtaaccaatgataaaactggatctttcaagtaaaaattagaattttggaaaacttgtatctgaccatatgaacttaacaactttctaatccttaaagacttttgtgaaaagattgttggtgcagttaaagaatgtgagtttctgttactgtatactgggaatttagaatatctgcataactaactgaacgagtattttccaattgaccgttgtatgatgttaccaaattatgcctagataaaagatgcaaagtacaaaatagagggatagattttaatgtaacatagtataaaaagttctttccacattgcaacaagcctttaagaaaccaccatttgtcaggtttgggtttaatataaaagaaggatatccacaattatctgaaaaagttattaaaattctctcttacttttttaaactgcattatctatatgaggtcagcttttcttaatttcaaccaaaa

SEQ ID NO: 124778 - DNA, 2224 bp, Homo sapiens
gaaaaggttttattcactataaaaattaaaacaaaaaaattaaggttttcctaattcaaatataagcattttagtgatttttaaaaatgtaatagaagcatacttacccttttttgttaatctgaatttttaagtggaaatataacatgctgataaaaccattttataacataaaaatacacattttcaatatacctatattacctaataatgccattcccacattttaaaattcattcctgtgggatagctatttgtccctgcaaatgcagatagttcctaattttcatacatattattcacatacttgagtgaaatagtttgctttcagttttaactagtataatttaaaaaaactgtggtcgggtctctcaaaacataagagatactgattttaaaaagtggttacaaatgaggcatttgaaaagcaattcctaaacaattggattttaggggtttaaggccaagcatataggcactctactttttcatttctgatcaagaacagagttaaaaagtaaaaataattagagaatataacactttgtgcttttagagtattgattgctcagatggaattgaggaaattttagtaatttctagaagcaaaattatagagttagtaaaatcatcttagcagagaataagatggtttcatgatatattttaaaatactctatactgggccaggtgtggtggctcatccctgtaatcctagcactttgggaggctgaggcaggaggatcacttgaggccaggagttagagaacagcatgggcaacacagcaagaccttgcctctacaagcaatttttaaaatcttagctgggtgtggtggcatacacctgtagtccagctactcgggaggctgaggcaggaggatcacttgagcccaggagttagaggctacagtgagctatgatcatgccactgcattccatcctgggtgacagagtgagaccgtatctcttaaacaaaagaaaataaaaaataaaaactgtttaccaaaacttcttgccttgtatttatcctggacctcctttccttacacattttccaagttcacttagcaaatgaagcaaaccaaaaaaaccaacaaccctccattgtccataagctttaaacctgaaacatggttacatttgacttgtgcctggccagcagccttttcatttttttagttttgtaatcaacagttaactgttattttcagagtaaagatcctaaagatttgtgcattagaaacatttcttggggactgatgtccagatatcactgtgtaatccctattttagctaaatttctgttggtatttgtatcattgcatgattcataaacagacattacttattccctttctcttctaaactgctatactctactcatgttgtggaaactgctattttgaaagtgtaactactgatggactctttttctcttacctcctcagttgattaaaatgtctcattttatgatgaggttgcttgggtgagaatcttggaattacagctgtaccttggaattttttctcagttgtcttgaatggattagaaatggttaaatggcttcaaatactcatctcaaccttcaaatcactgatgggttaaaatgagttattgaaaaagaacgaaacctcctaattgtagcggtaaggcgagagggtataggcagtggggagaggaagtgcatgtgtttgggagtggcatgactagggctagagggtgcaggggaggggagaatgtagacaaggcagtgagctatctcacatgaactttacctaatgaaatttcttgtcacttcttttctttttatttaaaagtaggtattagtaaaagctactacagcattttctcctaataattcatttttttttgtccaatataacttgttataccagattttcctttcggtcattaagatttaaatttcatatttctggtagtaaaatcatctgtcaagtgtggggaatctgcagctttaacaccacttcatgtctgattagaaggttttcttttgcaattaattttcctctcagctctttgtggagaacagtagcccactgcagagaggttagaatactgtggactttggctgttcatctttaatgatacaaggaggtagcaaagcaagaataaatgaggtactttttggtgagcaaaaaatgtgaactgtcagtgtgagatcggttctaggagcagttagccagcagtaatagggcacacttg

SEQ ID NO: 124779 - DNA, 2293 bp, Homo sapiens
atattcataaaaaacacattgcactaaatgtaacacacaaaatgaagctgttgatacatttgaggcatcatttggaagcctttctggaataggtgaggttcaaattatgttttaaaagattaatagagattttccaagtgaggaaggggaaggctgttttcaggcaaagggaatatagcatttacaaagatacagaaatgtgaaataacacaatgtttttgcttaaatatggaagtttgatatttctggattttggcatttctggttgtaaatggagaggaaagtgggaagagatgagattagctcgattgacaagacactcacatgaaggttcttctagaatcactgtattcagaaaagcatttacattgattgggggatataaaaggctagcatgagaaattaacatagcaatgtatttagattttagaagcccacaactccatttaaaagatgctgtttttacctaggttaacaagtaaattgttaaactaagtttcaaggggacagatttagttgtacttttagaaaatactgtctttataaatgccttacattgtgtgtatatgtaaatgcttgcagataaaataatgaaagttaaacaaaataatgaaagttcccacgctcttcactgaaggcagtcagaacttgtggtgggttaggtgataattttttttttttttttgagacggagtctcgctctgtcgcccaggctggagtgcagtggtgtgatttcggctcactgcaacctccgcctcccgggttcacaccattcttctacctcagcctcccgagtagctgggactacaggcacctgccacaacgcccggctaattttttgtatttttagtagagtcagggtttcactgtgttagccaggatggtctcgatctcctgacctcgtgatccgcctgccttggcctcccaaagtgctgggattacaggcgtgagccaccacgcccggccacaggtgataatcttaagtgagctgagagggctcaggtcctcaccaacttaaaatttacttctaaggagagacttggagagtctctgagattcgtagagtattttttaaatgatgttttgatcgtacccatttacctaattgaatttatatggtgcctcaatttagaaaaactgaaagctaaacttcaaattaaaaatgtaagacttagatgagaccatttgataccaaaatatgatggtatcagttaagttccttataaaaagaaaaatcaacttttctcttgcagtgttaatatttttcctgagatcctgtctcctgcctttaaccatttctctgttatttgagggagatattcaaggattgaagcgaacagagtccctcactgaaaggctggaaatataatttcacttaaccgtacctggtagtatcttcttaaatggtataagaaagtgcttttctaattcaaatgattcaaataatatttgctaatattatgaccaaactttgaagaaagtgatagttgtattttataggattaagtgagatccttatctgggactatgacgggattaacagataccttcagaatgctttacagctgaggtgtatgtagatagatgtagagctctaaagggattaggtgggtggtggttaagcaatagcagatgtcccttttaaaatcttcaaactagaggtctgttaagtacagtgcttattttttgctgacttggttccatgagaaaccttgatgttttttagtgcttctgaaagtatcaagaagaaactattcagatggtttggaaatttggggcctactctttttgctttgtaaaatggacagttttggataagcaggaaattctgactgatgggcagcagaacaattaattgcagtatagaagtgcattaggtatagtgaaaagagcacttacatgagaaatctgaactcagatctgagttcttttatttcctctatctgttgtgtgactttgggcaaattaacttttctgagtctcaacttttctgggtgtaaataaaagtgatgggactgttggtgctgagtctaaatgcattgcttattttgagacttaaatgaaatgatgtaccattgaatctcttggagtgggcatattcctttctctaatgccatttttagggcctgactttttgtgaaaatcaaatgagattttggtgttttctttttttctcaccaaaatcctaacctcagggctgactttatcagaatgttctaatgtaatcattgtggaaagatacacattagtacttacttgagaatgttgtaacccaaatcagaactcttactct

SEQ ID NO: 124780 - DNA, 1226 bp, Homo sapiens
cacaatctaggctcactgccacggtctaggctcactgcaacctctgcctcccaggttcaaatgattctcatgcctcagcctcctgagtagctgggattacaggcacgtaccacaatgcctggctaatttttgtacttttcatagagacgggggttttgtcatgttggccaggctggtctcgaactcctgtcctccagcaatctgcccacttcagcctcccacagtgctgggattataggtgtgagccactgcgcctggctggaaattacattttaatgagtatgaatatgcgtggggagataaaaatgttgcaaatattttctgccagtttgtcctttctttattcagtttatgataatttttaaaatacagaagcttggaattatcatacagttgagtgtatcagtcttctcctttatggcttctgagtttggtgtcctatccagaaaaggtttactgtcactaagtttgtaaaattaaaaagaaatttatgtacatcttcttttagttattttgtgatttcatttttaaaaacttaaattttttattcctttgcagtttattttagttgaaggggtgagcgtagaaatctagattactttttcttttaaaaatatatttaatgaaagtctgtttttttaccctaatttcaaatgccccattaatttcatacactcagttccagcatgtatttgggtctttttctgagctctctgttgatatctcattgttgagtgtttcctgagtaggacaactttccgttgctttattttactgtctggaagggtagttgtctttcattgctctttttccctcgctcagaattttttagactacttttgcttgtttattgttccaaagagacatgaaaatcattttatcatgttcctcccaaaacattgttaatatttttgttgggattgcactgaatttatggattaatttatggaaaattgatatatttacacaactaaatctttctatttaagaataagatatactcattgatttctttttgtgtgtctcttactaggactttaaagttttctttaggctgggtgcagtggctcacgcctgtaatcccagcactttgggaggccaaggcgggtggatcacctgaggtcagaagttcgagaccagcctgaccaatgtggtgaaacctcgtctctactaaaaatacaaaattagccaggcgtggtggctcatgtctgtaatcccagctattc

SEQ ID NO: 124781 - DNA, 1034 bp, Homo sapiens
agaggctactctgaatattcttgcagagatattttcatgtaaatgcaaatttatcagtaggagaaattttaagaaatgatatttctaggtcaaagagtatgtgtgttttaaattttggtagatgttgccagtcttttcatcaaagtttttacttccaccaacaatgtaggagaatgttgtggtccgaatgtatcccccagaattcatgtgttagaaacttaattcccagtgcaacagtcttgggaacttttgggaactgtttagatcatgagggctctgcccttgtgaatggattaataatgttagaaaagggcatggtggagggagtttggtcctttggtccttttttgcctttatgcccccttctgccatgtgaggacacagcatgcctcccctccagaggacacagcattcaaggtgccttcttggaggcagagctggaaccctcaccagacaacagacctgctggcaccttgacttggacttcttagtctcagaaatgtgagaaatacttttctgttctttataaattacccagtgtcagatgttttgttgtaggagcacaaaaggaaaaagagcatttattcatacatttgcaacaatctgtttgggggaactgatacattatctttacatttcttttctagtctaataagaagtaaaaaatagtatagtgtggttttgattttcttttctttttttcctccaaattacgatcttgtttgagcattttaagaacatttattagccatttatttgcctttttaaaaagtgattgctaattcctgtcctttatgcgtaattttattagatttattcattcagcagctatttcttgagtacttacagtttgccaggcactgtgctaggcattgatcttttctaattggtatgtatgagtatcaaatgctcattcatttattcaataaatattatctgtcatataccaagtactagtctaggcctgggaatatagcggttcacacacacacacacacacacacacacacacacacacacacacacctgccctt

SEQ ID NO: 124782 - DNA, 1633 bp, Homo sapiens
tgacggactaattggtacatacatcatatgtgaacacatttttgatatgatgtttgctttctgaaggggtccttaattattccctttccgtaacgaactaaaatttttgaatgggagcaatcacatatcattgtaagatgttctgcatttgacatagatgattatgttactgtatgtcgagtttgaattgtactcactttatgcctcttggtggtcatactttttcttttttttttcagtgctcactcagtacataaagcttgtatgggaaagaagtccttgtttcctgtctttgttggtatttgtaggttcctaatcttctaagagtcttgggatgtagatctgtacctcatgactagggttgggtagtttttatggtgaggaagaggggaaaagatagtattgaagcaattcctgtctaggtctgcaaagtgcagattgcatttctcttgcagtggtgttaggtatatggcccttttttgggaaagtgtttggagacctttatctttctctgttttgttgtggcagatggagttgtcctctggtatttttgctaggtatgataaatgttgtactaaaactgcttggtggaagtttattctggaaagattactgttcgtttcagtttcctgaagaaaatggaatcatagtattcaaaccattaagcaaacaagtccacaagcagaccagcaataataatgtgtacttctaattgatgcttgtgattcttattccttctttaaaacaaaggtttaggaataaaaaccaggattgattattagttttgtctaaaataaaacaaatggtagaaatagtcaaacatttttcttcataacttctagagagaaatatctagataatgaaggattgcccttattttataaaagaaaataaaagcaaagaagttatgtggttcttttatattccagaaataaaatgttcaattctcccattcatgtagcatagcaatctttagttttattctgattagtttgactaatagtatttttagataattgtgtacttctaatagcttttatgcagtctgtaatttatctacacttgtgttgaaagctgttagccaccacttacctactggatggaaataaatttttgattgattaaattctcccaacaaataaacttgttgctaaaaacaagtaggagattctaatcacattgcttggcatttagagacagagtttctttcttctttcttgggtgattcccactgcagatgtgctttgacacaactgggagtaaatttatagcctgaactgagtctgtggggtgattcgcaaacttttattatcctccatctcagctatttgccattaatattttcttatactaatacaggtaatcaaaatttgatcttggatctgaaacgccctcttcaaattcctttatattttattttctatcttataggtattctttccttcagtagttaggagcaaaataagatagcagcagcatctgcagtcttaagcccctctttttattggtgttggaggaaagtagtgaactatgatcaaaacagtaagtggtcttagtggtatctggagtccactcatgtctttgactatgattatggcatctgagatacaggatgcaaaggagtctggtttgg

SEQ ID NO: 124783 - DNA, 3192 bp, Homo sapiens
tccaaaaacctaagtccagctaagaatttatctgtgccaccaggtggcattgcatccaaacctgctaatgataaaaggattataaaatatattattttttgttaaagatataacgattttacttttgaagttgactgaaaactacatctgatatcaaggttaagtatctgcaaagaattgaaaagatttctaaactctaaatatttgtttttaggttgttgatattaaaacgaaagtaaatgaaaatgaaatatttggaggggattgctatttttcatttagtaaaataagcatttaacatttggcttttttttttttttttttttttttttttgcttgtctaaacactggagaggggaatccagcgtataaaaattctcacaaatatttcaaatccccgccccccaccatgtggcaagattccacccccctccctgggtcttgtaaaaaaaaaaaaaaaaaaagtgtcagcaggttttactgtatgggaatttttaaaaagagggagaaacctctgaaaggtgcaagttggtccttttcacaagcctaactatgagattcattaggcagttcatgttcatgtcttaaaagctgtttttgggaaagtaaattcttgagtttcctgtactgtttttcagggagtctttatagtcttttgaatcagctcattttaaaacagtgataatgtaaaaagcacaataaaaaaaggctcattataaattttataaaagtgtgatttttttcattaaaatacgtattcatgttctatttttatgaacccataaatataagttaataaactgtagcagaaacaattaaattacttaatacagctatccaggtgataggatatgttgtcagaataaataaagctcagtgtatattctattgatttttattcttttaaaaaatgtattcaccatgcagagtgatgtttaatgcttagctttgatcatttagcaaaaagcttagtgctactcattttatactcttgcctcttctgaggcttcttaatgtgcacaacctgttttaagaaatgtatatgttttcaaagtaaatgtttgacctcccaccttgatgttcccacttaaaagcaaaaccctcccctcccttatattttgaataacttgatgagaatgtgtgttgtactaaaactaaatatatgcacccttcagtattaccaaaagagaccttttggttttaaaaattaggaaatttcacttttgaaagtagtctagacaaaggtactcatgacatttgaccctgaaatttttacttttaaacttgatgcaacagtctgcttcttagctttgttgtatgctaatatttctacttatttaacatcaaaaagctgtagaggtttctctttatagattatgcctgtgttctggaattgcctcctgctgtccatgaattgcttcttggcttgttgtgttagaatttctcaccagggtcttttgtgagctatgtagccaacattaaaaaaaaaaaaatcaaatttgatagagtaaactggactagtaaaaattatacttactattcataattataattgaggtttcttggctcagcatatcaattttatgcagtaagagtaagcacatacaaatctcatgtaatgatatgcatacatatagttgcctacaatgactgtttttctagttatttctataatattaaaatgatttttttgctgaaattccagaaatctaaaaacattgaaaaataatgataatgagaaaaacaattcttacttgttagggtatatgttatttagtaatgaagcatttagattttggattctctcatttcagttggaaatagtattggtgtaagtgagtgttgccatgggaacctccacatagatataaaaggcaatactgtctaagtggaggaggaggggcgatgtactgaaataccactggcctaaatgatctattttatgtatgtgtgttggtgtgggggtgagagctaggatgaaaaggggagagaaagtactacagaaagtaaatgttagcagtcaaagcaatttactcacacttttggattcttttagatagaagtgttttaaagctcgaaatgtgattcttaattattggtatcatttgcacacactggggagtctttgcatatcttatttttaatgtacagtggaatatgtttaacttacttggttttagataaaatttaatttagtgaaatttgagagttaggatttcagtctttgaaatggctttatacatgttattaaagatgttatatttaattctttttaaatatctgaaatttagaaaaactgattaggacacagttaatgtggctttcaaagaaaagctggcattttggctttatagtatttttaatactagatttttagtaattttctataaatatataggcaaggaaacaatgacttactgtatctgcatgtgtaatattttatggttaaaaaaataaagaatgaaaacaacaaaacctaacataaaatctttttatatcccttaggagcacataaagattgtagagatagagatgattagagaacaaccaatttaactgcatgcaaagtaacatttttgttttttgtatgtttaggttacaaaaaaacaatgaaattgtgcccaacctgagttagcctggtaaaatgcagcagcatcatcattgcagttttaacactatggattctggttgtcagatacaaatataaaaaaaagaagagatattaactgacaaaaactgtttaaacttacctttttagtcaatccagagaaaaagctgccaaggtaataaaacatccagaagtttttaagttaaaacgagtaatttaaattaaaaggggtgagggggcatgagcaagcaagggagaagaaaaaaggggtgaaaacgacaggcactttgcttcctgggcctggctgtatctgatgtaaattaaccagcagtggggagtgtattgtttccaactccacataaacaatgctgggtatctctttgggaatgggtgggtgctgggatggatggaggttgttgagaagggaactggcaagcagagtttataatctattagtggattttttttggcatgcgaaacatagtaggaaagagtaaataatgagaaagtacgtttgcatgtaaaattgatcaagtgaaaccttaaaatgatgtgaaataattcataattgttagagaatgctt

SEQ ID NO: 124784 - DNA, 1663 bp, Homo sapiens
ggtttttctaaaaataaatgataattttgagaaaggaataagagcagcgacataattctgactttgagacctgtaatctttgatagcaaactttttttgtttttttttgagacaaagtcttggtctgctgcccaggctggagttcagtggcgtgatctcagctcacggcaacctccgtctcttgggttcagatgattctcctgcctcttcctcccatgtagctgggattataggcatgagctaccatgcccggctaattttttatatttttactagagacatggtttcaccgtgttggccaggctggcctcgaactcctgacctcaggtgatctgcccacctcggtctctcaaaagtgtcgggattataggtgtgagccatggcgcccagccgcagacttttaaatacagcatttagaaaggtttgatgacatcttatggtctttaattggactgaacttttacattcttattagtacacatataaaatcaacagcttttcatgattcggcatttacatcttaaatcctgcactttgctctgttaggaaatagagcaacactggatatttcaagctaataggaaaagtctacatttgatacagaaaagttaccttacgcaatattgaggagctagtgaacaagggttagggggtgggggtgccagagaccagagcatgcaagaatgagagagagattacattgtcctcttccattttagttggtagtttctactgaaaactgtaaagtttaactttttggaattgtaactatccaaagtgggaatgtaaactatattgaacaaaatttatttagcctgttaaaaagtcaacctaaaactatggttaattagtttatattattacatcacttttagtagagactcaacaatcagtgcagagtaagaggagctattatcaggtgagctgactgctacccatatggggctttaagataatgatgagtttaaatttcctcttagagctaagtgagaataaaactggaggcaataaatactcttggccaaagccattaaatgaaaaagctgggaattctccagctcttgacttaaattgtttgtttatcagctggcgcctagtctggagtcaagagctggagatttctatctgtgacagaactttgaaactcttgcaggacactttcatttcaacttaaggtaacttgagtttatagctttggctttaaagattactaatgatttactcatttccttaccatttaaccagagtggactttttcccaggaagggatctgtgtttatttagggcctttgtctgcggagggattaaaaggcagcccaccagcattgtgaacttgatggtcataaaaggtcaccaaaacacaccataaaaacattcttaccatggaattaattatacagtgtaattttacaaagcaacttggttactccatcttaccccctcccccatatttaaacatttcaacttttaaaaagtaaatctttggtataattttggtttatgaaaaaaatgttttatgatgtttaaatgctgaggaaattgtcatgtgcatatgtacagtttaattgcttaaaaatcttaaaatttttgaaatgaaaatgatcatttattgttaaactgtgggatgaataacttgtttgggaggaggttagagtagtcagaa

SEQ ID NO: 124785 - DNA, 1465 bp, Homo sapiens
attatgttagccatttacattttcccataattttacttatcactctgtatccataaagtatcctttctgtctctggagaatatctttagcctgggattttctacagtttgcacaagtagttcagaaatgtttggtaaataaattccaagggtttctttgaaattagtcctgaagaagaggtgcccataaaaatctctttttacattctttggcatgcctaagactgccttgcaacagttgtcatagacagtaattcatatataaggtgttaagttcttaacacattcaaagaagactggtgactcactgcccaagataacatggttgaggcagctccagcagtttgtcgcctaagaaaattacagaagaatgtgttagagaaggcaaggtgatcacttttacagtattttttattattgctctcattatttattgttagtaataattactattattgccaacaacaagctactttatttctaaaaatttacttttgcagtttgcaattcctttatctccagacctgaaggccaaattttaattgcactgtaatttccaatcaagtaaccatgacaccagctgttcttgccaggctctattctgtggtagagggggaacctgtgttctctttacatggttatgctggaaagtatatggataaggcaggggtcctgcctgaagtaatcccagggtatttttaatgtcctttaattgccattcaggatgtaagtcagacacaattgggtctggtcacagtttaggactactgagccctgtttatataaaggtgaatttagcaaataaatctgaagctattacttatgtacaatttatttttctttaacatctattgatttctaagcaatgtgaaactagttccagtatactctatgtattatatgtcttcattttgttttgtttgtgatccctggatagcattggcagtgaggtgggaggaggagatgtaattgagaatttgacaagggccttgctaccataatcaaactgaaaccttatcagacttatttgaagttttcaagaagtccgattttcttgaggtttgataatgttaacagatgaaaagtatatgacgttaagttttaagtctgtctttctatgtatttgccataaaattctgttttgcattgcttgggtgatgtagttgtgaacattttaaatttacatgcaaatttcatagtagtcatctttccttcaggtccaaggaaagtatggcagcagatatgccttctgtcttttgccttggagggattttgacctgacctgaaggtagaagattgttgtttttttgcatttagcttaggttacctacagggataggaaagatgtggatttcttttaaaagagtactaagaattttaacattagtatctgacatctttttgctttgagttattattgactgttagttttggttatcataattgtttatctactacagcctcta

SEQ ID NO: 124786 - DNA, 2364 bp, Homo sapiens
agtcaccttgatcccagctacttgggaggcagcagcaggagaatcgtttgaacccgggaggcagaggctgcagtgagccgacatcgagccattgcactcaagcctgggggacaagagcaagacttttctcaaaaaaaaaaagaaaaaaaaaaggaaaagaaaaagagaatgtaactttaaaaatcaaggtctgcatttctttcttcaacaaaatatcttgtacttgaaattatttatatagtccttataagattatctacttgtttctgattatacactttaatctcatcttctgtattatgctgacagcatcttcaccacaagggacttgccttattttccagttcatacaaagaaggcactagggataaggctttaaagatactcaaagtcctttgcctcttgaaacttatagaggaatagagagagttaacataaaaataatttcagtgataattgctatgaaggaaaaaaaaaaggaagagtaacagtttgggagatagaaagtattgagagtgctcttttggatagtggatgggatgccctttctggggaagtgatatttaagcagaaatttgaatgaaaaggtttagagaagagtgtttcactgaaaggagttgctctgtaagggctctgaggcattgaactagcttggtgtgttcatggaacatttatctttgtatcaccagacttagcagttgtttcactcagagtttgttcaattgaataacctgtacctgactccccgtatgtctaataccatgcctttgtttattagtttgttgtttccaaagtaaagtgaactgggctttatataaattagcccatgacacaggtctcataagtatgatgccctattaacttgtgcaaatcacatttttatgaaagttgtaatccttatttaatgtctcatgttgtttagtcatgccattttggatacatacacgtgtgtgggtgggtgggtgtgtgtgtgtgcgcgcacacacgcagtgggtctgctaccacagtgttggttccaacttgatcagctctcgtctataatgaatgctagacatacagcaaattaaaactaaattaaaaactattgctagtgactaatgaccaaatactgttcagtctgctcccagggcatcattatagctgtgcttgaataattgaagaataaactcactgattgcctaatacatctgtagatttgcccagagaccttaagttgaagtgactctgaagtggcgcttgtagttagccccaggcactgcatgttggcacgcctcattgatttgctaaactgtattgttctaggtaggaattaatgtcaaaattaaataattgaacttgtgtgtatgtgtttgtataacagttccataccagaaaaccaaattttatactctacttggctgagttaagttttagtaatttgtttgaggcattcttagaataagcacaaaacctattaagaaatttctcttagagaggtaggcttgcttggtaaatctcagtgagtttcatatagacttcattattgtttttaaaatcaaccatgcaggcttggcccttactgctcactgaactggatacctactgtttttccactagatctgtatctaatttatggtaaaaggaccacaaaaaattatttctattttggcacctaacactattatagttaagggtcttttggcatttccattaaaacgttttcttagagaagtttataacttggcagttttacttggctttgggctgaaacattgctgtttttgtccaaaagcaaattcttccatcaaatttcatataactgaaattgccttggtttataatgtgtggagggggaagggctatcagaataggtctttttttgatactctcacaagtgcttcgattatacagtagtcttgtatgtgatatttattcttatgttttattcttacctcagtaagaatttatttttgttacacacaatgaataagttctggagagctgttgtataacatagtgcctgtagttaacaatatcgtgttgagtattaaaaatttgttaagaaggtagataccaggataggtgttcttaccacaaagcaaccaccaccaccacatttggggcatgaggaaacttttggaggtgatggaaatgtttattaccttgaatgtggtggtggttttatgggtatttgcatatgtccaaactcaccaaattgtatactttaaatatgtgcagtatatcaattatacctcaataaggctgtttaagaaaatttttaaaaatgatttgaaatattttggtaaaataattcatctccatgggttcctgtctttaaagagttatagtactattatgtattttaaagttacttttggccaggcg

SEQ ID NO: 124787 - DNA, 1852 bp, Homo sapiens
tcttgtctcactggaaaggtcttcaggggcaattaacaggcatggagccataatgtcttaagataacaatgctttcttctggaatacctcctgaaggacctgcctggggtttttttatagcttacttttctttatcaatagaaggattatactctatttactctaaaaatatagtaaatccataaactagtagcggagttgttttattttcattagcaagtattatgtgctgtacataattgttgtgtgctacacttttatttgactagcagtgcagtaggtttgtttataccagcatcaccacaaacatgaataatgcattgtgctgtgacattactaggtgactggaatttttcagttccgtgatgatctcatgggaccagtgttgtatatgcagcctgtcattgactgaaatgtcattatgcagtgcatggcggtagtatgtctagctgttaaacgtctcttgtgctcctagacttcagttttattattagaaaggaccttactaataatttaatttaactctattaacattttatagatggaaaaatcgaggttcaaagaggataagtgacttgcccagggttctctaggttgttagcaactctaggactagaatcagttttccagctaaatctaatgttcttcccacactatgtcacaccttcctcccttcagtctcgttccttggtggcctcctgtcttcttcatagcagtcatagttatcagaagggattctcataactccatttgtatccattttatttaccccggcaactgcttccctatctcctatgttgctagctgataggcactggcatgtagtaaaaacagggaatcgccatatttcctagtcctcagaggctattttataatcttaacatttctgttaagattagaggcttaacatttctgttttagattcacacgagaagaatcattgagaagccactattcttgaatctggagaactcaggagagatcagatcagtcctattaggttaggtccatcctggaatgtttgttaactggctctaaggggcatttgttctgtggatggattgggatggaaccagtttttggggtctttcctgattgagatccacctgactagtgctgtttcatcaaataagcctccagagaaagaaaagtaaagtgataccttgacatatctttaacatgttttagtttaatgggataagatctgtttttagatataaggatttgtgaattgaacagaattatagttgaaagcaaagggatgagaggatttttatatagcaacaatgatagtatgaaatccatgctattgcaaggacaactgtgttatgcttatgtttgtgcctgtctcttctactagactgaagagggcagacaccatgtcttatttaattttatatctccaatgtatatctccttgtagacaataaagtatggttggttgaatcaagaatcttttcttctttaaaattcaagactgatgttaaatattttgagccttcttgcggttattcatctttctgaagctgtcctccaggttatctccagattatttacctctctgtgaagtgtaagctaactgcctctacattttgttatcagtcaggtagcaggcatatactatgtttaaaatgttgtattgtaatattaggtgccattgtggcgagtgtgattatgatcaatttagtggggatgagataagagagaaatactcagaacaacttaaagaggaagttcttacattaaaagtttagaatttagaaaaacatactaatacttgcaaatagttacagaagtatttaacaagcagaaatggaactcctcattaccagtttaatctctaacagcattc

SEQ ID NO: 124788 - DNA, 1023 bp, Homo sapiens
tgtcaaactgtacatcttttttttttttttttttttttctgagacggagtctcactgtgtcacccaggctggagtgcagtggtgcaatcttggctcactgcaacctctgcctcccagggtcaagcagttctccctgcctcagcctcccgagtagctgagattacaggcgcctgccaccacacctggctaatttttgtatttttagtagagacagggtttcaccatgttggccagtttggtcttgaactcctgaccttaggtgttctgccctccttagcctcccaaagtgctgggaatacaggcgtgagccaccatgcctggccttaaagtgtacatctttatcagagcccacatcacgctatatttataggctatgattctcttcctcttgagtttaagcttttttagtgcagggagtaagtttttttccccaatttttaaaattaaatattgaatatatgtgcaacatatttataaaatatatgtgcggtataaagtgtaagtatacattgaactaatacgtaccccctactcagtttaagaactagagccttgctatttattacctttgaagttcttgtttccctgatcctattttcttttctctctgatgagaggtaaccagcatcctgaattttatgtctcattcccatgcttttttttttaagtttaactccatatgtttttatttctaaacagtagtttattttccacctttggaacattatagaaatgttccataatgagcatattctgtgacttgctttttcactttacactgtatttctgagtttcaaccctggtgttactagagccactggcttacttggtacctgtgtgagaattagaaagggcacctctctataccaaaatagcccttcaggtgagcagaacgaacctttgtataaagaaaaaggtatgcctttctgtagacacgtgtagccttatgtcagggtttgcggtttgacacattgaatgtagattaaatgtcagcccctgctcacccatttggctagatgccca

SEQ ID NO: 124789 - DNA, 3635 bp, Homo sapiens
aaaaaagttatgtcctgtgggttagtacgtttgtagtaagaactttgggaagttggaattaaaggttagcagtagctctttaacccatttatgtcagaggttgcaaatttttttgtgaaaaatcagaccttggcaatgaccttgagtagtaggatgtactgcttgagcagtaggatgtaaataactcccacaaacttagcataaatggaacactaggcataaatgggttaagtaaaatacagtttaggtcagtttcctaatcagtgcctgtcttccctggctctgagaaaccttttggttaattgctgcttattgccaaacccttgcggttatgttaggatgatagtgattgaattcccagcttagttttgtcatgtcactgtttctattcctaacttattttgttgttgaatttcagcaaagagctagagcaaactggtagacactgtagtcacaagaagggctaaaagaaagggtgtaatttcaggaaactgtaatatgtgaaatttgaagtttctggtaattgaattgtgttggaaaactaaccaacttggaaggaagcaaaagacacttggatattaggcagaaaactgataagataaatgtttagatttcagggaaggttaaaagacactcattttggatggagctctcagggccacagtgtgtgtggtccagaggcatcctagctgtcctgttacctagcctgttacagttatggtcctgctttacctctgaaagaaaagttactaaaaacttctgaggagacatagccctacatttgttaatatcctttgctaaggaatatggtgactagctatcagaacagtttggtccagggagtgtttttaaaaagtttgactttacattgaactataatttgcttcttatgggtgattctttatttttttctgggtgaggatcatttccatacacccagtgcatgtataatttttgggatgattttccatttgttgaaaggtttaagatcttaaaatattaagatcacagattgataaacttaattcttattcttttaggctaaagagaaacctacatactcttggagtatgctatttctcttctgtgaaatatacccaacaattgcatttgaattgtaacaattcatatgtctaaaattgttgtttaaacaatttttaatatgtatatttttcttttctttttattttagacgaggtcttgctatgttgcctagtctggtctccaacctgtggcctcaagtgatccttctgccttggcctcctagagtgctggggttacagccttaagccaccatgcctggttatgtttaaaccattttgtgtgctatttttttaatagaaagatttttccttttaatagtttttatcaatgatttttctgttttcttcttcagtatttatatttattcagttttaattttcttatcatgattccatgccctctgggttagtatatctatagtaagaactttggaaagtttggccaggcacagtagctcacacctgtaatcccaccactttgggagactgaggcaggatgattggttgagcccaggagttcaagatcagcctggacaacatggtgagatcccatctctgtaaatataaaatttaaaacttagacgggtatggtggcatgcacctgtggtcgcagctacttgggaggctgaggtgggagactctgtcttaaagaactttggaaagtttgaattaaaggttagccataccctttaaataaattataatttaggttagagtttcctagctagtgaagatagacactgccttatagtgtatatatataagttaccctaaaaagccaaaaagactgtgagatttccagattctttcatatattttcctttctacctgcttgatattttattttgtcattaaagttacaattataaaataatatgccatcccaacacaaatggctagattttaattgcttatgtttattcttcattgtggaaataacacggatatatgaaatttgcagtatggcttgttaaagacaaataaattactttttaaagatccagctactttacagacaaaaatttaagtcctatctaatacccttttaaagttaataggtgttttaaattgcttacatcttagcttcatgtttattattatggttagtgtgtagttcatctgaaatcagaatttataccatgtagtatattaggttttattaggttttttttggatcttttgaaagagtttgggtttacttttgaagtacaattggtctcaaaaagaatgagatttttaaacgtgttctaattaataatgtttttaatactaaactaaaatcctccttgatatatggcagcttttcagcagattctaattctgtaggtagttgcatgaaatttttactcagagttgtaaactacaaatatttttatttatttacttagaaaagtgaagaagggctcattattaatagattccagcactattgatcctgcagtttcaaaagaattggccaaagaagttgagaaaatgggagcagttttcatggatgcccctgtttctggtggtaagtggtagctaaaatatatgcaaacctatttatgtttgtcaaaagtagcaattatggttttgttgtaccatatggttttgtagtagttatttttagacttgttacaggattctcattaaaaataaagccaaactgatacgttatttagtactctcaagtctaaataactaacattgttagtcttaaattcagataaaaaagtgtcataactttgaagtgttgtgaatttttggtccatttactgtggataggaatacatcagtttttagaaaattttttttggaactattgaaaaaaaaatcagcttaaataatcctgtaactgttaaagaaattgaacaagtgggaaaaaaagaaaaacaattgtttcacaagggaagcattggctcagatcattttacagatgaatattaccaaaatttcaaggagcagatcatctaaattttatacgaacttttccagagaacaggaaaagaggaaatacttcccaattcattctgtaagacctttataactctgatatttacaccagatagaaatgttataaaagagaaaaaataaatataggtttattttagtcatgaatgtagatgtaaaaactttatattagcaaactgaatccaaccatgtatgaatgagattaaacactataaccaagtttcctttagcccatgtatgctgagatggcttaattttagaaaatctgtgcatataatttaccatgttaacatggttaaaagtcatatgattgtctcaattagaagaaaagacccactaatgaaatgctaaaaatttactattaactcatacattaatagcaggtatctgggtagtttggaatggcaggattatagtatggcttctctgtaatttccaagttttccaaaattactgtgtaatcagaattactgtgtacacatttatattatgtatttgtagcagtatagcagtagacagcagaatatgaattttattccagttacattaaacttgattgtgggctttagaattaaaaagtaacatataataatttaaatcatttcgtatttttttataaagaacttaatgatcttgtagagg

SEQ ID NO: 124790 - DNA, 1032 bp, Homo sapiens
gaagctggagatgttacatagtttacacaaaatcacccatgacttcttggctgagctgcaacttaacccgggtctctggcttcccaaattagtgttcctttcactgatccatgctgtctttgcttatccattcaattagcaaatgtaattgaaggactctaattagtttggcttctaaaggcttttgtagttgatgtcagactggcaacaaggttggtttgtttttcctcccagcttttgagttgtggccagattttgtcagtcaattatttcagggtcttgaagtcatcacatggatggtgagattgtttgaatgtctgtttatctgtctgataaacatgcctttgtagtacaaattagagactgttaggatgtaccaaatacacacacacacacacacacacacatgcacagagagagagagaaagagagagagtgtgtgttattaggtatagagcagttgtggccagtacagtggtgacattccagctatcactactgttgtgtatttcttccgggcctgtgagctttgatactactttcctatacaattgaggggttagcagtattctggcaatgcaaccatctcaagaagcagatgctagggatgcagggggctgattggccaccccatgcacttggcaagtgcccgaattggcactgccagtttatgggattaagaaacttggagctgtgaaacatccttagacctgtgagctaattgttggtgcccttcagggcccctctaaaggagttatgtagatggaatttaatttctttcagtgggagagaactcaattcctaagagagagttgaaattaactcttagacctcaggtcttactgatgtcccttaaaggtctggaaggatggagctgcaatagaaggaaagtatgccattgttttgcattgtgtttattagagtaggatgaacaaatgggactaagtaacatatatttggtatagtataggagtagagaagtatgactactacaactttttttttcttatttcactgagctctatttttctt

SEQ ID NO: 124791 - DNA, 1062 bp, Homo sapiens
gtgtgtgtatgtgacatctgtgttgatgattctgaaatgtagctacctgttaacctatttataaactagattgctggaaaataaggtgcctagatcagtcaagccactgatcattggtctcccttgccttctcttgtgtggttctgtacccacggagttacaatttaataatatttatctattgtatgggttgtttagtgggttgaatagtggcccacctccccaacccccaaagatgtcctataaaattgttaggagaaaacacagaggtaaatctttatgactttggatttggcgaaggattcttagatatgacaccaagagcatgagcaacaaaatgataaataggtaaattggactttatcaaaattaaaaacttgtgctccagagaacaccatcaataaagtgaaaaacaattcacagaatgggataaaatatttgcaaatcatatatctgataaggaatttgtatctagaatatatgaagaagtcttacaacgccagcataagacaagtaactcaattaaatgggcaaaggattttaatagacatttctcccaggaagatatatgaatgacccagtaaacatgtgaaaagatgctcaacatcattaggcatcgtagaaacatagtcagaacagccgggtgaggtggcttatgcctgtaatcccaacagtttgggaggccgaggcaggtggatcacttgaggtcaggagttcaagaccagcctggccaacatggtgaaaccctgtctttactaaaaatgcaaaaaaaattagccaagtgtggtggtgtgcacctgtaataccagctactcaggaggctgaggtgggagaattgcttgaacccaggaggtggaggttgcagtgagccgagattgccaccactgcactccagcctgggcgacagagtaagactctgtctcaaaaaaaaaaaaaaaaaaaaaaaaaaatcaaaaccatgagacacacccactagaatctagattaaaaagttagataacaatgtgtttgtgaggttgtagaaaagttggagccctcatacactgctagtggaaatgtaaa

SEQ ID NO: 124792 - DNA, 1652 bp, Homo sapiens
gagttatagtggatctctagtgtttttaggctatcattcatgtttaaagaattttggtaccagagtttatcatgttggatgataacatctgctggttaagtcttgagttgtttggatttgttaaactttatcaataactcaaattacaggagaccatgtatcagtatccgaatatagtttgttttttctagatatgagggaaattcttcttggtcaagttgtagagtggtaactgaggatagtgtgtgatcccagaacagagaatactaaaaaattcctgagaaaaaggtgagaaaaaaattacacagccagcttctagataatagacttgaaagtaaatactgaaaaatgctatacctagttacagaacagctttaggtaacttagaagccattttcagaactatatatctgaatctttttcctttccatggtttttgtgccatatggaaattgcagcagtatagtgtgaggatggaagtatgactttggaacttttcagggtagtgttgtggctgcttctgcctgttcagtctctgaatacggatattacactcccagtatagcaggcttacaggcttaattaatgtagggacttagtagccttgttggagagatttgatcagtcgtatagtagagaatctgggaaaggcggccttttaccatcttcagagatggtgagcatttcaagttgatattcagtctgagatgaaccaattagtagttattttgaggagacagttattactttttgggataacacatctatttggtattgccattttacagtggtttatctgttagtaagagtaacaagggtacttgatctctaaacagaggaaatatcttcaattaaaaacagaatttaaccaaagagtggggtaggaattgaatggggactattaccctagactggcaaagcagaagcttgtgaccttttacgttgttacagacacaggtactcttccctctatgcctgtagtacttccagcttgtatgtggaacgactgtaatgatcatcactgctttgtgactctctcctgctttttcccagaattctagagctttctgatgctctgcctgaattacctcatactctgaagttaccaggcttacctctgtttcccaacaagtttcttatttctttagtgttgctaattttaggtaggtatgaaggaaggctgccttaagaataaggcttatccctgcatgaaggagatatttatgttttgaaagggagagaaaagaatctaatacagtatttagtgagcacctactatgtgtcaggtcttttgctaaatattttgtatgtattatctcattttatctttgcaacagaagtgctatcaagaagccaatgcttggagaagctaaataatatccctaatgttatatagtggttcttattatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgat

SEQ ID NO: 124793 - DNA, 1061 bp, Homo sapiens
tattaggtgttttataaatgataacattatttagtttattgttaaaaatggtaaaagaatgttatacaggtacaaaacaggaaaaatgcttaaaattttgtgaatgtgccccagaaaactaaataattagaagttagtctgcctgcacattgttgataactttaaatgtggttaggtccattagtttaaaatttgccttttaaaagttagtgggttttttttttaataaatattattatttatttttgagatgggatctcactgtgttgcctaggctgttctaaaactcctgggctcgagcagtcctcctacctcagcctcccaagtagctgggattataggtgtgcaccactgcacctggttcctgaaagtttcttttattaaaaaaaaaaaatctaacaattgacttgctaatattaaatgaatgtttacaataaaaaatgttatttgcccctattgaaaataatgtattgaaatcagtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtaagaccttttctttagatttgttttagattttgagaatgaaaaatgaatatacattcaaataagtgacagcttcttagaagtatacccaatggagttgtaaacctaattcagtgttaattttatatatatgtaatcattcatccaacatccagatttgcagtaaaggagagttctcgttagacattcaggggtatctattctttggcaggtgacttggaacattttgcacatttggtcagagggccttgttttagctctgtatcagttttctgagatagtaactttactgattgtgctgttaaagtagttagtttggtggaaataacctcctgtgttattaaaagcacatatgtctttaaaacaagagtaggcttagagatataaagcttagtttgagttgaagctcagatacatgct

SEQ ID NO: 124794 - DNA, 1001 bp, Homo sapiens
gtgtttgttgaatttgtgaatgaattgtggttctacgtgaccatacttatgaattgtttgacctagagtgaattgcctgttaaattaactgtctttaaattataatcttcctagttgctgaagtttttagattgctaaattacaccttttcaaccttaacacagtaatgccacattttctttctggctattattgctagtttgtttatgagcattagttagagttctctgatgaagtgtactcattctgtttaatatcaaaataaaatttcagtttggtgtcacttttctgtcattgaattccttgcaggccagaaagacaaactataccagtgtactattataccagtgtactattataccagtgtattaaacttagcgcctgttaaatgatgttgcacagaaatgacacccacatttaatggaagtgttagagtcagtcattaagttaaaggaattaaatatgcttccaacccaagaagacctctagttcttaagcattagggcttcaaataatttgcttttaacaaatctcattccattcagattcagttcagggaagagcagattaagttcagttgaggggacctgaaacttaaaagagggactgtgattagttgttgcactacaaattttaaagctggagttcttgaaagaaaaaagaaaaagaatgctgggaaatggaagagcaaggagagttacttctctcttttccctcactagactgtgagcttttaaaggacagggaccatacgttgcttgtgtctgtctctgagctctgtcatagtacttcatgcagtgaatatttattgagtggagttctaaatctagaaagtgaaaaattgcatctaacgctatttccatagtactgtaaagcctccccactctgtaacgcattactttgattcatatgcccacggagtaatttcaaaaagtcttatatgaaaaataaaagaataaataaaacctgtgtagtttttaaggcttttttttttttttttt

SEQ ID NO: 124795 - DNA, 2425 bp, Homo sapiens
atttttgcattttgacacttagtgaaacctgctttttgatagcacttaaggttatcaagatacggataactccccttgttacattggagaaagaggtcataatcggtaaatttgcatctataaatttagaaacaaactttgccaagttttctggctagtttcttttcattcgtcctcagtaatagacactaatgctagtttcttaaccagtgaaccagtatcacctttgtatttggttgattgattttctcccagcttggttttatttatgttttaactctactttttccacgcactactgtcagaagttatttaaagagagatgcattatttaggtttgagagtttttagggcaataatcattccattatactcatggatttctgcccctttgggtgcaaattattttatatttgccaagcgcttattcaggtgtttcaccttaactaaaagctttctttccccagatacagggcttctcctacagtcatctatacttttttctatctctttggctcttgtaacccactaggcaaaaaggggcagttggcataggacttgacctgtactgctacaacttgaccatttttggtaagagtaactaatacttattatcaatcgtgtgccaggcactgtttaacgctttatatgcatcatctcaagtaatctttacaataatcttctgaagtaggtacttttattgatcaaatgttgtctagagaagttaagtaacttgtaacttcaatggtatacatctaagaagtgaacttatcaggataggaacctaggccttcccaactcagagaaaattttaaacattatcaccatcaatagataacttattctcttttgacatcaggtcatctaattatactggcctttctttaactttgccacagagaaagatgaaataaagagagctgagtcctttgaaaactttatcttcattcacattcatgttggcccatccaacatggcctcattgttcttaacttcttcagcttcagtaacatcagcactctacttcagtttttctaggatcttagtagtaggagtgattctcttgctgagatttcaccagcagaactagtctctggttgatttaacctcctctgtgattcttgttctaacaaacatactgttacataatgctcatcacctggtcctttgactccctcccttttcctccaagtacatagacatgctttcttgtttcctcatttcataaggtctctctctaggtttgtctgtacccattctcaaacttatttataattaggaatttcactgatgcctaatactgtttttttcagcctcttgttgtatttctggataaatccattgttgtggtctgtttgtgcctttccccagctgtcacttagcttggtgatatggagagtcacagaagtttgctgattagatacaatgctttcattaatctcttgtttattccccattacattttcagattttccacagcatttccagaactttaacttagggctggcagctcctgaaccagtcatttggcagaaggatgccattaccatgtattagtttagacagtttgaaacttgacctcggatctacgggaaagaatattggagagtcaacctgcaatgtgtaatggttgctgtgacactgtttacctttacacagtccacttttatcagcagcattactttgtaattgctttagaactggcttttattcccatatgcccatttgatgaaacttacctagtttattattcattcacatagcatatattaaatttcactgtgccacttcatttatttcattttattataaaagtagttacaaaagttacatgctcatggtaaaaaatgggaaaggttataaaattaaaagtaaaattttcttcaactccgacccagtagtccaactctccaggtgtaagtactgtttcgtgtgtatccatacagaaaatcagaaaaattaatgcatatgtatcattttttcttctcttatactgtatcctatagataatgctcagcattttttttccacttaataacttatcctggagattttttcctataattttagataaatgtcacctttttttaaacatttgcacatttcattgtgttgatttactgtgaattatcaagtgtcctacaatgtacatttagttatgaattaagtgccctattaatatataattagttatgaatgaagtgccttattaatacatagttatttgcagttttttggctgttacaagtagtgctgtaataaactatatctttgtgttgttcagaatttaatacatagtagggattgctatggcccatagttgggcaccttgtttgtaaataaaattgtattggaacacagccatacccatttgtttgtatgttgtctatggctgctttcaaactagagtagatgaatgaaatgg

SEQ ID NO: 124796 - DNA, 1055 bp, Homo sapiens
tacttgtttcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggtaagaaagctttctgaatatgttctccatgtaaacacttaaaattttcttttaaaacagattgataagtagcttttacttgccttaactctgcattaagactcatttttgtaaacatcaccatgaaatatttaacagtggggagtagataaaatggatgttgggaactccatttcaccagattttcctctccctgatcagaaagtttaccttcacttaaggacttgtgaaaattttttcagaatcttcttttcctattttctccattcattacctgcaataaaaaaagatctttttctttgggttcttatattatttaccattttttccagtcatttgaaattaattttatacagcttgacagccatgttattatcccttctactgtcctgcatggcttaaatattgctcagattgtattacacagttttaagagtattctgtttgtattacacagttttaaagtattctgtttaacatgactgaatagtaaactctttgatggcaggagttctagttcttatattttaccagtgattttgtataatactttcttgaaaatgaaggtgatcattacagtggtacacctcactgtgcaggactttttctggcaattttaactcttcaaaatgtagtggaaaaccaaaacataagaatgtcctctgagcagtcaaaataatgtcacgaatgtccaaacagtaaaacacattcacttttctcctgtgttattctgtagtcttcctcagaatcagtttgttttattttagttaagatttttatgggcttgaaattttgattgtctaatctgtataaagttaaacaacaaggaagaaagaaatgaatagctgctagaaattaggcacattgaaagtgt

SEQ ID NO: 124797 - DNA, 1040 bp, Homo sapiens
tgatacccagcctgcatcattagcaactctgttgctaattttgaataatcagatctttcacttaaccaaacagccggagtaaaagttatgtgaatgtggtttctctcactctcaaaatattaaaatatcttattgtactatactcacttattttggggtcttggttgaccttaggtaactaaaaccacacaaagtgaaaccttagataaaggatgactactgtagtaatgttaaaggtccatgagtttttgttttttaaactttagagtcttagaattctcacatctctgagatactgttctaattggaattctcacatctccgagatacttttctagttgaggaaactggaagtgcaaagtggtcatgtgacatgttcaaagtcacattgctaatgcataacatgtcctatactagacaaacaaaacctccctgtaaggtactgttttcactgcatcctgctgtcaagcacatcaaaaactaagttgcctgattagaaggtggatccaaacagtgattttatgcttgaatatcctgtttcaagcttttgtttctttgttccttgtttttccttttcaaatttttttcctccttcttctcttttcctgccttggtctccccttcagtcctgtctcattccactcattttctgtttttaaaaaaagtcctctggttgtaaaaaaaaattacaattataatatatataatatataaatatttataattatacttatttataattataaaattaaaatgtcctacagtcccactacccaagtatatccctacctaattaatatcaatggttagcactgttaatgttttaagtatttccttccagccttgttttattaatggaaggagactttcagtcttttttgttttttgttttcgtttttgttttttgagacagtctcgctctatcgccgaggctggagtgcagtggtgcgatcttggctcgctgcaacctctgcctcctgggttcacgccattctcctgcctcagcctcctgagtagctgggactacaggcacccgccac

SEQ ID NO: 124798 - DNA, 1050 bp, Homo sapiens
taatctgagttttttgctttatagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaaggttagttgtgtcttatgtaactgattgaagttgatagtatattgcctgaaacccacctttttaaagagctgaaccaattaagtaagtgaaaaccaggtactgagaaaagtagccttttagatagacgtttatacaagaacaggtcagttcctattaaccttctgccacagctgcttttatgtttgtaagatggttaaaatacttttagacttttggtaccaggcttgttgaggtagtccctgacaactatttccagatgttttacatctaattgtagaatacttgattttttttgtttagaaatacaattagaaatgataaacgctgaataaaggaaaaatgggatacataaattaaaattacttttcaaaaaagcataatttggtgaaataagatgtagtattagacaaaattttgaaatttttaatgggtgaaatgctatgttatcctaagaaacaaactagttaaaattggcagaatttcttgagctaagaaaaagagagacaggtacaatgaagcagaaaacattgtggcttcattagtgatagaaatagacttgtaagaagccaaaaacagtgaaaaaacagttatctagtcattgacttgtttatttaatattttcacaagaaaagcagtttgttctgaaacttacacagactgtgatcttatatattacagtctcatgtacagtagagccggttgggcatatttatgcccatttacagtattgagctattgtttcctgagggtggggtctgttctgttatccttttgtccaacaaggcctccagcaattgcttaataattgctaaatgaaccgctagtgcagtgattctcaaacatttgtatactccagtggagtggtta

SEQ ID NO: 124799 - DNA, 1032 bp, Homo sapiens
tcttgtcgtgccagatttgaatatgccaaataacataatttgtttccccaaaagaacaaccaaatctatttgcatttttaaagagaacctgaaaccattaaatcaaaggaaaagactttagagatcaggtgatgttgttagggcttagaataatctctctggaaaataaaaaagcttagaaaagctgtgttctgctcctgcatgcttaactagtcatttggcagaacctgggtctcctaaatcctagtctagtatgtctttccttcctttcgttgtctttgggttagaaatataatggtattttaaactttgactaacttaggtcatggagttagaatattcttgacattttcaaacaccattacaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagtaagtacttttgctatatatatttgaagattgtaaaacatacctatgaaatgtatgcaatatgattttcatttttaattcccccaagcttttgttctaaaaaagttcaaacttacaaaacagttggaagaacagaacaatgaatactgatgtaccctaaaatattttgccattctttgttttatctccctcatttatatgcctttttttctgagcgatgtgagttgcaagtattacgataatttactctaaatactttagcatgtctcccttatgaacaagtgcattcttcttcatagccatgacaccgttattacacctaagaatttagcactgattgaataacagtcattctcatagttagttcacaatcacattgccccaaatgtattcttatataatctttaaaattttgtgattcacagttagtcaaagactacatattattttgattgttgtattttgagtcggtttcagtc

SEQ ID NO: 124800 - DNA, 1040 bp, Homo sapiens
gttttttaaatgaaccttagtcctaagaatgtaaaactggacttaacaagagaccctatgttgctctgtagccaaaatcccaaaataaaaaagtggccggggacagttgctcacacctataacctcagcactttggggggctgaggtgggaagatcgcttgatcccaggaattcaagaccagcccgggcaacatagtgagacctcatctctacaaaaattttcaaaaattacccaggtgtggtggtgtgcagctgtagtcccagctagtccaaaggctgagacaagaggattgcttgagccaggaggtcaaggctgcagtgagccataattgggccactgtgtttcagcctgggtgacagagcaagactctgtctcaaaaacaaaaaaaagaaaaaaagtaagattgaagttggggttactattaacattaggaggtatcagatttttatttttttcttcaaatgtttgtttctttctaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagtaagtatcattaaatttacacatagtaaaatgtgttgttagtatttttgttcgaaaatcaaatttgtaatattccaaatatcaaccttttaaatattatttatctctgcttgatttcaagtcattggccaaatattgtaataactcttctttaaaaaagtctggaattttaatttactggacagccaacaaaggaagcaagggcagtagcaaggaaaaaacagaaaaaagtcttcttttctagataatttccctcttaagttcttgataaatatctgtcactcaaaactcaatacttattattgactcttgtgaccatgacatctatcctcattggagttcaccattaatcatccctaggtcttagatggtgtctcagttgtaattggcaagttcttcatactcatattatg

SEQ ID NO: 124801 - DNA, 1045 bp, Homo sapiens
tactattataatagcaaagatttttacatcttaaagtgactagacttgcatagtggaaaagggaatgttaaccaaatgaattgtctcttacggtgtttattttgattattattattttattttatttttttttttgatacggagtctcactctctcgctcaggctggattgcagtggcgtgatctcagctcactgcaatctccgcctcctgggttcatgccattctcctgcctcagcctcccaagtagctgagactacaggcgcctgccaccacacccagctaattttttgtatttttagtagaggcggggtttcacgatgttagctaggatggtctctatctcctgacctcgtgatccactcgcctcggcctgtcaaagtgctgggattacaggcatgagccaccgcgcccggcctattttgattattttaaacagcttcattcagacttttctggtttgcagccttcttggtgtagtattcagtactggaatatttaaaggaaaagggaaaatgcttctcatttatatcaatttggcatagagaggaaaaagtgttgtttgtgcaagtgatttttgtttgtttttttaaatgtgctttgtgtgtttttgtgtgcattggggaggggaggggcattttttagagctatagaataaaatttacacattagcttcatgttactgtaatttaatttacagtaattatttaaaatattttgttgcttataaatagcaaaatcttttaaccaaagttaaaatgaatttttttttttgcttgagagaatcctgtggaagggttgattagaacagttttactcttgaattcagggtagttttttgtaagagtgaactacattttcgttaaagatgaaacaattctggatgaatatttcaagatttttctatagaaatagtattgaaaggaagatagaataatgttcaagcaaaaaccttcctcagggtgcttttttttttttttaaacaaccatattgaggtataattgaaatccaatgaattgcacgtacctagagtatacagttggatc

SEQ ID NO: 124802 - DNA, 1919 bp, Homo sapiens
attgcaccccagcctgggtgaagctctgtctcaaaaaaaaagactttttattcatacctaagttgtaagagattcacagtttaccctacattaactcaatgagaatgatgtactttcttggcacaaataaatttgaaaatacatcggctttatcctgctttctgattttgttatatgtggaggatacatttatgagaagttgagagccagcttttctaactgtgtttccaattgcattccaacttcataataggaaataattttattgttatattttgactaaatgtttaatactgctgtatttatgaaatattttattgctttgcttattcatctttgtttttgttaattttaggaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagaggttattacagtatttttggtttgggattagctgcatctggagatttttttatggtttatattttcatggattagcaaactgctggtataatcaaccctaatacaaacattattttatttgtataattagcagttttaatatttaacactgtaactggcttcatctagaagtgatgcaccatgagatgagtactttatttacttattgcatatagttcacaatttaaaaaatcacctgggttaaaaataaaaacatctatttttttcacatgccaaagtggttctttatatcctgttcatcatatctgtatatacagatgttagttgtagtaaccagtttcactctacctttccaaaaattttattacagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagtaaattgaattttcattgtgtgagcctgtcccttttttattttttagcttatgtagagagttaagggtatgtgtgcatatgtgtatctttgtgcgtgcatgcgtgtgtgtggaaggagagtgtgtgcttgtgcctgcacacaattgcctacttgattttttgaaaactgtgcttgtatttaaatttgaaaaatctaccagtatgcttcagacttatactttaggatttatatactaaagtaaaagattaagtttagagaataatctcagaatattgtagttatcagatagtttaatcttaaacatcactaagtaacttactatattcttttgattatagatgttaggcttgaagcagcaaagtgttaatggcagtgttatgcttcagtgtacatcttttctttatagcatttatatcccactttagattttagtgtggactcttcattatcttcagccagaaaaagagaaaagtgtatgtatcatatagtggttttcttttttggagaaatactatttgagatgtctttagtatttaggtaggatttcttattctctggcagcaacacaatactgatgataattgaattagtttgtatagcatgtcattatttttgtaaattttatttaagagattccttcaatatttaatgaataggtttgtttccttacagcagctctttttggatagataatatgttcttttcttcatagtagctctttttggatttcctgtgcattaagatgaatttaaaagaaatgctttatcgtgctctttgcaagtacagtggtatcatgacctgtttcttatttaatctagtttgctgcatttaattgctattaacctttgcagaaactgatcagtgttcagaca

SEQ ID NO: 124803 - DNA, 1039 bp, Homo sapiens
agacagattaaatagcatgccccaaatcacttagctgctgtgggtagagacaggattgaatctcatgagattggctatagaagttgtggtcttagccacctgtcaaatggactaaaccagaggttttcatactttcttagttctagtaacccctaggccaaaagaaatacagtaagtcctcacttaatgtcatatataataagttactggaaattgtgactttaaacgaaatgatgtgtaacaaaaccagttttttccctcatcaacgttgtaatgaaccgatgaaagaatgatgttatttctttcaacctgctgtaagtcctttcacttaaagttgcagtttctaagaactgctccatgatgttaagtaaggacttgctgaccgttaagtatttgtcttctaacaaatttagtgaccattaaaaaaaaaagaaaaaactacacataaattgaaagaaaattaatgtgtttatttcattcctaaataagtagttactaatgggatgtgtgtgactattggccactgtacaactcctcaagccttagaatcagattggacaagccaccttcatttcctgtttctcattgattttcacaatgtggcacttgctttatatcacagcaactgccaaaaccagcatctcgaagataagatggcattgaaaggaatgtgtagcacatttaaagttgaatctgtgagcgatctccagtgactgtagttgttcacgtggtatatgacaaatgcagatgctcctcaacttacgatggggttacatcctgataaacccatcataagttaaatatgtgtttttgacttgaaggatattttcagcttacagtgggttcattggaacgtaaccccatcataagttgaggaaggtactgaatgtgtattgcttttgtaccatcttaaagttcaaaaattgtaagtctaaccattgtatgttggagaccaactctaatgaatatttctgtgtacttctgcatatataatatccttagaaaattaaaattatcccacagtaaccctcggaattta

SEQ ID NO: 124804 - DNA, 1001 bp, Homo sapiens
cctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaatatggctctttattttccttagtgtccattatgaaaaccagtatcaagtttaccatggaaattaatatatccattcagttcctcattctaaggctgttcagttgatgcatgtagactttattcccttacatttttgcttagattagattaggctgtattacttttctgtcaataacaaattaagcttggacttacttacttaaactattttaaaataagttctaggctagtaagatgaacagtgtctactactataataaatattccaaggatacttttggattaacatggtccataattattaactccaacaaaaatgctcccattgttgaacatattttacctaagtatataacctatctggaagctgaaagtctccaaagctattgcttcctaggactgctgtgtcctaacagctggcatatg

SEQ ID NO: 124805 - DNA, 1230 bp, Homo sapiens
cttactagcctagaacttattttaaaatagtttaagtaagtaagtccaagcttaatttgttattgacagaaaagtaatacagcctaatctaatctaagcaaaaatgtaagggaataaagtctacatgcatcaactgaacagccttagaatgaggaactgaatggatatattaatttccatggtaaacttgatactggttttcataatggacactaaggaaaataaagagccatatttatttttgggtcagaggcagtttattttaaatgtgatttcatttacatttataagcagcttttcttgacaggaattttgattaaattgccttcagttctaaaacaaacctctgttgctttcagacttaatgtgctctgtccccaacaaaacatatgaaaatataatttaaagcacagttttcacagacacagtacaatacattcactatacacagtataacaaaatattcccatccttacctgtttagtaatactgtcacaatgaataagtaaatagaaattggaatttatctttgaaagcattgaaagaaatttaacatgcacaatgactattttatgactgtttagctgttgaactactgatccagcctgcagtttcttgcactagaaagagcgaagctaaataataattgctggcctaaaaaattttttttggtcaattgtaggtagatatgaaatagccaagtggggccttcttatgcaccaactagttgcgtctcatgtctggatcacccttttaaacataggataacactgtatattcaggaccaagaccatacttcagatctgaggaaatttttagagggcagtgtttttataaatactttgaatccctcataatgaaggattttagaacttatgaatatagaggtttactcatctaacaaacagaactgtcatcctttcaaaatgtctgaaaattgaggagggacccctgcttcccagttatatgtgatgtaagacttttcatcaaatgggaacatgggaagaaactttataagcaatttgagtttgttttatgggcagttagctatctcaaagcattttttattgcattattaggcaactggtaaactctcgtgtttaaggaatagcacttgggagaaaagaacactcaaggcatgatggtactgtcggtgaggaaaaacttaaggaatggtccagatgtagattactctaataggtcgtattagtcatgcttttctttgaccac

SEQ ID NO: 124806 - DNA, 1075 bp, Homo sapiens
aggtattattttggttttgaacatatgtgagttgatgtgttgaaaacttcaatcacattacaatcttgaaaaaaaaatctcagtgccagcccctcctccccccaggttgataccaccgcaatacaattcaacaatatgcaacatgccctcaattttattttgttttgggggaaatgtgctgaagaacctagagctttttttgtttagcaccttatatcaaagtaatgaaaatgggtatgatgattacatgtgcaaatgtacaaaatcattaactctacaaagatacatcattccaaaattacagaaaaaatttaaagcatgcatttaattctttttctttaaagggttgctgaatgcttcccctgaaaaaaggtggctgttttcaaaatcagcaactgctggtgaggatttcttggcacagttatgaccagcatgttattgctgcatcttcctgataatctcagccgacaccgggggatggaaattgattgtgtggtgccgcaggccctgagctgtcttgtaactcttcccacagcgacacttgaatggtttgcggacacgaatctgtgttctgtgaccattcttagcgtgatactttatgccattcacattctgtggagaagacaaaaatatttattacatggattcacaggatacctgtcaaacttcggaaacctcaatttgggtctggattgcagttcctggatggcagctgtttagagtgtagtcttttgcaaggactccagttgggacccttcaaggacattctggtgtgtcggtcatgggctgtacggatggtcacacacacagctgactcaaaatttcagatgtgcctcaattactctgaaaatgaaagtactgatttcttccaattttatataaaatatatatttaggacttacagactgtataaagaaaatcctctgaatcttttccactctaaagaaagttaacagtgaacaatcctacacaaatatcctcagcatgaccaacaaaatatctttctaaagaaaaacatcagggcatatcccaaaagtttaacatatagaaatttttgatttggaaactcaattta

SEQ ID NO: 124807 - DNA, 1059 bp, Homo sapiens
gcaggagttgtgccttttttgtcattgaaattcaggttgttcgagccatctgttcatttctaacagaagcctattgcactgatttgtaattattttgtgtcctatgtttggccttgaggtagccattagcttatgaatgctgtgaccaactactcgatgtagtcttatgtagtacaatgcaggcaatgtacttggctaaatatcaagctcatggcacatagtggacactctgtaggtcccttggacaatacagaattgaagttttgttaaccaagtttggttcaaagttagaatggtttcataagtaccagacctgtgtttgacatttggttcttcagttattataggttgaagatcattagggttagtgtcataaaaatcctggtttttggtaaagtgtacgcctacctagacctactcaaaggtcccgtgggtgtgggtgtgatagtggcttttcattggtagtcttctgtagatcttttcaactagatagggctactggatgatcccaatccctcttgggagggatggcattccaaggcaatggatccaaacgtgcctatgggcactgggccacctggagcttgaagcagctttgcatatttagtccctcaagtgattcgctgtcaactgctcagggtgtcagctgagactcctgctctgacatcagactgtatagcctcaacaactctgcagagagtcttaatgctctggtatctggctgatctaaccacttctatattacttaacagattacaaaatattttgatatacatagtctcatttgacatgctcatgatgatactacaaagtcttgaaccttgaaaatgttaaccggtgcaaagctcaatgatgccaatgtttcacaaagaggagtggaaggtggaatgagattgtatcaaaagtatcgtgaaaagcaggtaagttatctctctaatttaggtctgaagctgagtgtctagtaaaagtcaggaatcctgggaagttcctaagttggggattgggagacagtggagagataattttgacctgtgtctgaggggtaaacttgagactcct

SEQ ID NO: 124808 - DNA, 1032 bp, Homo sapiens
ataaagcaaggaggagtcttaagaatccattcaggagtttcagcaaatatctccccagagacctggctacatggaagatgccatgttgtgaataatacagagacctattaaatatattatttgccctcaagaagctaaataaagtcaaggaggggggtaggaaaagacatgtaaattcagctcagtataaatcaatcagaggatggtaacatttccatgaagtggttggaggggcagcaaagcagaggggaagggccacggtccagggtgagttctgtcccatctatgagcaatttgtaggatctgccttcaataaatctaccaaatgaaaagagtgttgctaaggtcgcgtttaccccaacattctgagattctaaggtggaatatgagaaggggcataatccaagccggcagaggttgccaccctacgtgcctttgtcccccagacacggtaagattatgcttaatcctctctttaggtggtctggtccaaggaggacaggtggaagcaaggcaggaggtacagtgtggcttgtcagcgccggttccagtgtcctggcccatggcttagatgcagaggagaatggctttgcttctggaaagatttggtagggaaaatagcagagggcttctggagtataactttagaagtactgtgtcagtgtgaagaacttggcaaggataaacagaggagccacaaggatgactgaacatttgaaaaataagacctgagaggagaggttagagaaacagggcttatgtaacctggagctgctcagaggtgactttggcaggcttcttcaagaacaggactctcaggatctctgcacagacagcaatgactggccctttttgtccatatcaagtgaggacagactccaactgaaccacgaaaattttagatttcatctgtggaaaagttttcccctcgcagcagctgtaaaatgtggaatacatcatggagcgaagtttatagaattttctcttcttcctgtctttcaaaaaaaccaccagaacacagtagaacctttt

SEQ ID NO: 124809 - DNA, 1176 bp, Homo sapiens
cccaaataaactctgaacagattgattccctctgcaccccagtaagggtgtgctccactgtgttcccttgtccccaggcccagattcttcctaaagtaaactgggccactgaactgtgcccattagtgagccaaaagattggcatctgctgtacctagagggagtttgttctgtagatgccaatgggctgccgtgagggttgctggttattcactttctctggtcttgctatgtgcattctttgcagatgtttctccccatccctgaccatactttcctaccttctccaggagcacagcctcacccccaacatcccatacccctgagtgcccaggcagggttaggaacctctaggtgtctaataaagggaggtaaaagccactaacccacgttaagaaggtagctttccctcctttcctctgtttggcacaaggcatcatggcatttggggcaggccccagaataatctgtgtgccatgaggaagcccaaatgtcctccagagatgaccctacctcctccagtgcgagcctttttcaagatgctctgtgtccaaagctgcctgcagagtgaggttgcgttactctaccacttctatttgcatcctcattgttccccccaaaaatgagtgaagactatggcaccagatgaagaataaacaaggaaaacaacttcaggttattaatattttcaaataatatgcatgctcccaataactgtacaaaacataagaaaaaaatcactatagaagtcagataggttttagtttgttactatgtcagtagtttgttaatcagtgtttatcagactgactctaacctgaagtttattctaggcagggctgctgtcctggtggacttgaatgtataatggaatcataattattgcagagtgctgcatgttaaaatgactggttgggggaaggtgttatttacttgtattttcccccacagttgttacatattagtgcatcaagacaaagaaatgattataatttactgagtaaagttgcaaaggtccttggcaatcatctcacatacatgtacttatagagaggctagagctactccattggactttatgtatgttacattgttagaaaaaaagataaggtcttcctgctgaattttcacaaatatatcttcttccacttaaagatattatttgacaattgcatt

SEQ ID NO: 124810 - DNA, 1046 bp, Homo sapiens
caacatcatgaatttcttctttaacattttctgccttctgacaagaaaacaaaagttaaaatgagctcttttgtattgttagtagttccattacatatttttggaataagaaatgccgagaacttgttaaacatggaatcgcttgaaacagcaggatctctcctgaacccgagcagtaataatgcaaatcgaaagcagcttcctcctctgcaaatttgcactttttctgatcacagatgtgtccttccatgttgcctgtctttgtaaaccaagcatatttttgtcatcacctccaaaccctttaatcagctgtaagtgccgtcactggatagaaggtccgtccttgggtctgtatgtgggtggcaaatggtaagtgaaaggtttcactgaaatcttggcagattaggagctggttaaaaatacttttatgggacatactaacttttgtgtattaatatatttattgaaaaaccaaaatctttccaaatggttctatgaggaaggaaagaaatgagagttgaattataaaagtttgaaaggaggactaaagatttttcagggcagttgaggcagggttttcagaatttgcatttagccactaaactgtagacgcctgctggtgttggagttgacagaggtgtatctgctgaggttattaggtctttgtcctggtgcataaaagtggaagagtatgctgtgatgagctcttttcataacgttatgaacgcaggtcttgcctgtgacttagaacagtctcttttggtgtcaaacctccctgtgcactggcttccggctacacctagttggatctttgtatcacaccgcattgcttgctgacctgtagtatttcgctacacacagggattctggctctccagagccgattccgttttaggcagctgccttccccatgtaggaatactctgtttatcttaccttcacccggtaaccagttctaggtaagatgcctgctggtcatggccctgttcccatgaaggtattcacagttttcatttcagtcaatcaaatttattgaatgtctgctc

SEQ ID NO: 124811 - DNA, 1001 bp, Homo sapiens
agcagacaacaaacatcctttctgacctagaacataaattgcctcttgtgtgaagagagagggagcctgcccagagctgctccaaggccatctccatgtctccctcctgggcatggcaatggcatgatgctgcttgcccgctgtggggtggggtcacccttagaagctcaggatttgttttgtgcccttactgaccatggcacagaaagactaaaagaacccatacactttttaatagccagtacttctacaagtttgtgagagcaaacttcctgacgggaagccaggattaactctcttggaatttgagggaggttggattggaggccgtggtcagaacccaaattttgaagtgggagttcagctcccacaatgtacttgacttggtgaatagcttaagagttttcatttaaagagtcatctcatagtactttgtaattggttccaaagccactagttggcctgatggaaagggtttttgttgttgctgttagtttgtttttgttttggggatatggggagactagattgtgccataaaatcagtaaagcaaaattgttaaacccacaatgatactgggcaagtgttaggtttttctcttctctttctgagaaactccctctcttccttccaccctcccttgcaagggggcttttccacagtcttcagaaggcagcagaaaatgttgcagtgtgatggttacaagactggcatatatttcagtattgtttgtaatgcctgaaatatttatcaaaatatacccatgacatcttctgccctcattcgataatcctggaaagaaacaagctatttcactatttgctttatattgttagacttgttgtcataaaatgtaacatgtaaaagcaataccaataattcttaggctggcagaaattgttggatgttccagcctgcttgagtaatagcactgggccctggcattgggtaagacaatgttgcaacaatgttacaatgttgtaagcaacatttcttaccca

SEQ ID NO: 124812 - DNA, 1057 bp, Homo sapiens
atacaaacttgaagaatgttaatatggaaaattagaattagtaatgaaatacaaagtcatttgccatagaatactgtagctttcacatttttactttaaaaattccagtttacgagaaattttcaaatagaaataattgggaacgttagatccttgttaaaaaatactcttttttttcttttgagacagagtctcactttgtcaccctggtgcaatcttggcccactgcaacctctgcctctcgggttcaagtgattctcctgcctcagcctcctgagtagctgggactacaggcgcccaccaccacgcccggctaatttttgtatttttagtagaggcggggcttcaccatattggccaggctggtcttgaactcctgaccttgtgatccacccgcctcggcctcccaaagtgctggcattacaggtgtgagccaccacgcctggccagaaacattctttttgtgctcctcttggcagcacatatgcaaaaataggaaagatacagagaagattagcatggcccttatgcaaggatgacacacacatttatgaagcattttatatttttatccttatgaaacactcaaagaaacgtcatttaccacttttccagctgcggtggaccagacattttccgatttgcctgttttccctgtcctatttttgttgtaatttttttttaataccgcacgtactggtgttcatataaaataaacttgagtaaaccagaattctgtgagttttgccagactttaattgtgttgtattgcttgctttttaaacaaattaatagtgaaaaataatttagcgacctcccagttgtaaacttctaaatggcagtttgtgtctgtatatctcttcaagtcaagcatctgctcaaaagatattgttgatgatgtgataaatgcagtttcatgaaacttggcagttcccataaataattgaataacataggttgtatttacctctgtagtgtctagactagaggattagaaccatgagtttataaaaatctaggttgctgtctacacacaaatagaatagtatttaaaatt

SEQ ID NO: 124813 - DNA, 1038 bp, Homo sapiens
tcttgaattgtagttcccataatccccatgtgttgtgggaagggcccagtgggagatgattgaatcatgagggcacttctcatgaatcatgagaacacccgccatactgctgttctcatgatagtgagcaagttctcatgaaatctgatggttttataagaggcttttcccccttttgctcggcacttctccttgctattgccgtgtgaagaaggttgcatttgctttcccttctgccatgattgtaagtttcctgaggcctccccagccatgctgaactgtgaatcaattaaacctctttcctttacaaattacccagtcttggggatgtctttattagcagtgtgagaatggactaatacagccacattttccctttttttgacatttatctctgcttttcatgaaataaaactttttggcactttttttttcttttagacctccctggtgaaatgaggtgccagtggtgtttctctctaagggttaacatgaattaaggcaagcctggtgaaggtttgtgttttccagtcaggcatcacaactccccttgcataccttgacattgtcaccattcccaatgcaggtccatgctaggccacttgatagacgaggttccatcccacttccacagcttcctctggcatctgtatccccaccctgacatgggttatacctaaggttacacatgtttctctaaagggcattcgcatttaatagtaatccttaaatacttcaaagactgaaggcatgacttctaaggctagagtgagatgctctgcaggaagggtctgtccattttcccttgccccagtactcttaaggttagccttaggatccttcgcctagtatgcagctgtcaggagactgtcaattctaatgaaaagcaagcttcagaactttctggaatatatgtcctgttgaccactgcctgggatatcccagagccttgattgagtgtctggaacaaactgttcattgagagacagggggctttggccagaaaagccattcactgttttctaggggagatcagtt

SEQ ID NO: 124814 - DNA, 1066 bp, Homo sapiens
ggcatggtggctcatgcctgtaatcccagcactttgggaggccaaggcaggtggatcacctgagattgggacttcgagaccagcctggccaacatggtaaaaccccatctctactaaaaatacaaaaattagctgggtgtggtagtgggcgcctgtaatcccagctactcaggaggctgaggcaggagaattgctggaaccggggagctgaaggttgtagtgatccaagatcacgccactgcactccagcctgggtgacagagtgaaactccgtctcaaaaaaaaaaaaaaaaagatttgtgactttcaacttttataggagctggagaccttgaagaacttactttgtcagagtaagtacttctttctgcaaccttttctagtctccctccccaacctccgtctctttccagaaagaaccatgccttcttccctgttccccaaatacatatactctaaacatacctccacaccactttatcatgtttgtccatagggctgttacctcctaccctgctctaagttctttaagggcaggatatagatgtcttcttcaaccttgtgtccaaggcctagtcgtttagtggatcctcagtaaatgtgattaaatgaacgaattattgagtgtagggaaacaggaaaagcaaatcctaaatatatggtttcctgggactacaataactgtaccataaactgagtggctgatacagtaggaatttattgtctcccacttctggggactagaattgttggcatcaaggtgttggcagggttgtgctccctctaaaggtgctagggaagggtcgataccaggtccttttcccagcttctggtagtttcttgtcagcataactccagtcttcataggaagttctccttgtatgcatgtctgtctgtgtgtccacacgtttcctttttatagggacaccaatcacactggattagaggtccatcctaatgactcatcttaactaattatatctgcaatgaccctttttccaaatgaaatacattttgatgtaccaggggttagaacttcagtggatcagctctgggggacacagtt

SEQ ID NO: 124815 - DNA, 1119 bp, Homo sapiens
gaaacaaaaaaagcaaaaaaccagaattccaaagtgctcaggtttcaagcattttagacaaaggaaactcaacctatagtagattaaaagcaagaacagcaacagtatgactagtgatagttaacattataggaagaagatcagaacttctatttttaaatggcaatactctgggaccatttggaatagggagacaattgtctgccatccctgaggacaactctatttaagggcttatcatgcagtcagactgttgataatgatcactctgcctcatcaagtaaacacttgattatattcagtagactctgtttaagaaggcatagaattagcaccttttaatacttaattagtacttacagtacttaataagataaatttcagttatctgaagattcactcctgtgttacaccagaacaccctgaatcttcaagtgccatgggatagctcatgtcaccctcacagtgggacaagttacagatcatctggtatatcactgttccctaaatggaaatacttactgatcaatcgatcaatggggaaacggttttccttaatttaatgttgttctaatcttttacagtcaagaggtttcttcaagatggtggcctgtcatctgctggcttctgctccttagtatggctaggcatttccaactctttgtttaaattcttgttggcttgcctagcttgaccctcctgacaggtgctatttttgttcctggccaagtggccacagctgtgttgacatttctgccaaagacaaaatcaaggaaagtcaataaacagtatttagaatagtagcatggggcttatcttaaggcttctaggaagagtagaaaattgacatggagaaatggaatactactcagcaataaaaaggaacaaactcctcatccacatagcaacatgcatgactctcaaacccatcatactgagtgaaagaagtcacacacaaaggctacgtacagtttgattttactttatgaaattctagaaaaggcaagactatagggacagaaaacagcaaagtggttgccagcgtcctggaatgggggaaggagattgtacgaagaagcacaagggaacgttattggggtgctgcaaatgttctgtttt

SEQ ID NO: 124816 - DNA, 1054 bp, Homo sapiens
ttttgtttggttttgttttggtctttgcctttttattatagttgggaaaaacctgcaatctggttattaatgaaaatttccccaatagaagttactcacttttttgaataatcatattctaaatatagactttaggaaaataaatttataaaatacattgttgctaatttttttttttagtggaagtgtgatgctttttatcattcgcaaagagcctgatgcttacatttcattagttttatttcagcaaacattttctgagagcccacttcctggctgacagtgttaagaactgtatgctccaagatgagcaaaccaagtagtgtacccttggagagtactagtggccccacactgctcatagggccatagtggaggtgctgattcgagggagaaattataatgaactggacattggtctctggaagttggaaattacctagactgctcaacaaaccttttacatgatttataaattttaaaaattctccctagaaactaagaaactatataatacggctttgtgaaaatgcaacaccaatttacactgttttcaaaaacatgtaatcataatagttatgaaaaagttgtaaaattcaaatgtatttctgtgtatctgtattgggttatctctgtatctttcttgtactttttccactgccattttttgcagtgtccccttttcaaacctcctaccttcttccttttcctgtcctgtgtcaatagacctagctgaatttcgcctctgcataactcattcttcaatcactactttcttatctgtaattcttcattaactcgctgtatttacttactattcttgtatttcctgagtcgaatttttaatttttatctttttcttttacaaaggaatagtaagtcaggattcatttgttattacttatatggcctttgatttttcttttcccttttctgagtcaatgggagatagaaaaaactaatccaatgcctggcatagatgaagcattgagtattagaagaaatgcagtagagtttgggagaggaaaaggtgtgctcagtagcacagtggggt

SEQ ID NO: 124817 - DNA, 1014 bp, Homo sapiens
ggtgtcggggccactgaggatgggctagagatcactgatccccaacttgaccatatagggcctctcggtttttccttacttttatatttgaaagattttttttctacctgataagtattgattaattcatttttctttttaaattaatggcattcataattgtcaatcagaaattgtgataaacatgagatgtctgatgttaccatactgaatcaaaataattgcagccaacagtaaagaaagttgccattttacttgacatgtgaagctttcttgtgtgtgaataactaaatgtttacatacacgttaaccttttggaaatactgaaaattgaactgatctctgttattacattcacagacttcctaggaatccagagacccccaagtggggagcaactggatttagcaattgccgtaagttcccatctgcttctaacattctgtgatttgtgaacacagcattacaactaataaaatcgaccagttacaaatgttgcttccaacagcaagttttgaaatacaggtccaacatttttgtgggaaaggagcaaacagagatacttctaaaacttggagagcagggtaaagactgggaatagctgcacttcactatgtcccatgattttccttggtgaacaaccaaaattagtgatgtccactctgttgtccttgaccacagacagatctacttgtgatttaagaaaaaccccaaccccaaaccgaaccaaaccaaaacaacagacccttcatgtgatgctttatgtctacatcctgaatagaccttacaccatcctctgtatcgtaagctctatactgcaggcagaatgaaaaaccagacctgactatatcaaccctctgttggttcttcactgcccatagggtaaaatttaacctccttggcttgatgtacaaggtttgcattatataactatcatctgcacctgattcctctccatgtatactttgtgaacctgctagactgaattttccatcatccttgcaaactaccaga

SEQ ID NO: 124818 - DNA, 1040 bp, Homo sapiens
gttgctgtaacagatgtaaatgatgtaacaagtatgccagcactggctgtgatctggaaaactttaaaggggtctgtgctgtgtgtctatggagtgggtgtgaggtgcgcaaagggaagtagaagtaaaattatgattcagagggagggtctctgcttggtaattctcctcctggaagaactcccccttaatttgtgcattcattgcaataacttgactggaaagtaactattctatactagtggctggcatctaagattcctcagatctaaagttatcccagctatgttaggctttctgcaagtctttctgtggtttgggcataaacaagtaaggcccaggttattcaggtattttacaatgaatctggattctagccacttttctggggtgccattctgtccctttgccaaactgtgtgtgtgtgtgtgtgtgtgtgtgtgtgtgtgtgtgtgtgtttgtctatatctatatgtactttttttttcctggaaaattattcttgagtgaagctggtttgtgaggttgtagcttacaaatagcgtgttttgaatctgcctagaggtttcatggtacatagtacatgtatgtgtatgtgtgtgcatgtgcaaatacatatgctgtggaggtgggacaagggaacaaaaggttgcatgtgcacagaagtatggcggtcctacaggagcatccctatgtgggtaccattgtctagagagtgttgctaaattgatctctccatcctgggtcctgggaacttaaatgtaaaggtgggttggctttatatgcaattcacttgccttactttaaaagtgatccctgagctcacattcttgaataagctccatatggtttcccaagcagatactgcattttaaagtatattcacattgaacatatacatattgacaacaatggaagttgcgggaaggtgtcactctgcatggtactaactttagctgccagctccctttaccgagggagaaaggtccctgcctggactctgcttttccttcatcatctattggtctatttcagtgctg

SEQ ID NO: 124819 - DNA, 1086 bp, Homo sapiens
atatgaggaaataagatcaaaggaataagtagtttgctcaaagtccatatatgtctgtaattttcctaccatacacctagatgtgtgagctgtacatactaagaacacattttggtctcagttgtatgtttggatataaatctctgaactactttttcttatattattggtatctctttaatagtcatccaatggagaaaataatcaaaagtttttaggagattcttctaacacataagcattgaaaagaacaaagagttgtggtttaaaatcagattgtctcatccattgtgacaaatagaatgtaagtgttactggcatttataggagttgtccgtttctcgtccgtattcttagctggtcaagcaaaatggaattttgaataattcccctgaatcctttggaggccttgctctgcagtattcttttttatatgaaaagcttgcttgctgtcttcgttctgtctggaaaccagtcccctttgactaagagtataggagaactcaggcaatcagggactcagtggaaagttaagcattagcttctgctattcagggcaatttttgataataaaatcaccttgggtcccctagctcactcggccagcagagacttgatctcttggtgttaataacccttcttactagcttagcctcagtaatgcaaattgaaattgtggcttgattgcagttggaacacttggggtagctcatggttgatcgtgagtaggtgtggaatatataattggttactttaaaactatgtcttttggagctagttgagcatgcgttgtaagagacacctttgtcagagcattgtctaatggactcacaggcacttggaagagcatctagtcccacagttgtctatcttggcaatgaatggatcccagtatatgagtcaagagtgtaagagggtgttccatctccccactgacctggatcaccctggccaggatggtttttaagcattccatgtctgttgcttaaaaaccaggtctgccttggtttgtcccattgtagcactgcctttcaggacagatgcagggaaacagtaacatcagtgttactgagagactcctattat

SEQ ID NO: 124820 - DNA, 1038 bp, Homo sapiens
cattaacctggcccttcgaatgctcggctttgttgaaaggagtcaatgctaggttggtaagtgtctctgctaaagatttcttttcttctcaaatgaccatgagagcaaatgttgctgctatctaaatcaagaacccatagagtgctaagagggtggagtagattcattaaagacagcatctaaatctccagggacttctctcaagtggcttggctttcagcagacaattcacagttatgccagctaattataattattttatttttctttcaaggggaaaaaacataaaatgtgctagagtttactagcagttttacagcattccttcccccctggagttctcctgcctccctctccctgccaccccccaccaactacccttttggaggcccttagtattcagccattgttagcacaaagctggtctttatgaaacagtcttttgagggctagcaataaagtttaagatgagtgctgactctgttgataatttacccagctggcccaggactgtacatttgggtgacatttgtaggctgtgtcaccatgcctggatggaggcgggtgtttctgtggtatggacgccttttggacacactccatcttcccatttattctccagcctggggtgttgtgtgtcgctcctggtgtgttctaggagataattgtcacttttaggactctgtctcattgccaagcccgagggaggctatttcttttattcagattcctccctggtgtgtttgccatgttgattcaaacccacacatcttgtcgtttccatttttctccatccaaaaccttgcccggatgatcctggagactcagcaagaaataacccaacccatctcaccagtggattcagtatgaaactctaggtggtaacatttggggacggttgactcttttatttctctcaggaaagaggaaatgagtacttatttgaaaacacgagttccctctggagactgtgtctttaaatgagcatttgaaattgcagatagctttttttttactttattttttttgaggctgcac

SEQ ID NO: 124821 - DNA, 1064 bp, Homo sapiens
tacagtgtcaaacacttcatcccctcatgtgtaagaaaactatagcatcacagagaagtgatggccctgtctccaacatttggttgctctatatttggcttcttagcttgcaggaagaccactattccctgcccaaatgcaattcaacttccagatttgttccatttcctgaggggacagttggctttgcctgtgagcttttcttggaggaagacttcatttctggaacttctacacagaacctggccctcagagttcctgaagcttccatgtaagtgtctcagtgtgcatttcctccctcctatttttggaaaagataggcacaaatgagggactacttctacagcaaccagcctggaatcattctttctgtgcttacagtaaatctagacatttgttcttttgtgcagcatattgaaaagatatgcctggaatacaagagcttgcttggagcaaaaccatggcaagtcagaggggagtcaaggaaaagcattgtcatgggttcagagttcatggattttagacattcaggctctgccatttaaaacatttgccaccttggctaagcgctcagcttccccaggcctggtttcctttacctacatataaaggggttagccaattaattgagtcagtctcagctccagaattctcattcactgcctcttttctgtctcaaatttattctctcttttggttgttttcttccaggagccaagtttggcagaagctctagattatctgacctcctagatatgttcacatagcccagagagtgagaacagaatagggtttgggaagagaagcccacggcagtaaaagggaggggtcctaacatatgaagtcagagacacttgacttctaggctcaactcctaggtgaataacagcaacctcttctctttgtcaggtgctgtttacaaggcacatctctactagtttggcatgcatgattctgttacccaggaattaatacacccattttgcagttgagtaaagtaaggttcagagattaagtgacttgccccaggtcatagtgataatggccagagccagaactcgaat

SEQ ID NO: 124822 - DNA, 1052 bp, Homo sapiens
tgataggaagcttgttttcaaggtgtttccatgaaaagcatttgatccttcatatttccgtggtggatttctctggaaagttgggagttttccaaagtctaactgttatatcagtttttatggtgatgggtctcatttttcttgtagtatacattatcttctctactaattgacttaattttcagtccttatctccagtcaagaaatgaaaagaacttacaaattttgttaattgtactgaaattagacgtgtggtgagttttagaggagcgtccaaacagaactggattccatcagagccttgaggaaagttagacggcagaccccaagggagaagagggcagaacacaggctgacatatgacaattcttgggaaactgtttaaatttcttgggaaaaacaagataactgatggtttttttaaaattaaataagtaaatagcaggcagatcccagaacattgtaatgtgaaatctaggtgccataatataaagatgaattattaaaatatgggcacctcgaatccactaacttgggcccaacagagcctgcccaggggctgccaagcatgaggggtgtggagattggccaggtgggcagggctccccatttcccaggtatgtcttcaaccacagcagcttcacatatgtgaacttagttgggtttccacataagcatttctttgaacaaagggctcttcagcaagagcatagtttgaaaactacaaaattggaagatgcttttttctctatgtaccacaaacaagaggaaaagtgaattattgggtatgataaagcaagtaccatcttaaagatcaatttccgggagaaccagtgatgccatcatcatcatggaaagtggatgagattggacaggcaagctgtggcttctgaggtgataggtgattgaggggagaataaaacatgaaataacttctagtatttggatgcgagggaagaaaatcatcagaagggaaacatagagacttgatggggatctgtccatttcaatctctcaggaaagggtagaacaacaataacaaaggaagttgt

SEQ ID NO: 124823 - DNA, 1070 bp, Homo sapiens
tgttgtaccctttttggtctgtcatgtcaaagggtatatgatgataaatcttatccctggtgatattaaccctgatcacctgtttaaggtgggatgttccagtgttctcccctctcaagttcctatctttctctttgtaattttttctttttttggaacggagtttcactcttgttgcccaggctggagagcagtggcaagacctcagctcactgcaacctctgcctctcgggttcaagtgattctcctgcctcaacctcccaagtagccaggattacaggtgtccgctaccacacctagctaatttttatagttttagtagagatggggtttcaccatgttggccaggctgttctcaaactcctgacctcaagtggcccacctgcctcagcctcccatattgctgggattacaggcatgagccatcgtgctcagccttctctttgtaattaatatgtatctcagaagaatattttgagacaagcgaacaccctactttaaggaaaatcttcgcatggaaacctgaacttatgaaataagtactgatgtattttcttgcattaacaaaggaattcttcacttttccaaaggattcaccccaggattcaattttaaatagcaatctcagttctagtacatttaacatagggcctgtctaataaatgttaacagttaactttttgagacaatgtttactacaatggcctcttttaggacaatgtttgtcttcgcaaataatccataaatatcttcttatccccttatataatgagaaaaaaacagcagaatttctcttacctggtaggtcactgaaagaagaaatagagcttaaatcttctactctttattcttttctaaagggatttttttttttttttactgccagaattagtgggaaggtcaggaaaatacacatgttttgtggaaataaattctcagagataatattctataacataataccaaagtagatgggctaagaggatatcaattatatgccatacacatgattccacttactggaaaacagtttggcaaaatgtaccaagccttgagttccacctcaaaga

SEQ ID NO: 124824 - DNA, 1083 bp, Homo sapiens
ccttgtgggtaactaagccctaaatagtgaggaggaagactccctcaggtgtccagctcagccacattggtaaactttcctgactttctgatcccatcacccactagtatccacgggaaaaggcagggatgatcgtgtgtcttcatcaaagagaggttctatgtacaagataactcttggggacagggtgatatcacacttcaaacctctctgaagtatggagtaaggacaggtcatctgcactccagttcaaacacagaattggacgctaaacattatttctatactgatgtcaagttctgcttcttttgtttgagtctttgttttaacaaagagtaatacacacttggttttaaactgcatactaggggaaaaatcctagaaggagaattgcccaagatcttgtgttttgtcttcatgtcatgacttaatttttacaaaatcaaaatgacttcattcacaatttatgtacccaagtaacttagcccattttaaaattcttgctgccctgttccatgtatgcatttatttttgttttttattttcattgtaattatgtgtaccagactgggctacaggcagtgtgacactgacaaattggaaagcatatcgaacatagagagaaagagaatggaaattctaagatgggttagccagcctctcttgagttgatatattcatgacattattttctttgagctttgcactatcttttcaggaatcttcctattagaaaataacttaacaaacctgagtttattttgaacttggcagtggttctgattagagatgttgcaaaataaccattcagcccaacatggccctaaagactcagagtttccaagatgaatcagggcagatattggcatacactgaggagcatttttaacctttaacatggagtgggaatggggagagaagcgacacactgcaaatcggcacacaccctttctaccatcctcaattttatttctgtggctttttccacataaaagaaagtcattttcacaattactaagttgcatcgcatctgtatccatccagcccaagcttccaagctcccaactggggaacaaaagcagc

SEQ ID NO: 124825 - DNA, 1034 bp, Homo sapiens
aaatggctccatctttaggggagagatacagggcttgaaattccagggtcacattttcaagacttttcaatgaaaaaaattcagagtcagtttacgttccctcatcaagggagccaccttagaatagggggattttatccaatgtgttttctggttgtcctctggatgctgcctgatgtggacacgggattcacgagaagtctgggggcgtccttcctccattagggcccctcatcctctttaaaagaaagacaacgatgccttcctcagggagtcgttgcatgaacacatgagatggttcttatcaggctcccggtacgtgtgaggagcagggcaacccttctcatgtcatgatctctctgtgtggggcatttcatttacagcgctaccccttccagaaacttctaagtgtatttttaaatggcaagtacctaaaacaaaaaagtatctgtattgaggtccagacctggcacttcataatgtttaaagcatcagctgccaatttgctgtgcctgtaatatctaatttatagttccccgtgggtgggtgggagggtggggccaatctctcaggagaagacatttttcttgtttgtaacttttttctttggtcatttaaaaaaggtttagtaagtgtgctccataaactcagggagcatcccagccttcctctgtgtggctgatgtgttgagtctctattttcccttggcaataaatttcccatgaggaggaaagtcacctttttcttcctggcctggtaaaaactggacagcaaagggcagttgtcattctctaaaacactcccactttctcgggccaccacctaccttggctgcccagcccagacgttaagggacatgggatagtttcacttataaaatccacttcctcagagagagcagatactggtggagtttcctgaatttggcagaatctctctttagagagactctgcttcagacggctagacacttgggacctgttggctcaggtttaaaaaatgttcaggttagtagccgaaaaccgctggaagtt

SEQ ID NO: 124826 - DNA, 1044 bp, Homo sapiens
tcggcatgagccgccatgcccagccagcatgcatttagaaacattattgtgagaaggtagtccacaggctgcaccagacagtcataggagactgtagcacagaaacagattaagaacccatgcattaggctatttgaattgttgaaaataatttatagattctccccagcccaaatcacctatcacctttggtgataccagacagattttatgagctaaactatcaagtaggcttgaattttgtttctagttgattacactggcaattctaactacttttgttaccatattcaagtgacattatagtatagggattaagagaatggatactgtgttagacttggaatagatccctgctctaccatgtaccagctgtatgaccttgggcaagttacttaacctctccaagaaccccctcacctgtgaaatggggataatattatcacccaccactctcacaggagggttcattattaggatgaattgagataatgcttataaattacttgaccctctctctacctggcacctaataagcataaaataaatgttggtttctattgccattagggagctctcttagcattaatctattttcacagggcaagaacctcttgctctgttcatagagtccttaagagacattttgtattaaagtttcagatgatgaaatgagttcaatattgtctgtcagataggcctgaaactaccacagctgtatccagttttaacttgactttaacaaagagactgtcttgtcaaaaggtagtagtagcagagagggatggggcggtgttggacattttgctatatgacagcctaataggaaataaaagtggctgaattgagtaatgagttgtttctaaagcattgagtcccttctagtttaacaataatttgaaacatccctgttgacaacaaatgaggtgcatccagcctttttttttttctttttctcctgtttgtactgagcttctaacatatggaagacaggaaatataggagcttacatttagagagtaaaaaactatcaaaacaaaacaa

SEQ ID NO: 124827 - DNA, 1063 bp, Homo sapiens
ctagagctggaactgtcatctaggacccaagctcctgtgacattaatgctccccccacccacttcctggctcatcctaaagagtagcatcatccttagagaatttcttgtagacttttttttttttctctctggcctcatagaggctgctctatttaattacttaatactttcaaaaaagaagtcataaagcgctttatattttaaatgggcctcagatctccaggctgttgtacccataaaggcacaaagatttaagtggcttaggtctgccctgtgtatagctgtgttgtccagtatggtaaccattagtcacatgtggctatttaaatttaagtgtaaaaatattcagttcctcagttaccctaggcatctttctagtgctcaatagcacacatggccagtggctaccatattggactacacagacacaaaacatttttatcattttttacaggaaattctctaagacagagacaaaactaatgtaaaatcaacaagctaaaaagagaaaatctgatccagagcgctcccattgctgtgtgtgctgcttgtgctgtttaggttatcttttactaattttgcaaattgactttttaaaaaagtaatttctttatgaccccgagggaaactgtggaatgacagctggaggatgatattggggagggtaattgaaaatgtttataaactctgtagtcctgaggtatgattcaagctttatttaaaaagtggtttgttgtttccctaatggcaactcaatttctttttcaaataaacccacagtgagttctgatttcaccctcaaagaggaaaaagtgcccatgttcaaaaagtttggatcttaccattgaatctcctttaaagacatcgtaaggaaaactgtgaatgtgtggactgaggttgctagtggcatatacaagccgtgttatttaaaagagattttctaccaacctggccatcagcagctagctagaaggatttttacttctacaaaaagcccacatcagggcaaagcaaatgcattggtttttagaaaataaagttagcttttggaattttcagca

SEQ ID NO: 124828 - DNA, 1050 bp, Homo sapiens
gctctctagggctggttagttcagcctccactagataaatgcctcccttccccagtatccccaaaaggccatggcaccctccttctcactgaagaatgagggagagcagtaggtcccctctgctaatgctggacaaagcaattagtgcatttcttatgactagttaattagctttttatccagctttttaaactctggccacaactctatggcctcgaagtagagtgtgagtcatccaggaagcaagtttctctactgtgtgcctgatgctcctgagtattattcgcacagtgatgtgtctgtggctgcctccatatgcccccacttagatggatgcttgtacagacgtttccaaggatatcatctgctggctcttttgttgtttctaatcaaagaaccgacaccctttgatcacaacagatcacggtattgtactacaaagactttgttagaaagacttaaattttacacgcttgtagctgtcacagaggttctgacagtatttacttttaccccacacaagtaaagaaaaaatgcatttgatcagatcacatggaaaatatgagtgattataaatagtaaattttctagaaccatgtattgttcactgtaaggaacctagtcaatgaacattttttaatacttgctggttttgagtgccaggttgttgcaaaagtcctcttcttcctcccaagtatagagactcctctaggtagataaactttctgttaattggaggaagattggccctgtcatggaattaatgaagctaaagacagacgtctttggggaactgagtccctgggtagccactttttgggcaggcttcagtatccaatggcctgcgtgaatgtataggatggctggctccccttcaagttgttcatggcctttcctcctttttcccataggacacctgagacaggcacccccacaaaatacaaataaatgccccttcacgggagtgtgaagacaaagcaagtactagaacttcttccttaaggtctcattcagagtgttttcctggcaacccctagaggaagtgggcac

SEQ ID NO: 124829 - DNA, 1013 bp, Homo sapiens
tagaatgtctttaaggccctgaagtcctttggatttactgtttttcattctagttcttcctttaatagctcggagcaaataaaagtgatttcctttagaatgtgcacatgctcctaaggatatctgaataaaagatacgtatctgataatttgccatctcagcatcatcccttgggcagcaggttggaaggcaatagtttaatctgaatgtgaactaatgcttatgcgcaaagacatgtatgtctcttcctggatttgaaggaactgagagtagagcagtttaaccaggattccctagatggcttatcatcctgatgagctagcattgcaatcagaagacattcacttttgcttaaaacatgaaattgactggtagagttcagatattaataaaactagttttagcctgtagttttaacccttttcatcttacatttaagaaaaaaaagacacttaaaaggaaacaatgaattggaactaattacaaagctctaaagggccctgggtgatgttagtctcattagggattgtgatgtcccctcccacccatctcccacccccttccaccccctcactcgccagcatgactctctttccttcttacctgtaaccataaataccagacagccaaagtcatgcctcgtgaaggtaggcatgtggagtggtggaatcatacaatatctgtgttaaaaggttatatcctagtaagataagcgtttggactgtaaactagttcaatcattgtggaagtcagtgtggcgattcctcagggatctagaactggaaataccatttgacccagccatcccattactgggtatatacccaaaagattataaatcatgctgctataaagacacatgcacacgtatgtttatagcggcactattcacaatagcaaagacttggaaccaacgtaaatgtccaacaacgatagactggattaagaaaatgtggcatatatacaccatggaatactatgcagccataaaaaatgatgagctcatgtcctt

SEQ ID NO: 124830 - DNA, 1044 bp, Homo sapiens
cacagcattgtgttatgtggtcctgcaagtctctgtcactccatcatctgaatctgtgtcacacactcatactttaatatgtattctctttttttttttttttttttttagaaggagtgtcactctgtcacccaggctggagtgcagtggtacgatctcggcttgctgcaacctccacctcccgggttcaagcgatttgcctgcctcagcctcccgagtagctgggactacaggcgtgtgccaccacgcccggctaatatttttgtatttttagtaaagatggggtttcactgtgttagccaggaaggtcttgatctcctgacctcaggatccgcctgccttggcctcccaaagtgctgggattacaggcgtgagccaccgcacccgcccatatatattctttatgaaattaaaacttcgggtctgttatgtgtattatcccctaatttcatgtcatcaggcagaccattaaatacttttgcatggggaatgatcatatgtaagtatgatctttaaaaatagcttatagaaataatatgtatttattcatttatttaacatatattgatcatgagctatgtgccatggattcttctaggcaccgagggtatggtagttaacaagacacataaatgtattgaggattgtctttaaggagcttatgttctagctgagagttacaacaacaacaaaaataggtacaatttagggaagaaaaaatggggcaaatatgaggatataaagtattaagaagggctgaatttgagataggatgatcagggagggccttcccaaggtggggacttttagcaaagcctaaattaaatgaggggactggttagtggatatctggggaaagaacatactaggtaggggaagagccaggacaaagaccctgaggtgggaacatgcctggagtgttcaaagaacagcaagagagccagagtggctggagaaaatgagcaaggcggggcagtagtcagaaggaagttggcgtgtgtgaggagagggtggttcatagatcttaggagatcgtgtaggtca

SEQ ID NO: 124831 - DNA, 1145 bp, Homo sapiens
cttacgcccaaccccgtgctctctgaaacatgtgctgtgtccactaagggttgaatggattaagggcggtgcaagttgtgctttgttgaacagatgcttgaaggcagcatactcgttaagggtcatcaccactccctaatctcaactacccagggacacaaacactgcggaaggcggcagggccctctgcctgggaaaaccagagacctttgttcacgtttgtctgctgaccttccctccactattgtcctatgaccctgccaagtccccctctccgagagacacccggggtgatcaataaatactaaaaggggaaaaaaaaaaaaagaatttaaaaattaaaaaagtcaattgactgttaaaagcaaaaaaaaaaaaacaagttaatttaggtagagtaaatcattagactttttaaaggagatctgttatttcttagcaaaaatttaatctattgggaaatgatctcagaactaaccatttctctgaaatcatagtgaaatcaggagtgtagaaagtatccattgtggagcctttgggcaactttatgttgagtaaatgggggacgtgcttttagagtctagagactttgaaggaatagggacggcatcatgggctgcccttctgtggtgtctctggctatttcccagcacagtccacaacgctgcccctattccttcaacttctcctgactctagaagcaacttcaagtttccagaaagctccaagttgcctcctgactgtgcagtctccccatttcctcagcacgctcttggtttcctgcctggcttccttactctctgattactcattggatttgctatctgatctgttgccaaagaacagggcacaacttccactcgctctgctagacttagactggccaaacccactctcttgaaacctctggaaacctcgtgctcttttgagtttgacttctgcctccttaaggcccctgaagctgagcaggctgtgaatgaattaacagagctttgtaaattgcttaagagatgtgggtagacaatagggactcctggagtgaagacagaatgactgaaatagaaactttctgtggttagcatggatgtacctgcctttgtcactccccgaataaagttctttactttcttggaggcaggaggcag

SEQ ID NO: 124832 - DNA, 1126 bp, Homo sapiens
tgacttggggaatctttaatttggatgactctccttagagcagccaaatcagcttcttgctgataacagtaatcaggttttatactaaagtccccagttaggcagagtaaacaggaagcagcctgttattgatctgtgttatggaaggttcttttccactgaggagactgaatattttatactgaaaccttttacttcctgtacccagcatatttttcctatatatgtgttaggacagaagtccttttgagtatctttattttatttgtttagtgaaactcctgaaactaagggtgtgggaacaaattatccatatttagtatatgtggtgggttaaaaaatgtcatccatttttgataacataggaggaagtgtaaattgttagtttatcagccatttctaatggtttttaaaaaatgtccttcatccacggcttcaccagaacacacacacacacacacacacacacacacacacacacaatgtccttcaatttcataccatttgaaaaataatcttgttgagtattaggattggctagagttttttttaaggtaaaaagtactgtgtgcattttcaacttctcttgatctttgcatttggaggataataatctccagggagatttgaagataataaatagaggtggaaatgcacggatgcttctgcaccaattctcagggaaggcttttccagatgtggaatgcacggatgcttctgcaccaattcccagggaaggcttttccagatgtggaatgccatggggagtctgtctggcttggataattgacagctgccagcttgtaatgatctgtgctaaatggagctggagccacagaaggcaacacaacagctgggctgctgggagccaaggccctgcacgaggcacagctctctccccaacacccatcctcagcagcctcaccccctaaagaaggtgcactgttccaggaaaggaagggagtctgttgcttctacctgatgggtaagaggaaacaccttgattcactcaaatgggccacggtcagataattagagattcgctttttattgcattgactttagcattttaatttaaaaaaatgtttatggatacataatagttgcatatattttgtggggaaca

SEQ ID NO: 124833 - DNA, 1038 bp, Homo sapiens
aatgaaaacagagaaaaggaacaatatcagcaggtggtggatggcccgagtggtagaggaagtgaaagccaaatagcaaaagtggcagcaaagaggacagctggccagtaggagagaaaagagaagccacctctcctggaagctgtgttatctgaccccctcgtgctgcttctgcctgagagtgcgtcgatgtctgacctccactggagtcagtcagtcctgggaataccgtgtattcctgcataacagtaccttagagctttccttacgtgcttacctggtggcaggtgactgttctgagtgctttgtgtattaacttgtttagctgccttagcaaccccttgagaaatcattttccccactagacagaggacgtagctgagcagctcacccaaggccagaagcactgagcggaaaagctaggtttgattcgcagaattctaagatggtctgcccccaagtttcccctcggttggtatacacgatctgtagaatcctctccccttccatgtggacaggactagtaaaaatgatgggatttcactctctttattaggttacattatacagcaaggataaagagatatttgcagataataagtaaggtccctaatcagttgattttgggttaatcaaaagggagacgtccgggatgggcctgacctaaatatgcaagctctttatatttatatttttatttttattgtcatttttattgagatggagtcttgctctgttgcccaggctggactgcagtggcacaatcttggctcaccacaacctccacctcccgagttcaagcaattctccagcctcagcctcccgagtagctgagactaaaggcatgcaccaccatgcctgcctaatttttgtatttttagtagagatggggtttccctatgttagccaagctggtcttgaactcctgacctcgtgatccgcctgcctctgcctcccaaaatgttgggattacaggcaggagccaccgttcccagccaagctcttttttttttttttttttttttttttttttgagac

SEQ ID NO: 124834 - DNA, 1034 bp, Homo sapiens
ctcctctccttgaggaatctctggggaacacagtttgagaaccactgatctgatccaacaactcatctttacatttccctctacaacatcctgacaccttgttcctttggaaagtcttctgtggcattgaaatctggctcaccgtaattcccactattggtccaggtccagtcataggtgatacacagagcaaatggaactctttttccataggagaatgcatcactcattaaagacagttctcacgtttcatggaagccttctattttccagacaaaacatctccatgaccacaaaggagctgccagtcccttctctcctagtgtttgcctgtgtttctcttagagtcaggtcaggaactaagcacaaaatttttggtgtggtctgcttcacataaaatacggcaagcctagcataagccacagtctaaatattctgtttccatgaatgcagcgttagaccacatttgctttttcgcaaccacaatgcagtgctgactcataccacacgcagagtcaatcaaaattcccttttcacatatgtggttgctagggtatgtcttcaccaacatgtacttaggtgtgtttattttaacctgaatacaggcttcacattcatcaccattgtgtctcatcagggatctggtgcatatcttggatgatcctgattatgtcatccaacaatattgctcttctccctagcatcacctcaactctcaattggacaaatatgccataaatatcctcatcggagttattgacagaattttggaaccagacagggctgaggtcagagccctctagcaccatattgatgactattcccagtgtttgggtccttcaaaaacttacaaatccaactaattgtatcatctaatggcagtgatccaactcataaaggtaccaccagaaacataatgaactatttcctggccgccaagtacaggcattaagtccatttctctgccttcccaagccaggaggtcactagagctcctcctgcatgcccacaaacatgtaggagcctcttttcga

SEQ ID NO: 124835 - DNA, 1305 bp, Homo sapiens
tgtcttggtttattttttcatatacctttctcctttattcacattcatttatataaacgtgaaagttgccatgggtcttataggatacctatgctacctgaagaccaagagcttctgtttgatcattgaaaaagaagtgttttagttgtggttaaatttgacagtgcagcattcacctagtattcatttaccatctctaataactatctcccttcccctggggatggggacccttttcttctcctgtatttttagtccatttgtttctggtggagtcccctctatgctctactttatacgggtatgcagcttaggtctggccaatcagaaccttatattctcccttgtttgattcaaggcaccaagagggcagagagacttttgctgagtctcctggcaaaaatacgcttggtcttcttcactgaacttttcaggttttgaggctcaagccatctgagccaccttgcccccaggaagtggggatctgaaagaggatggcactaacacagagaaagtggagatgggagatggaggcaaactgaactctgggggcatgagggggaagtgactacattctagactcagccagatttcttgggtttgaattgttctgccacttacaaatgtggtcactctatccagattggtctctgtgcctcagtttactcatttgtgaagtgggaattgttatgatacctactcatggagtcttagtgagggtcaggtgagtcatgtgaaatgctgagaacagcacccagcatttggtatgtactatacaagtgttagtcatcatttgagccctatgccaagacatgactaaaatgagacccaccccttgatttttttcagctcaaagaacaataaattttcttttgctgatagtccgtttgggttgtgtttgttgtcacttaacccaaagagtcctaactagtagactcagtgaaatcaaattcatattcaggtttaaattttgtcttccttaatgaccctaagatagaaataatccaaacttagatattcctttcttgattattgtccagcaatgagcaaggtcttggaactggctaatttccttcttcttcctatcttcttgcttgcatttgtttgcaatttggtcttcagcatgtctttaaaaaatactgcatgtcacaattatttaaggaacctcagaacactgcaattagattttcataacaagcatatactttatgtcctttatttccaattcatgcagtatttaaaatgacaatatgaaaaaataaactatgaaaaattaaaataaatatattagtatattagacataa

SEQ ID NO: 124836 - DNA, 1031 bp, Homo sapiens
cccgtcataagttagggcctatttaggatttgttatggaagctggtatgtgattattcattgatttactcaatagcgcactgtgtaagtcaataaatctttggtccctaaactggtggtgtcttaagaagcagacttgaaagcattctattgccttatcagtttcctgggaggatatctgaagattaaaaactgcagtcaaggtaagcatttgctaggaagttaattattggtatctctgaaaatggaggtactggcatcatgcaaaagaaaggaggaacgcactgattgagttgcttgtttaataaataatagaggattcacaaagcagcaaatgtagaagagatgtgatgggaaggcaaaattcctttgtgaggtgtcacttaagagagtgctgattggtcagaagatgagtataaactgagaggaggggctgtggcaggaaagggggaccctgggtgttaaagcccaaggcgatagagcacatgctgaatgaactgttatatccttgccctgtgacacattcatccccaggaacaaatgtccagggaatcttgtgttcaaggtgatttttcaagtgtattgtttattatttaaatgtagcaaatcacttaatccagtgtaatcagtatgtaagaattgccgtgaactccctcctgtcccagtagctttgttagcatccttgagggctgacagcaaacttaatcaggccagcttgagtggaatggctttgggtgatttgcattctgcagaattgccagattcctgtcctctaacacaataatgagtgtttccatccagtggtgtgaagcatgtggaataattagctctcagcgttaaagatgtgactagtaacgtccaagcctccttcctcttaagagtatgattttcttatggtgacattttcaagaggacatccgtaatctctcattttggggacagcaggaaagagatgtgcctggatatatcctatcagtgttcgctgattcgccttcagctaaatcatttaaccagaccaagggaactgagatt

SEQ ID NO: 124837 - DNA, 1086 bp, Homo sapiens
ccttctttatgcctcactctttgttctgaatcctctcacagaaccttttaatctctactgcgcttcctgacacttactttgtgccaggtactttatatttctcccgtatcctggctgtatccctgtgaggatcatagccccacttcacggatgagaaaactgaggcacaaagaggctaagcaacttgcaaagacatcacagatagggactaataagattcaggttcaaacacaggcagtgtggctccagcatctctatgctgagcatatatatctgctgctgcttctcatatttctaaggtctttcacttgtctctcttcccctaccacattgtagaggggggatcatgtgttaaatttatctgtatttttttggtgccaagcccaggggctggcatgtaggaatctcataataaacactgattgaatggctatttaggcaacgagtatttactcagcatctgccatgtgtcaggcattgttttaagcacccacctgaaataaataagcaagaaaacagatcaagagtcttgccctcaataatggaggaggggggtgacttagattctagaagaacatgtcaagggcaagttaggtaaatgattgaggtaatatttagatgacatttttactcctgtatccatgcttctctagttctcttcttttaaattttgggtatgatttgaggcaactacagtactggaaattaatacaaatccttcatttgtcatatcagagctctgtaactggtcacatataagcgagctgtcagtggtcgaatcatgactgcctgttgcttctcaatggtttgaaaacagttttttgaaatggcattacatttctcatttcttcatgctcttctttcttgcttatcttttccactttttttctgctttgctccacctgttctcttgagaaaccatctcaatccctcctgcttcttcctacctcattctctccctcccttgcttcttaatttccgttcccctgaaccttgccaaatatgtttttttgaacagttgatcaaaactcatcaagcacaatgtgattttctctttcaaactgtaggtaaaatggagaggaatta

SEQ ID NO: 124838 - DNA, 1127 bp, Homo sapiens
aattgcctggcaaatcctgcttattttgatctgctccatctttctcagctttggcaagcaagcacaaagattgcaatttcccttgtatgatcccagaaagcagattgctgaatcatgagtcctaacttcaggttgaaggtgaaaataattccttcagggagtaatacatagctacagtctgcagaattaagctgataagagatgacattgcattaggaggttacaataataggatcaccttaaattaagctccctgaatgaataaaataagcctattactctgtggttcacctcagccttgtaaaatgcctggcacatcagaagttctggaaaagtgtcaaatagatgacataaaaaatggggtattctgataatgcagtgatgggatttgaggattatcataaacgattcatttttttttcattcaacaactatttctcaacctctcactttgtgctgggtaccgttctaggtgattcagcagtgaataaaagaaaaaaagttatttgtccttaggaatcttgcctgctaatggggaatacagatgatttttttaaatcgtgaaaatgctaagagagaagattaagtgggaagggagctctaagatatcatggtgtatgctgaaattttagcaagggtggaccatgcataaattaggaaatttctaagaattagaatacacaaaaggctgtggtatttaataccattcacctagtagagcacaaagaccatttgtggggtatgagggaaactgaaatctaggtctcgctttgtcacaaattcattgggcaagccatgctctcccctgggctcagcacgcagctgtcaaatggacaggttgggccatgtgaactccacacctcttacagctctaaagttgtgtgagcattcatgtttctttgatgatcttaaagacccttcaggatcttgcagttcagcacataaaaacaaattcccatgaaacacattttatttgagcttcctggtcatttagattctggataaataggaattttttgccatctatataatgcataataaaatcaggtcttataagatgcctataaacttccatacctttgtaatcattttcttttataatttcaggtaaggcaatttgcttccct

SEQ ID NO: 124839 - DNA, 1030 bp, Homo sapiens
ttatttcttgtaaatatagggaagtttaatttgatccactgtacatggatagttttgataagaatgctccctgcttttgattaaatattccctgggataagaacaagaaatactttcctatcaactaatgcatgccctttgtaactctataattgtcaatcatcaagttattgagctacctgtctctgtgtctaaaatgctttgctgaagtcccccttgtctgcttcattttctctggtctctcaggtttgtggattgggttggctcctagggcaccaccatttttgactccctttacagtctatccattattatttctgggatcaatttctagctgagccacctgtacctttgagaattctccctttctcccttttaaaaattgtaggcatttgcctaattccttgattctgtcccgctctgatggatcatgtcttcctcaacagactctcccagcgggttggccatgtcatttgattttcctctaagcccatgacacagtttgcccagatgtgagatttgaattcatttggagcagtagatgttttcgtcctacccattcatcacgccttggggtctgctttctttgttttgtccttggcaatccaaaggcactcctccttagtaggaaagccaatggcagctggaaaaggaattgagcgctctttttgacctccatcagcaccatactatgaaaggcagccaattgtctcaggccttctttgatgttctcctggttctgagcctcacaaagttctttcaaatgttactttcagtctttaagtgaatcttattaaaatgggagtacctctgagaagggttatactttgaaacataatacaaccagtgaggtgctaatatctttgcaaagctgctaactcagcctatgcagttgcaggagtgggtgtggcttttaaaggaaaacaccctgaattgctcacttacggctggtctgaaaaatgtttccttcccaggacactgtacctggcaccactgaatggtgaagagccgcccattttctttaggggaa

SEQ ID NO: 124840 - DNA, 1100 bp, Homo sapiens
agtgctttcctactgggctctgggtgtataagatgattacgatattgcaccgttgaccttcatcccagtgcacagggtcagattgggtcatttctgtgtgagtacagttgggaattgttaccactctgagaaccttacacagttggacaacgtaagaaaaagagagtcccccgcttagatggtttttatttatttattgcaattaatgaagaattcatgaaggtggccttgctgaaacttgtcttttgaaagtaaatttggcctctgattgaccttccagagacaaattcatgttcttggatgttgtgtataagtgtgtgttttagaaaaacaaagtaataatttagcatcaagaacatatcattgaaattcttagaaatcccataattgcagctgtgtgcaggcgtattatatgaagaaaaggaaaacaaccccttaactttgaagccttgcttgtgctcagaatacatcacagaaaaggaaaggggagagcgttggtggtgttattgcttttatttttagaaaaagtagaggctcagacgaaagtcccgttgcatacagtgagtccatttaaaggtgtatggtatagcatgggaagtttattacagatgtgaaattaggtagtacgtagcaaggatcaatgtttattcatactctaaatttaacccatttaaacatcgcagtggggagtgaatttgcttgtgggcctgaaattctccctacgctgccatgtggaacagagacagagttatggaaaatgtagaaggatgtccaagttccctctccttttgggcaacgtatatgactccagtttataaaaagcaagtcagatcactacaaaaaataaattatcttagtcatactcaggtcttgtcttagcctttgctatggtctagggggtgacggaggacatctgtcaaggccctgtggggacagaaggcacactcagctgggatgttgaagagcagttaatggagggtctgttgacagaggtgtcggcagattgagagaactaagagagtctgaagcatctgggagtggccaagagtgggaagccattcccaaccccgggtctggagggggcaacaagaggaaattgt

SEQ ID NO: 124841 - DNA, 1081 bp, Homo sapiens
aatatatatgctgtaaagcaagaatagtaaaaatgctgtagaacctagatgatgtgtatatgggtgtttactgtaaaagtctttcaacttttctgtatgtatgaaaattttcattataaaacgtcaagaagaaaaaatgaagactgtgtgagaagagtggcaggatgtgctctggcccatggaacaaagacattctcttgggtgcacagccctgacaggtgggaggatgacttggcatgagagctgtcgaaaacactataagccatgctcaagaatttttaatgtggaatagagaacttttctgaaaaagcatagttgaaagcaaggacaagcattaataaggcacttctactcttttatttattaccatgttgggaattattttgggaggagtgcttgcttcagaaatgctaaagtaggtaatttgtaaaaaaaaaattaatagagaacaggcttctggattttatgtaatcattacaatatagagcaatgagtgctggccctgatatcaggaattgggttttaactctgaatctgctgctatccctgggcaggactgtgggcaaattagttaatcactctgaactgcagcttccttgtctataagaagaaggcaaagatacaattccaccctcctggtgggagaatatatgtaaaagcattctgaaggtcatgacgttatcagtgaacaatgagttctcaaagggggcaatatcacccctaaagtggagaaatttggttcttaccaaaaaaaaaacccttactatttatatgtataaagcacaaatacctatatagaacataaacagatatacagtctatatgtaatattaaaattcctttgtggggaggtgcttgagagaaaacctgtctaaaaaggctccttagggagctataatgcaaaaacagacaagccttgaatttctaccatctcccagattctgttctcctttctttttctttaggtagattaattttatccatcactttgaatacttaatactcttacatttctaggagagagagaaaaaagtaacttctgggagaaaactaagaatgatagacactttgccttttccaa

SEQ ID NO: 124842 - DNA, 1039 bp, Homo sapiens
gaaactgatatttctagattcttgtccttccctgagagggaagtttggtcaacagaaactgatatttctggacaatattcctatcaggaaacttgtacctcaaaatatgcccccttgtgcagatatttttgtatttatttgtcaaaaataaattgtggaggaaattaataatccaattaataatcactttgaatgagccacccaatatacatttacctttttgggaaacggtaaatcaagaaaatattgcaggaagacaccccaactctctgagcagtttgatggacgggtgtcggtggtgtggattttcttggacactaatgatgtgatgtttggttgtcccaagggacactgggcctggtcacttgctggggctactcattttgttagtagtttgttaagttacttggtacgaatccatccgtttctctctgacctatattgacaagtggaattattaaaggtctcagccttgccagagattctgtttcccttaaaggcagtcagtggtccattgcgatggagtcagtgactagaaaagagggactggaaacgtgaatggcttcactgagaagagtgggtggggggagggtacctgtttgctttgctaagggcgtgtcttgaaggttttaatgagtgaaatgagcaggtttcctaatatttctcaattccagacacaccagcatttccgtttccaggtacttaaatttcgttttctcatttgttttattgatcgtttccaaatgaatccagagagacgatgttacctgtgtatccaagaatactaacgcagtaataattggcaaaaagagattacctactccatcagatttgagtggctcccagatttctctccagtcatgattgttagcagtaaacttgattttaataaccgtagatgagatggagaggcagggaggaaggcagaaaaaaaaaaaaagttgtgatggttagccaatagtgatccgtctccccactgattctttatttagttggatttaaaaacattatgatgtatgtgggccaccattcggtgcat

SEQ ID NO: 124843 - DNA, 1030 bp, Homo sapiens
aacgcatttcagaacttattccatagatggattatctactgaccttcacatcactgtaagcaacaaaggaataacaggagatttaacatgagctcagacatttagtgttaaacacatttcacatatgtgaactaatttcccattttatcctcagaaccactttgccaggtccgtagggcaggaatcaccatccccatcttattgaaaggctcacggtggcagggtgaggaatcagacccaggcttcctgattccacgctcaaagcttcttaaatcaactgagcagttgtgcctcattctgtgctcactgcccttagtgctttgagcgaacacccttggttttgggccatcctgaggcaagtgatgctaaaagtactcagtatttacatgatctgtttctgaaaacagatcatgtaagcagaaaactgctattacgagctataataactagtattttcttaaaaagtataccctacgaatccaatgcatatgacaacagtgtttttgacagcacatttttattcaataaatatggtttgtcatattaaattgcatctgtgttttagtggggaaaaaatgatccatgcccttaaataataaaagcacatttaagaatatattataccagtttatccgtttcactgttcattatagcagcaaaaattagaaaatgaccttaatgtccatcaatttgagactgcttaaatggattatggtacatccatgttaaggaatatcacacaaccccaggaaaggaatgaatgagaaccctcatatgggctgatgtggaatgggcacttggaatcgttatatggaaaagtacctagcagtgtggtgtgtggagtatggtattatttgagtaaactagtagaaaaaaatatttttattgatttttattttaaaattgtatgtatttattattttttaaagacaggatctcactttattgcccaggctggtctcaaactcgtgggctcaagcgatcctcccatctcagcctcccaagtagctgggattacaggtacgagcca

SEQ ID NO: 124844 - DNA, 1033 bp, Homo sapiens
acaggtgccaagagaggatggttttaaaaggccagaggtcatgaggcaagtgttggaagaggcaaagatctgaggggctctgatttggcttcaggacctttcattagagcatcagtaattcttagagtccagaatctttccaggtgtggcttctttggacagagccatctcttggtatcggagggaagcaaatggctgctagtggagggaacagagccctgtccttggctgcataggcacagggaagcagaacagcggatcgggcttctggaagccttgttctgaggcaactcctttgctaccaatttgtttggggactttagacaaaccacccgcttctctgggcctcagtttcctcatctgtaagatgagagggttgcttagatagatgcttaaaagaaatagtaattggtcttgtctcacgatgttgttccacatcacaataatgattttctctactttgtgctgtgtagcataaatggttatcatcaattctattctcatgtagggtaactgaagccattctcctccatctgtattcctggccaaagtaataaatggcagggaaaccacatgttttgagcaaccaatcaagtatgtatttctcaaggacatgcccttagtttactcatttctctattcatttagaaacatgtaatgtatgctacacagccaggcagtgtgctaaagacaggaatacagtgattagcaagacagtcaccaccatgtagaacttagggtgaatagagccaaaagaaagagtgggagacccaggggaggatggaggggtgactaggagttaaccagatgaacaaagaaggatgatatcagatgagatggactgtattctaggaaggtccaagttgttagagtaatggtcccaacttactgggattttatacacatacaaactcaaaatttaagctatatactgagcagaagacttgtttattttcaggcaataaatgtttatattctcgggatctggagaatagccaaagactaaaaaataggcctagaggaaggggccttc

SEQ ID NO: 124845 - DNA, 1088 bp, Homo sapiens
ttcagtactctgcagtggctgctcacgtcactcagagtgaaagtgggagtcccattccttcccagaaggccctaggtcccttacctcaccttctagcacctaccactctagctgttcctgatctttgctatttctggagcctaccatgcttgctcctatttcatggccttgcatgtgctgtaccctctgcctggaatgttcttcctccagatgtcagcatggctcacctatcacctccggcccgtatttgcccaaatttccaaatgtcaccttctcatgagaccttttctgaccaccttgatttaagttgtaacctccctctcacttcctatccttgttcttgctttgtttttcttcatggttcccaacactttttaaaagaatatacaatgtacttcttagttttgtttgttgtctactctcttagagtggttgttccctgttctatctcactggcctaatacagtgcctgataaataatagatgctcaataattatttgctgaaataaggaaggaagagagaaaggaaggaagcaaggaaagaagggagggagggtaagagggagagaaggaaggaaggagctatgtttgcaacatatccaagaataattgtattgcattaaaacagagcataggccaaattgcatgtggtcatttcagactgaactgtgttcccctggaatatttacacttgttcattagcatgacagtctcttttccagagcagggagtggcttgagaggtgtctgcatcaatcacacacactctgacattccatttgggaagggacaacacagtcctacgcttggtagagctagtcttcccaaacacaaatacaaggaccaattgtagattttggaaatcccagccaccactcacacaggagaccagaaataaacttagattatctttggaatgtgtcaacatccatgtttcaggactactgcattcttaaatatccccaagaactatattgagcagtatcagctgcacagctgtgagtggcgccaaggactattttgtttgggtgattgttcactgtaaaaagcacagtagggattggagatatttttatttgtgaaatttt

SEQ ID NO: 124846 - DNA, 1040 bp, Homo sapiens
cctgcaggtataaggcaggagaagctggagtctggatctgcttccagatttagttgtagaatagctctttgataagaggtaattgtggaacctctctggcccttggtctcttcccctgtaaaaggtggaggagggattagacaatctcaatggttaagaatttatcatccatgcacactaaatctaataagagttttataatatactttaaaaatcatttttatataatggaataagaacatagtcattgtaggaaactcaaaaaaaaatgcaaagaatatagaagaaaataaatgtcaattaaaatttttccacccagaagtaactgttgcttatcttcagcagtttgagtgaatgtattttgaatatattttggtgtgttttcttctgatattttctgtgcatacctacttacaaatctgggaattatactatacatggctcaggagcctacttctcacctaacattataccagaggcaaatcttctcatcattaaatgttcttttaattgtctttgttaatgtctacataataccctattacattttatgccataatttatttaacttttcccctatattgactgtttaggctttttcacatttcttgatattgttttgatgaatatctgtatctctatatctatccatctatctagatcttagtctgaagaccttttcaagagaatcctagaaatagaataattggatcaatgcacatgaacttttcccggcttttgatccatctccaactttttttttccagacacaggccagttcacacaaacaccagtgggatattaaagaactctcctcaccacaccctcatcatcattcgtaatattgattttcatttcatgcactgccatgaagcagagaaggctgcaacagcaggacagtgtttggaataggagtatagctcgggcagtcaacacctaaggaagattcagactcaataaacagaactgtagagctatcagcagcacagacactgtggttggaatacagggagacatacaggaccaatgatgacattttc

SEQ ID NO: 124847 - DNA, 1049 bp, Homo sapiens
ttattggttgcctccatgtttagccaactcctttactttttaaaatgccttttttggaagtagctcaaagacttggaaccttttaattatcccataatcatgtcttatttatacctgcctggatagtgtagagatgggaaaacttcagtcaaaaggacacagtaattgagttctgccttccagaacttgctgagctaaatgcaggttatagcgaccagcttgggctatcttgggtttgtccacacagtgccttgttgtgggtggtcacagtcttactccttagctgatggcatggcctataatctgtttctccacgttcctttctgactctgtcctggggcatggtggatcgatgaaggattttcaaagatcaaagcacatctctgttttctcaggatctgtttgcaactgctttactggaaggaaaagcccagtgggggatcgctcctgctgatcttcattgacatgtctgaggctacctgcctttaaatgactctgagctttctgacatttttcttctttttggatcacaggtccacacgttccgaggcccacactggtgtgaatattgtgccaatttcatgtgggggctcatcgcccaaggggtccggtgctcaggtagacacagaactttcttcttttccaattatatgaaatgccactgtgctgagctggaggatgtctctccagagctgggaaatgtgctcagattagctcaaaagtctagccttctgcagggttcaaggcctgtctgtgcttaatggggaaactatttcaagtgtttgcaggaatgaaaaagaatatatcatgtttatgcaagaaaagaaaaaaaaaaacaaaaagtacatttccttaaacacctacctgcctcttacaataggcagtagtccgtaaaagaaaaaaaaaatcaattccaatggaactgcatagctagaaaagccatactttgtcctaccccatcttgctacaaaaggtaagacataaaaatagtaatagtgctggtgaatatttaccacataccaggcaccagttaatctctatttatcatg

SEQ ID NO: 124848 - DNA, 1023 bp, Homo sapiens
cacttgaagtgttaacagtacttgaggaatgatggaggttcagacttggattttatcagatatctaattatgccagtgaacacatcccccatccagaatcagcgtggtcctggaaaccaagctgtactgccatccccaacacaagctccagtgcaccaacatctcgtgcattgaaggaaccctagagtttggtgaataatgcgtgactattgtgactgttatgggagttcagaagtgtgaacaaatgctttaggatgggaaatgggaaatgagatcagggaagacttttaggaaaaggtgagattcgaattgtgacaaaaggcttatatttggatatgtggagctgagatcaataagtgtcagaggctgatagaacagcatgatcaaagtcataggaggcagaaaacatgaaagccaagtaggctgaaatgaagggcatgagaaagaagtagcaggaaataagttgagaaggttgattgagaccagccttggagagtctaattcaaggttaggtgtaaggcatttgaactccatctgtaggaaggcgttaattcttttctttaaaaaaaatttttttaatgagatgaaatcacataacataaaattaatcattttaaagtgaacagtttagtggcatatagtacattcccaatactgacaccaaacaatttttaaatagagtgacatgatcagaagtgagcttcagagattaacttggcagcagtgtgtaagagagactgagaaaggaagcagaaagaataattggaaaactagcactagaatccaggcaataatagtcttcacgagggtagccacagaagacatggagaggagaggataggtgagagctgatggagacatttgacaggactggatgggtggcctggtagaagaggagcctgggaagggagaaagttcaggaatgaaggttcaggaatgaaggatatgggagttatctctgtagacgtgagcaccgaaactttaagaatgagtgaaactgccaagagagaaaagtcagcaaag

SEQ ID NO: 124849 - DNA, 1030 bp, Homo sapiens
ttccaagtcagcaggaggacatggcaagtcacagtgtgtttacttacacggtgcagttcaaccttgtgggctaaatttaacattccctctctgacttctcagctgtcttctgctccagtgtcggccctgatgagcgccccgatgatctcccgctagaggtctctctcaccggatcttttttttttttttttttttttttttgagatggagtctcactctgtcgcccaggttggagtgcagtggcggcgcgatctcggctcactgcaagctccgcttcccgggttcacgccattctcctgcctcagcctcccgagttgctgggactacaggcgcccgccaccacgcccggctaattttttgtattttttttagtagagacggggttttacggtgttagccaggatggtctcgatctcctgaccttgtgatccgcccgcctcggcctcccaaagtgctgggattacaggcgtaagccactgtgcccggcctcacctgatcttaatatagtgttcgccaatcctctcctctcctgtgcggcaggaaggaattaacaattttgtggcaaaagcgaccatatacagtatatttagacttaattggttttgcacaaaaggacatatccatttgcacactgaaggccactttacacaaaaccagtcatttctccacttcatctgcaatatttattaacaattcaaccataatttgctgtcttaaaaaacctcctgccacctcaagaattcttgttactgtggttacaggatgcagaaacaggaaagaaaggattttcaaatattcactgaacgtttcatgttgtgcaatcctgatcatgggcaacgtcactaaaaagacagtcaagggagagaaagccattcctggacacttttcccacggcaaaactatgcaccaaaaactaaaaacacacagacaaaacaaaacaaaaaagaagccaacaaaacattacttccaagttcactcttgttttgtctcattaacatggtgcttgagtagtgacaatttgttgggtttc

SEQ ID NO: 124850 - DNA, 1013 bp, Homo sapiens
aatttgaagaacttgcccatgtcacaatgcccaaaccttctgacctcttgttcagtgcttcttccataatgcctcactgcttttcctggcatgttagaatctccagggacaagaatcctcctcactaccaacgtgtcacacactgtgcaggatctggtctccagcctcacggcaggcatgcacccagatcacctgagtctggtggttttgatctccgcctgcaagtctactcaaagtggattgtagtctcctttgggcattccacagtcaagaagatctttgtatctcactggataccatcttaattctcactgcagtgagacacaaaacaattgagaaatcactgggttctagacattgcaaacaataccccagggactgctcttttttatggctagagtggtcagtgcatggggtgggagccctgggctggaagtctgaatgcctaaatcggtttcttgcttttccactgccttaacttggggtctccagcacgttttttttatttctctgagcttcctgtcaagtgaattgctgatgattggttctataaatgtttataagacagtattaggtcctcacataccatcaactacataccccatttcatctggtttccacccacagccccttgggtaaaagtcagctctttgcataggcatctccccaaacttgacagccttgcatgaatgagaagcttcggggcccagcctgtttgggggggtggaggaggaaggctttcatgtgcaagagtcttctaactccacctggtaatgttctgttatgtttccacagttatctctaaagactcttcggtgagaagacagatgaagcgaaggtcctggggttccaggttgcagaacaacatgtcagaccccacccaccccatgctcaagctgtaattcagttggcatacaggcttggaattgagaatttatttattgtaaatatgtgatttgcacgggctttaaagcagtattttaattgacttttatttcggtaatattttttaa

SEQ ID NO: 124851 - DNA, 1810 bp, Homo sapiens
caattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaacatccagtggagtggcctcttctgttttgtgtctcgtgaataaacgtgggcctcagtcgcaatatagaaaatgtatgagaatggatatatttttctggctagaatctttagaaaacagtcagttcagcagtttcttgcatcatgtaatgttctgtggataaattcagtctttaaatataaaaccacaacgaaatatcacctcacacccgtcaggatagctactattgaaaacaaaaacaacaacaacaacaaaaaaccacaaccagaaaata

SEQ ID NO: 124852 - DNA, 1053 bp, Homo sapiens
ttggcgagaactcggatttgggaataaaaatgtccatgaaaacatcgaaggaaactgttacctgctttgactcaaagctgaccttgtagggttctgttaaataacgtggcttttctggattttctgtctgattctagcatgcaagtccttgacttacgcttgcgtccggcagccgggtggggtgggtgcgtgcgtgtgtgtgtgcgcgtgtgcgcgtgttgtgttcccagcctggttagaagatgcatcagttgcggaggaaacctatgctaattcaaaatggcagcatgaaaaataggccaggcggaagcagcacagaccacaaccatcagctgccccctgacttaagcctcagggagggaattagtgtgagtcaaggctcatccgggtatggagtagagagtgattcttggagctggctagattttagggtgctgcagggtcctgggagttgttaagtgggaagtttggagagctgtaattatttttcctaacttatcaaaagatgatacaaaacctagttaaaactctacggttttgtatgattttctccaggctcaactaaagttgactctgtggctgctgatgtctttttgatgcacaacctggaggtcgtttgatacctacaagctcttaaaagagatgtgtgcacattgtaaacatcatccaagagcagtgcacataacaaataccaggttcttagatcaagtttcattggaagaactgatttagcgacacgaggaagcacccaggcatgaggaaatgggaaattcttgaaaggtgactcattttagaattttttttttttaaacagcctttctttcccttttcacttccgtgctgccagccatcttgtcttttgggaaggagatacatgaggaggcaaatgcttcagggataatggaatagaggaggatgagctaaggtcggggggcagaggtggaggcagtcttaaggagcctgctgtcaaccccctttttacagcaggaaggctgaggccagcggggcgaatggacgccaagatcatatatctggctgtcaactggcagtgag

SEQ ID NO: 124853 - DNA, 1025 bp, Homo sapiens
ggccaggctgatctccaactcctgacctcaagcaatcttcccacttgggcctcccaaagtgctgggataacaggcatgagccaccacacctggccctgcctttgagcaatattttgtgtctccactttagcagtttagcaacagtttttttaagggaaaaagtttctattattttttaattatcattaaaactatgtcataaaatggctgtttagaaggtattatatttagttaatgaactaaatataataacagtccatgtctgtgatattgattggctcaatgtgggtatcttatgaatccaagttattaatgggatctgttattttgtaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttact

SEQ ID NO: 124854 - DNA, 1056 bp, Homo sapiens
gatgcaggggtgtgcgggaggctagatatttcagggcctcataggctggtttaaacactgtgatgtgattgtgtgtgtgcatgtgggtacatgcatgcatgcgtctgtgagagagaaatgatgagattgtttaaaagcttactctggctttagcgtagcgtagaacattttctggttacatctttatatctctcctgctgcatttattgtacttcactaaatactatgtattattattttgtgagcttcttttgcctcttgaattttaaatcgataggtattaattactgaaagttagaattcatcaagccctgataatagcgtctgaggtttatgtgagtgtatttctagaagagaaaagaagtctcttcccttaaatgctaagcgtattcaggtactctatcctccttcaatgaaaaatacaaaaaaaaaaaagtttacatgtattttcgtttacagtctggtttcatcctgccttttggacattccgggatttagtgccagtacctttctttagatgttagaagattaaacttgggatgaagagagtaaattaaaaacatgttacagattcccacattgtgtgagacatacttctaaagaagcactgtgtttgttatttgtgtctttcaagacctaaaatttagtcaaggagtattatacatgtagggctacacattaatactctagaacgctggttcaggagtcagagagacctgaagcctggcaaacagccctattactgccaactgcagggtcactttagcatcctgagccttagtatcttcctccatttaaaataatgggatttactagtttataattgtaagaactgttaaaaatttattagtacttacaatgtgccaagcacttttctaaacattttacatggattaactcagtctttgcagcaatttcaaaaaacagttgcctttattatgcccattttccagatgaagacactgagatatagagacgtgggtttgctgaaggtcacacagccacttattaagtggcttcagagtcagtgctccattagacaatacttttaaaggt

SEQ ID NO: 124855 - DNA, 1026 bp, Homo sapiens
ttcttagtggtaattggacactgcagaatgtttttcccaggtaagagtagagcactgcattagtaagtaaacagctatgaccccattttatagataggaaaaactctctggcagaactgaggccaaaactctgaaccccttagctctgctcccagttctgacaggagtgggtcagactatattgtctccttctttgtatactggtgattattcggtatattgccttaataaataatgtatactactttgaaagactggagatctactttttctggtttttcttgttattatgtcttcacctgtcacatttgcaacccatactttaaagatttgactttgggcatatgttctgtgtggtatcctaactagtaaggattcctcttctgcatagtatcctaactagtaaatcagttgtttgttctggttactgcattatcatcattttgtcatttagagtttgctgaaaacactgaaaacttgaaaaccaaaatgtcagaactaagactctactgtgacctccttgttcagcaagtagataaaacaaaagaagtgaccacaactggtgtgtccaattctgaggtaaaatattatttattaatattattaatatacatgaataatataaaagaagtgactaccagtatatccaattctgaggtaaaatattattttattaatattactaatatacctaaaaagcaccagacgttgcttacaggtggtgtttactctcatctaattttttgactatcttggaatttactattttatagaggaaaaaagtaacaaaattaaacaaagagaagcaatagtacatttcatcatatgcgtgtgtatagctttccttcctggaataaattagggattaattaattgataatatttggaacctttaactttagtactgtcatactaaaatatgtttctctccagtttatattgttttgttaattacagtcttgcagagccatttctatagctatggctattaagatgccaacttattgtctttcattgatgtgcatc

SEQ ID NO: 124856 - DNA, 1049 bp, Homo sapiens
tttctcttaagacttagattgacatttctctcgtcttctctataagccaaaataactttaccaattataggtttacagtagaaaaacactttcctgtatacaaagttcctggacagaatggttgttcaccaacagtaatggaagggttgttctctcagttactataaaagctttaggcataatctctaaatacctgatagcaagtttctgagttactaatagtaaatgaatgagagctgtgctgtttccataaccaggtgccaattctttcagaaaaggattggaaaaggcatatttttcatttttattacattgtttacagagtaaacaccagtttttttgacagaatggtgtgatgcaacaagagtgtccccaggtctcattgcttttaactttgtgaccttgggaaagtcactacctttctgggtcttccatgtcttcatttctaaaaggaaaagaattaggcaaggtgattgtcaaggcttcctacttagaaattttgactcagtttctggggaactgacacatctcaaagaactgggagaagggtatcatttatgtctttcagaggccaaaaatactcccagattatagaacatgcatgatgataatgaatgggtattacagtgaagattaatgtatttcattatctaatcttctctaggtaaccaaaataggtcaggcttagacttcatcttattttaatgccatcagtctcacatggcagggatatttgcagcgtagaagtcagctaaggactttgggaagtgtttttttttttttatgacttttatttcatttgttggttttaaattgcagcaatgatctcagtcaagacccagcccaaattcttttgacacaccttctcccattaggtcatctggcccacattttgccaggtggaactctcctttggcaaggtataagcataacaaggaacagcttctttgtctactagggccaagtgggaagacagatgtgctgctgtacaaacactctcccatccttaagccagactccccatgctgtttggactcacagcacctttg

SEQ ID NO: 124857 - DNA, 1033 bp, Homo sapiens
tgtttatatgcatttttgaataaaattcttatttcttcaaaataaattcctagtagaactgctatgtcgaatactaagaactacaaccacagtttacagttttgagcacttaacatgcactagatgttgttttaagtgcttgacatacataaatttctaagtctcataatcctgagatagattccattattttccctgcttatagacagagaaacctgagacacaaagtgatgaggtaatatacccaaggttgtagagtaaaaacatcttgaaggctttaaatattattgccaataaaggtgctggtttttaagaaaatagattatgtaatgcatttggcaacagccttatcaatagaggagttaattctgtagctagattggccttttcaccctattactctccaagtcatgcctactttggaaggtttataagttttctaacatgctaacttgcagagccaaattcatgttaactaatctcggttgctgagggaaacattgtttacatccaaggaatttgacttatttatcagccaaatagtgaccttttaatctttcagcagttatactctactgagctgatagccatttcaggcaaggtggctgcctccatcttggtcactaactagccttcatttgacctttttggtttcctcttcaatcagactagacagttgaactctattactggttctccccttttttttctagagtgctgatggctgagtgtagaattctaggttaataaacattttccctccaaattttgaaggcattcctctattgtcctccagcttctactgttactattgtgaaatcctattctattatatataatctgttccttgtccctttcgaaatgttttagattgtttttccccacattctgaaatttcatgatgtgcccttttggtctttatcattcattatgctgagcacttgattaggtctttaaatctggagactcctatcctccagttctgggagattttcttttgttatgtttttggataactgccttctcttaattt

SEQ ID NO: 124858 - DNA, 1167 bp, Homo sapiens
tgtactttactacagaaacaggaggaagtgtgcgttgtcctggggaaaatgaatcctacttcttcagttatgttttatgctgatctactttattgcaaaacgctaatagtaaatgaatcaagaccacctcccctctcccctttatgaaaataaatagaagtatagaagataagcattcccatttcatcgcattatgtatctggtattagaaaaattagcaactgagcacagatgagcagcgaaaacacgatcccctacatttttgtgccgcttttacttatatatttgtaaacgtaggaactttggagacttagtaaagtggaatacgtagtaatttatccgttctcatgttctgtactatcagcacacacgccagcataaattaaaaacaggaatgtcatgtttcatttttcccatttttttagtaacgctttgcaaattcaattggaacgacgcttgacttttaattagctaccttgttttaaagtaatttttgcttcttaaaaatattcatccctcttaaaattgggctatttttaaaagtcatttgcttttgattttgagtaaaagaactctactggtgtccttaaagtgatttgatcacaactaacctaacagttgaagttgctgtagtccgcactgaagaatataaaaggcagtttctgagaattggtgattagtgcgagaatgaagggcaaactggtttttaatgtttatcattatctttttaaagtgaaaatttgcatttagcaattattagaagatgaatatttaagtttgctaaagaagggtgaataggaaaagccttgtcaagttaatagttaatatttatttaatatgctgatttctaaaaattcattttctaagagctgataattccctttgagaaacattatagttctgtgggtttattttgttaagtaaatgcattctattcagagcaagagacagttgagccccatgctattcctagtaagtaaaaatacctagttgcttaaagttggagataaagcatttatcttttttcttatctaagttctagatttgtgcactcattatagttcttttagtgctgttggggttgggtgactggggcctagtagtacagtgacactttctgaggaacttacagcagcctttctcacccggctttctggagacaattgt

SEQ ID NO: 124859 - DNA, 1635 bp, Homo sapiens
taaaaatccctgcttttaggggccttattattctatttgggagagatagtaaacagacaagtaaaatacatagtgtgttagggcattgagtgtaatggaaaaaaaatggagtgcaaaggctgatagagattctggggtggaggcctatctatagttgctattttaaatcgggttttaaggatgacctcactgacaaggtgacaattcaagcagaaagtgaaggagcaagtcatgaggatctctggggtaaaaacatattcaggcacagggagcagtaactataaaggccctgaggcatgagtgtacctgatatgtaggtttacttacagctggagtgcagagggctgtagaagatgagagcatagtggggtggcatgaggttgggacagaatcataaactgcctcataaccactgacctgtggtttgcggcttttgttttaaagagggatggggagtatttttgtgcagaggattgacataatctgacttgggttttaaaggattactctggctattgtgtgaggtggcaagagtcagcaaggaggcaaaaatccagatgaaagataacagtggcttggactgggtggcagtgctggaggtgctaagcagtggccagattctgcatatcccgtgttttgaagatagagccacctggattagatgtggaggtatgagagaaaatgaagagtcaaggatttatttcgttgttccttatggttgagcattttgtttgtttggtacagatgtaataaaatactgttgccatgaacaccctggtaagcaaatttttacattttttttttttttttttgggatggagtcttgctctgtcacccaggctacagtgcagtagtgcgatcttggctcactgcaacctctgcctcccaggttcaagtgattcttgtgccccagcctcccaagtagctgggattacaggtgtgcaccaccatgcctcactaatttttgtatttttagtagagactgggttttgccatgttggccaggctagtcttgagctcttggcctcaagtgattcgcccacctcagcctcccaaagtgctgggattacaggcctgagtgcccggccagttcttagaaatttatcagcgacatgggattgccagaaacaaagatacacttttgttcaaggcattggatctttattgccaaattgctcattagagatggaaacagcttctagcaaggtataatctttgggactacgtaaaattttttaacccataaaaacttgtgaggtttttgatatttataagtgcagattggtggatatatttcgagtaatgtcacctatcagagtcattatttcattcagggctctttttttagcgacgaaaatattagtgtgtcagaaaattatagatgtattcagtcatttgaatttcataagttccgaccatgtggaatatcctaatttttgcttgaattgtgattagtctgtaatagttctttaatttacctatttatatgtgagctgaggaaaaaaagaagaatgaagccatgcatacataatgggttatttatttttatttttattgtcttttttttctttcctttttgtggagaacagggtctcgctatattgcccaggcaggattatgtgtaatatgtttcag

SEQ ID NO: 124860 - DNA, 1027 bp, Homo sapiens
gaatgagactctgtctcaaaacaaaacaaaaacctgcttttgtagtattgtgagggttaaagtagtccacatacttcatatctccgtacttttaactattgaatgaacctcttcaatgaatgaaaaaattgaaacatccaagatttatgccgcacttccagtctcaccctcctcagaaagaccatgtgctttactctgataccgtattcctttctcttcccaactgctcagattttgcaaaaacaatccagttttcattatttttataatgtgtcttccttatatttacaaaattctcccctgaacatttgaattgagtttttcagcacatttactatgccaaacacatggtaaaaactttgtaaatattgaatgtttcccaaaatgtatttgataactacattattatgttttaaggtaagattattatcaaaattattgtcatgtttaaattatatatagaaatgtattgctctagaaagaagtggtaggttatgtttttatttgtataatgtaaatataggtaaattaatttttgaaccaaataggtataatatagattgtacaaatggaggcagttataaaattgccttagaagtaaaattatactgtgcttatagctcttttataatcatttgaatgtgttacaaagtgttatcaatgtgagcgtgttttgtgggcggttggagatggttggaaggatggttgataaggtaggtcagtgttttcattaagtgtgtgctgctgcttcagggcagaggctgaaaaacttagattattttagttacatgatttactacatctcaggcaacctggatgacttggcatttactaaagcaattcactgctttgctggtgcttcaacacccttcagtctgagagccctgaagtcttgatttgtaattctccagatttcctgtctatcatagcacttcttcaaaaacagcatatctggtcaccttgaaatctcagttccttaataactccttttgtccactcttcctaccaccttaccgtacgcagagtt

SEQ ID NO: 124861 - DNA, 1005 bp, Homo sapiens
aattgctgtgaaatagaatttaggtaataaagggattcttggttcctttagtagtttaagttgcacattgacttgcctgtcgaccgtacttaaaattacagactttctttgccttcccaagtccactttttgaaatagctgttaagtagctcagtgtccaaataataagtaaaacaggaatacgaggcagaagggagcattgatcacccacctctcaatactactagaaagttggctgcctaatctctcattattttgtatttatttgctattttattctgggtgcatagatttaatattatgttgacactttttatccttagtattgattgggttttccctcttttttctactctgctacctctatcccttctggaaccagtagtttaatggtaagtatttaaataagatttacaaagtttttgacctagtgaggatttttttaccctcacctatcttggtgaaaactttgtagacttcagacggtctctgtggtttcccaggttttcattgttgccttgtttgtgtgtagactgataaaactttagttctgaggttctcctgtccttgcatgctgtgtcaaatggcatccattgtttgtgtgtttcatagtgatgtttttcttggagcttgcattctcttttttgtcttctttctgctgtttttttttgttttttttttttttttttttttttggctgggggtggaggggtattggagtgggaaggagaaaagtctttctcacatctgtactacttttattttctatatggcatttggaatcctcccaaattttgccaggtagatctctgtaagatgtttgttctgtgtacattaaaagcataataactagtatctttgggaagaattatagactgagtccaagtccattgaatgatactgtttttattgacccttaattctgctaaatttgctatcaaattctgtgttgttatttcttgtttcacatttcaagatatttgagcctttcaagtgttttttaaa

SEQ ID NO: 124862 - DNA, 1982 bp, Homo sapiens
ctgggattacaggtgtgagccaccacgcctggcctatgggaagtgtatttgttaagatatccaagacttggtcccagtatggattttgatttgctcatggtacctaagtgtctgttcttatcttagccattcattccattggtgttttgttttggtattttggtatttgtttgttttttgccactattcacacgaaataatcccttggaaatctcaaaatagaccccctatgattgttgcatggttgtaacatttttatgtacaagatattgtaaatcgtttaattggttataaatgctatgagagagatctggtagagagatgagtggactgcagagtgtagtgaaaagagtcctagttctggccctagtcctgactagttttatgagttttgtcaagaatttttacctcactgagttttcttacctgtaaaaggagattagagtggatgttcccttagagtgcatttgcattctcacaaagttgagtctacctggcttgggagtaattacagtgaacatggagaagtgtaactctttttggacaacacggagggcatttgttaggtacacagtgtgaaacttaaaaatgtctgatcccataattaagtttgttttttgtccctaactaaagaaaaaggtggggcgggggggggggggttgggtataaagacgcctacagggcatacttaaagaatccttgtaagacatttaatgagtcattacagcatactgatatctaacataaaaaactgctttggatagcttttcattcattcaaatatttgagtgatagtgtgtgtcatgagaggcacactaatgactttggggctacaaaaaatagatcataattttcacttaaaattgcttcattcatgttctttccaaagagaatatatgaaaaaaataaagtaaaagaattgtcagactaggcgctgtggctcacacctgtaatcccagcactttgggaggccaaggcgggcagatcacctgaggttgggagttggagaccagcctgaccaacatggagaaactccatctctactaaaaatacaaaattagctgggcttggtggtgcatccctgtaatcccagctacttgggatgctgaggcaggagaactgcttgaacctgggaagcggaggttgtggtgagtcaagattgcaccactgtactccagcctgggcaacaagagcgaaactccatctcaaaaaaaaaaaaaaaaaaaaaaaaaaaaaaaagaattgtcataaaccagtagatagtaggaagtaatgattttccctagtggactgaatatatggtcctgatgtgaactaagctattcaagaatgtctgttatacaaattgttgtatactgatgttttataggttcatcaaggattgctttggaggatttatcagaggattaattagacatttagctatttagcctggtaaaacgcttgttgaacaaggttaaaacgtttcctgctaacttgtttcagaatgtattctgctatattgtgttattggaacatttgctgtcctgctattttaattttatttcagatatttttgtcctttattaagtcgctgtcatttttaagtgtatagattttacttaggtgtttcctctttggcctcttgagcaacttttcctttatagcagaaagtttacctattagaaaaccgtgataatttagagagaagttaggtcatctgcaactgatcctgcctgtggttatagaagttagttagcttgcattttctgggaaatttttcataacagataattctgtatttgccagactcagaacagatcctaccagtaaatgagataagttcatcttttcagtttagactccaggccttttgctgcgcttatgttttatatagtctaaagttctttgcttatggaagttgatttatttgcccccccttttttttactggcatgtttaaaacaattttacctttgaacggaatttgaaaaaaaatgcagt

SEQ ID NO: 124863 - DNA, 2832 bp, Homo sapiens
cccatggttgatcagtttcacagtattcgatgtagcctgtgtttggccattatagtttttttgtagtttcatttttaggggtgtctaatcttttggcttccttgggccacattttttatagtttcatttttaggggtgtctaatcttttggcttctgtgggccacacataaaatacactaacaatagctgatcagctaaaaaaaaaaactgcaaaaaatctcataatgttttaaggaagtttatgaatttgtgttgggccacattaggccatgcgttggacaaacttgttttaatcgaatcctccttcctgttttttttctttctctttttggtggttttcaagaagttgaagtaaacatacctttattcctttcttttaaaatgcatgtactacagtttgaaaaacattgtacaaaatcatatatttcatttaggaaattgaatacctggaggattagctgtgccaaaatctttttcccaatccttataaagttcggcatgaggtataattctagcctcactcatttggttgcagtgagtttcacatcacagtgaagggaggacagttcctgtgagaacacatgtgttggaactagagagctgccaaaacgtctctttcaccacccatcttattagttgtctctcacagtgcttctgttcctgtctacactctagcttcatgtggccttctttcttgtgcttgcctatagtttctgttctctcgtaagttcagcttacacctgagccgtcatggacaccactgtctctcttttacttacttttgacctttctgcttaagctctttactgctggccaatatagtctctcactgtttcttaatcatatttccaaaaaaaaaaaaaattgattggcctatgccatctttttgttccacttctgatttgtgcctagccaaactataagttggctatctgggttcaggtttccaaacagcttagtggtgtcaggggagggagcagtaggacagcaggggaacatggtatatctgaggactgtcttagcagcaagaaggcagggatgggacacttcaccttggtaagtgagggggcagaacagagctgaatacatcaaatagtccctattttattatgctagtttatttttaatggagtacttcaggcaaatacttagtagtgcagattgaataatgtaggaaactagctaatttttaagtgtcaaaaattgactgcaaaaacctgtaccccgatctgatgctagtttctgttttcattatgacttcagtgccatggtgtggcagaaagaccattaaagtagaagtcaggagtcttagattctagacctgtttttgctgttctgaaaggcttcacgttctgcatcagataaaattttaaggttattgaggtagaatagtgtctaaggtgctgtttagctataaaacttgtgactcacagtgtactataccaagttggtaaaggtaatttccacaagagtagtcagattacaaagcttgtaataacatgaaatcatgagtacaggttaatgtaaaaaattaaaaacgagaatacctggaccagtacatcagagagagatacaggagtttgtagtggactgcatccctctcattttaacttgttttgtttgatgaggagatcatcttcataaactgatacaaaagtcagatattataatcacaaaattttcctgacttgagttgcacataaacagtgtaatgcagtaagtgtaatattgaagtttcaaacgctttttgattttccatgctttttaaaagccatagctggatattcagaatagttaagtaacttgagtttcttttgttttttaggatttaagtgccctgtatgctcaaaatttgtatcctcagatgaaatggatttgcatcttgtaatgtgtttaacaaagccacgaataacctataatggtaagtccaatggtttaaaataatattttaagttagaattaacttacattttatgaatttcatgtttcaagtataatttaaaaggagggaaggacattgttttctctatttttactagtgcattaatgcagtggttctcaaattctgtgatctcaagacttctttacacttcaaaaaattactgaggacttcaaagagtttttctttacttgggttatatctatccatatttgtcataaattaaaacagaatttataatttttaatttattttgttaaacataaatataattatgttgacaacttttaaatgaaaagtaaattttctaagacaaaatatttagtgacaagagtggcattttcaggatttttacaaactctttaatatcaggcttcatgacaaggaattctcacatctgcttcttcattcagtttattgtgatatggcacgtcttgtgtcctctggaaaactctgctgctatactggagagaatgggaatgaaaaaggcagatatggccaggcacagtggctcacacctgtaatcccagcactttgggaggccgaggtaggcagatcacctgagatcccaagtttgagaccagcctggccaacatggtgaaaccccatctctactaaaagaaaaaaaaaaagaaaaaaaaaaattagctgggtgtggtggtgcacacctgaaatcctagctactcgggaggctgaggcaggagaatcgcttgaacccaggaggcgaaagttgtagtgagccgagattgtgccactgcactccagccttggagacagagtgagactctgtctcaaaaaaaaaaagaaaaaaaaacaaaaacaaacaaacaaaaaaacagatacttagtgttaccatgaaaatagtttttactttgttaatctaaaaggattt

SEQ ID NO: 124864 - DNA, 1675 bp, Homo sapiens
cttgtttttggtcaggtttggatatttgacagttcttaatttcctgatttaactatgcctaagtcattaaactgttctgctagatcacttgtttggtgtcttaagaactaatatataaccttctgcttggggatactataacaaccaaatatttcgaattttaaatatttaacagtatttcaatctagaaattaataaatttcatgcaataagtaaataaacttgtaggcattcttaaagttgctgactgaaagctttaaaaaataaaaatatatatatttttgtttttagagtcaggatcttgctgtgttgcccgggctggagctcagtggctatctataggcacagtcatggcacacgacagcctcaaactcctgggcacaagtgatcctcctacctcagcctcctaagtagctaggactacaggtgcatgccaccatgcctggcttttattttttattttgtagagataaaaaattcaaagtatgtattaattgtataaacattcacagcaagaagcaaatacagcttcttaataaaaaccgtgtatagtttttgaggttttaaaactagctcttggacagtggccagttatgagtaagtgaaggagaaaggagctttgcctggactgatttggagggttacagagaggtggcaggttaataatgtactttcctatcataggcaaggggaattctaatgccacctggttttaaagtcagaccccccccaaaatgtctgtcacaggtgatgagtccaaatggaaattggctcctttaatacctcataagcaaaccatctaggattattataaagtagaacaaggtaaagccagagaatctctaaaactgaatctttttagtcaactggattcctcacaattttatatttgaattcctacatgttgattccatagagagatacatcagatacattgggcctctgaattgtgttagtgctcaaacaagaacatttttttcagcatactgttcatttaacttacacttttgcagccttttccaaagtagctagatctgaaattttgaaatttatttgttaagtgaatgttaactgtctataaacattcatagttataacacaagaatagtggggcttgttttcttcagactggatatatttatatagataagctcctgaattggatgagttccagaaattcaaatataagttgatgatttagagtttcagactctttgtcacagagatgatatttgaaatattggtttttcagactagctcaccaaaaccttcttatttttttaaatgcacaatatatctgaacacccacatcctggtacctgaagaagaaattggctgactaggtagaaactctcagggattgggcagctggctcggcagagatcccaatgggacgcccaaggctgtcagggcagggaaggattttgaatgatgtgggtggtattatctattgcagatggtattttggcagcttgaaaaaattaagaatgccacagtgagtattcaacaacatagattaccttcatgtgaaggactgcctgtttcatatacttttccctctttcatgtgcttcattgttgagtttatggacctaataattccttgtatagtctatgaatctaatacaaattttatgagtatagaggctctcttcatttccttgctccttctagga

SEQ ID NO: 124865 - DNA, 2170 bp, Homo sapiens
atcagctaacatttagtgccttttacacattttcacattcattagatttatttttaatcatccgtattaaagaccatgtgagatgtaggtattatcacttgcaatttattttatgaaaatgaggctcaaagaggtttgtgacttgtccaaagctcaagcctgttctttttccatgagactgccttcatttgcattatctcctaagatcttcacaaggatcctaagagacaggtcaagcaggttttatcattattaccacttaagattgcagaaaacaaactcagactcccttcttgcgaataatcacgtagctagtgttcagaacatacctgctctgttccaggtatctcactaggcatttgagaggtattatttatttctaccactaccctgtgaggtaggtactgttatcctgttatattccataataaattggaagagttggagtttgaaactaaactgtaaattaaaaaaaaaaaaattgctacgtattacccagattgctggactcttttattgccactatgagcctacatacattaaaatttaaacatttgtctaattttaaaagtatacagtaataagcttgaaaatcagataaagatattagctttgttgtgttttcaggactggtgcttttctctcctagtgattgaatagaaatgaacctgaaattttacttcaaagtatactttattctattttggtctgtattcaatagttccattttttttcttgttcatgtagacaactcatttaggaaaatatttgtttaggttttaacaaatcagtgtaattgattttaagttttagtttattgttgatttgtgacaatgagagggcataggaaaattatcttagtttgatttcatggttgggaaataacttggtaatctaataatttcctagacaacttgtgtgactacttgtggcttgttaggtaaatactcaatacttataaaatacttaatcctgagttagctttttaaggtaagttaggagcaaaaaggcccaagaaagctatgtctaggtgtggaattagtgctccttttgtatattgtagcttttagagtttgtgatttgtgttccattttattttagttacattttcttggcgaattcaccgaatttcgatttccagaatattcccaagagtataaactttttttaaaaagtcatcatcaaaagagtaacaaattttatttcctcctaaagaatagtcttaattttgcattaagtttctaacagtgcagatgaagagtagctacatgtttaacgatcaattcttagttacatttaaactagagaggcattgaaaaagtaattttcagtggcatctaggcagagaagcccagattaataaacgttattcccatatttttactgatatatttatcttacagtgaaaatggcaacttccctttgttaaatatcatttctaagcctatttatatttgagtacagtaatagctcatggatctgtaattgaaagaattagttaatgttacgttcttttatacgtataagagataacttaatatctgaaagtatttattattaaaacttgtgagccccaactttttgttctttgagtaattgcttttcactaatgttgtaaatttttttaattcttgatttttctagggattatttcacatttcagctgcttttgttttctactgctatcattgagggttcaagaacaaaaaataagtcttcaggtaaaatgcctgatccataatagcgcttggcgttgtattttgctgaaaagatcatatacctgtttggatgcttgatctgaaaataaagttgtgatgattatgaaattttcgcatgaagtttccttggctgcctaacaaattcagtcttatttgttggtttggttttttgtttttttttttaaagaattttggctgtttgcttttttttttttccatgtcgtcttgatctgcaataactatatggatatgtgcttggacctgctaagtattttaattttgcatatttggctgcttgaattttaagtaatttctttggacaatgcaaattttaagagcttgagaagctgtaagtgaaatatcaagtaacagaagtttgtaactagtttataaatgtatattcattacctattatatattttaaggtttcatattttaccaaaattaaatta

SEQ ID NO: 124866 - DNA, 1066 bp, Homo sapiens
tagcttgtggaggaggaatccagactagccaactatggtagttaaatctgtgagtgttcccttctctgcttctttaatgagttttggctagttagtagtctaccccaagatattccagttctgaagtgttgactccttaatccctgtgggtgttatcttcataaatgttttcaactgatctttagatttttaatcttttcccaactgtcttgaagatgctttagtatcctgggtttagtggtatttccaggtcctgtttttaagtatgaatgtatcacattactaacaagtctttcacaattgtgaaatgtagttacctatgtgaaggcaaaagctcaaaactttcctctgaatgaaagtgtcattataggggtgagagaggggactactctagcaaacccccaggtaggcaaaaattaatcacattccacagtgaattttcaaaactgaaaatatttttaaacatacaaagacacattctagtggaaacaagactttaaaatgtgaaaattaagcatttgctatgtgaagctgtaatcatgaggttttgaagtcagagtgaactatcttctaactcagagttgcttatcaaaatgcaactgatcagtggctacaatatgttaacattagcttttaattttctgagcagagattatgtcactagaagctatttttagtggatattaggctgtttctgcactgaaatcagtgtgttcgggatgtttttgtatacaggtatacttttcttgaacagaaaatacaattctgaagtacagttctgattattttttattgctagggtttaagggagcttattttttaaatgactttaacccagcattctgaattacactaaaaagattgtttaaacttagtacctgcaaagcatctgagggataagtctcgcccctgtcaattttaaaatagcattgtgttcttaaaatatgtatcattctgttaattataggcaggttggatttgtctttgttgtactataaattttcttataaataggataaaatgtagaccttttaaaatattctcatctcaaagactttgaagagct

SEQ ID NO: 124867 - DNA, 1012 bp, Homo sapiens
catttggggtgatttcttgaacttacccaattttattattttataatttttaaaattataattttattttcatgtctttttagccacattacactgtaaaattctttgaactatcttggtcacactaaaggaaaataaattcatggtacaaataactagcttattgataaagttatagagcaaaatctgcccaatttgggtgattctgtactgtttttgcttactgtaatgcttcaataaaatagaaatgaaaacgtgagacaatggaagtaaaggtaaacattattcagtcatttatgaatagtatttcaaatacacgtgctgagttttatgtatttctggcgaaaagatatgccaagtaaggtggaatcacaactttttatcagttagcattcacgtaattcttttttcaatttgatggataattttattgtcctgaattcattttctctttcttcagaggatgtactgagtaaagatgctggggaatgtgcaatatgccttgaagaattgcagcagggagatactatagcacgactgccttgtctatgcatatatcataaagggtaagttcaccaagttggtattagagtaaaagattgttctcacagtttcagacattgtaattagggctgaaaaggaatcttcgttgaaaccaccccctccctgtctcacacacacttcttaaaacttaatgatcttttttctctatttgaactaagacttgaacccacatctgtttgtatccaaaaggctactatttttaaagcatttgctatgacccagctgttgtccatagcttcttgaataaattatctcatgtaagccttgtaaccattgcattttacaattgagaaaataagctaagggacagtatggaattgccccaaggttacaaggctagtaaatggcagagttgagattccagtagatttggaatctgcttgactccaaaacctgtctgctttctcatatggtcttcttgcttttagagtgatacaggaaaaatttg

SEQ ID NO: 124868 - DNA, 1063 bp, Homo sapiens
ataacttgctagctgttaggcaagtaatagctagttagtagaccttgattttttcacctatcatggtactgtgaaatagaactttctaccataatggaaatgttctatatctatgctgtcccctagagtagtcgtgagccatgttgctgttgagtgcttgaaatgtggctagtgtgactgaggaactggatttttttattttatttcaataaatcttaaataaccagtgtgtggctcttgtctactctgttggacagtgcagatccacaatgacgatgatcatatgcaccctaatatttagcttctaataaaataagatcataaaatacttcctaaatacaaatgattaatgtatatttatttgtgtatgtatatgtattacatggtgggataggatttaaatattcaataatcacatataaatatagctttaaaaatgaaatattggcaaggattaaaatttaaaagccgttttttaatacatttataggtgacatgaacaggttgataatgtgcataaatgaataactgttttgaaaagaaaaattatgcaaatttgttattcagttttgaatattggtaaagtggtagttcagattatcttttggaagtagttctgtttgaactttaaagtactttatagcataattttgcaaaggtttttttcttaatcgcttagaatcaaaatataataaacattcttatctgttgcttatgtatgccaaatataatttaaaatgctcatttttttctgtaaaaaatatattaaagtcaagtatttttactgtggctctcattatataaataattagtataagtatctcaatttttctggttttgttcctttctagctgcatagatgaatggtttgaagtaaatagatcttgccctgagcacccttcagattaagcgtcagcttcctgttttataggtaattttttttgtaattactttttaaagcgttagcccaaattatacattctaaactataatttttatttattcatttactcattgaggtgcatgagtgtgtatgtgtatgtttcagacacttaggctactg

SEQ ID NO: 124869 - DNA, 3283 bp, Homo sapiens
taactaaagcaatgttcatggggaaatctatttttacacaggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatgattccagctcagataacattttccctgaagttatgctgtgaaatgccttttgttatgctgcaattgctaaaggaatccaaaacctccattgtgacagctgaaggcacagtttaataggtgcttttttactagttatgaaaaatattcgtcccttaaggaaacgattctttttctgtttttttctgttaccatgaagtcttaatttgatttcattttatttcacatttttgattttgtaagctttcataccctcctgctcaaccccctcaagtaaaacctcttagaatgtgaataattggttcattttctattgctggtatactcttgtgatgagaattattttgttgtcttccattcttaaaggaagagatttattacagctgtggggattaactgtattctcctggaagttgattttctgataggttaatgcaaaagtcattgcaaaaactgctattacttttgcgccaatttaatagttcacttgtttactttttaacctatattggcttaaattcactttttagcccctctttgtcataaggttctgtgctgcatttgctacaatagaagctcctatggttttaaagaaagttcagtgttttgtcagtgtcaagtgctacttgatgattatatttgtctggaacagtattcacttaagtctgtttatagcaatcccttttttgacaaaatttacaaagttggcatttttactttaaattccatctctatcagtgacttcctaaaaagagcaacttagaaattgggggaaaaatgtttttaaagcccaaatgctccagtttttattcaaagtcaaagtcgttattctggaaaatacaagtaatgttctatataatgtcacttaaaatattcgtaaatctattttgcaaacactgaatagtataagtaagatataaaatcacaatagatatttaaatactaagctgaaacttctgacaactaattattatgggggacacaataaagattgaaagcctaggttaccaagttggttttagctttctagaatctttgtaaatactcacgttcaaataagatcacacgtgcatatatagaaagcaatatgttctgaaatttcactttagtgccactgtttgtccataatggatttattgccaattttgaatcctcatcttactttgatctggcttttttttcccccccttgccagaatgtttaggagaaagtaaaattattccgttttactttggctttttgccagagatacaaactaagaatagtctgaatatgtgtttttcagatctggttacaagacggattatagattgtgttttagagcaatgttgtgattgaaatataaataatggtataactttttttgtgttagcaaaaacaacattaaaaaggttatgttacataatatgtaggttttggtttcttagtgcaagacttatatttctcttaaatgttgtataattatttcagttttcactcactagctactttactaaaatgtagccccaaaatgacgggccagcctcagcgtatctgccatatgtatttcaaagattacagtcagaatgagttaatgaaaatggcaggt

SEQ ID NO: 124870 - DNA, 2423 bp, Homo sapiens
aaagcatgaaacttgttgttttaaaatttaagaataattgaatttaccatctaattggcatccgtactgtgcattgatagtaatatccaaatcatcttattcttccatagaggaagcgctcatataaatcacattgctgagaactatataaaactacatagaggtaaatggtgcttattaaatatgagtatagtttgttacttgctggaagtcttctagttcatttggaccattttcttaccctgaggtgaactcaatatctgttggcaatgggtggttaaatgtgaagtgcccttgttcagtgtcccttgttcttgtacaggtattttcttagtttaaaaaaaaaattctagcatgccaacatttgtctttggcctattcctttttttctgaagtgtgtaacttctgattttttctttgctatgttgtaaataacagtagctaaattctctgttttactatctacttttcttttcttcccagatcatttcattctaaaattaaattgcttggttttctttagaggaaattgctacatggtatacttgtagtagtgattcatattaaaaaaatagctggtaaatctttctaggtagtaacttatccaaacaatactttgagtatcatattttgtgaatgacttgcttaaactgggaaactgaatattctttttaaatcatataattcctgtattaaatgtgaaacacacagtctccaaagtcacctgattctctgtggaaaatgaaaggcattgaaggaaaccagatacattaatacttagttttggttgaaagtgcaacattactgtacttagaaggggcttggtttatttttagatatttaagctatcattaattttagaccaatggctaataataagagagatttttggttgctcatttatggagagacaaagaacagcatggcataaacaaacatcccagaaataaatgaaaagttttaagtgataaaattgtgttttctatgaaccagtgttgtacatgaaccaacattgtgtttcttagctctgacctgtacagtgaggtacctgtcaggacccctagtcttggcactggaaatgacaaagttctcctattactaaattctcatgccttccttttctgacttagtagattgaaattggtaggtactaatgatttatgtttgataaacttaagttctgctgatatcctgttactggtaattctggtaccaaaatttcaaacggtttgattattagtagcattttgagtacctaggtgcatataatacagttagcagacccttacagagtcaaaagagattttggaatctggtgatactgttgtttattacactagcctattacattttctttctttataataactgtttatgtgagtttcattgaaaatcgtggctctattgctttattcatggtttccacaactctttttgtaacaccttaattttctctcttaggtattttcctgttaaataagatatcaaaagcatcaatcacaagacagagaaaacgtattaggaaaaacttgtattagtatattctaaactgaaatggaaaaactcattattcatattttaataaataaaactcccaaatgatcttgctaaattatcccactatttagaagtagaaaataagagaagagtgctttcaaggaaatttgtcatattctcccttctatctagaagttgacaatgaattgcaataaaactaagaaataactgaatgctgaaaaataccatgaattaatgttatggcttctttatttttgtatatccattcccacaaaattgaatttaagattattaatgaaaattctatattaagtaataatgcttgtattagtaatgggtaaagaagtctttctttgttacattaaccgttagtaaaagatgtactttgacatttctgatgtaaaacctatatgtaaatattgtaatttaaatatgattggacagctgttaagttttggggagggaagcagatgccagcgttctctgctgaaaagacaagatggcgcttgacggaccacagcagatggagctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaaaacctctggaggcggcaggtgcacgggaatgaactaaatgttaaagtgtgcctattacaggaggagctacagctgctgcaggaataggactcctgtgtcagggaagtagtccaggccatgggtaagaagaaagtgttggtcaaggtgcatctcaaggacaagtttgtcatagatgtggacaaaaatatcagcatcagtgatgtgacacccagttc

SEQ ID NO: 124871 - DNA, 1081 bp, Homo sapiens
atggaatattttgacatttgattttcccgaaggtgagggaaggtttcatgggctgaaggacttggtgatttaatatagacctccttttcctagggcactgccatagagtttagaatttagagatatcaaggaaaagattatttcagatgattcccatatgcaattagggagagccagagcttgcagtaggaccccggagatcatgacttagtagtaaacaccaaacgggtttctcctgcatgggcgcctgatgcaataatttgccttagctacagagggtggaaccctatctcggaaataattcattggggcatagctgccgcaaattcagccactttgccatctgtcctcttcgctggtttgagcctgaccgattttaataaatagcctttcattttgaaatatcaccacgggcttaacttttttcttcatgattggtgtcagaacaccgattgcatattctgtctccctccacccaccttccactccacaaataaaattaggtgtggttcctttgtcttttcttaacttgccattttaaaaaatatccttccctttagaaggaagcatacaactaatttggagaaaaaaaaaaaccaccacacccaaacccctccctctgccacgttagcctggaactgcagtgaaaatcatccatcggtagttaagacaggatctagttaactaaagtaaactttgatcgcggcagctttccgatgctactaactactgtcttgtgtattgtttatgttgtcttgattattgttttgtactttaagatattttccgaatatacgagttagttgatttaagttagtttggatatttttttctaattttccaagaacacacatatatcagttagttaattgtgtgaattactgagtcctatgtcagctgaaaaataatttaaagatgatctaattttacccattttttgtatatggggaaatgagacacactgtcacccctatccattttggataactccattgtgaagtgcaattgaaaacctttccggagtgggatttttacttaatgactggtcttgttagtagcacatgtttcatagaaatttgtt

SEQ ID NO: 124872 - DNA, 1110 bp, Homo sapiens
atgtgagcagttatttgttaacttgcccgtgtgttcttctagattattaaatgaagagggcagagaccttgattcataatgatcactcacataataaacatttgaattgcatcattctttttttttttttttttttttttcattttgagacggagtctcactttgtcacccaggctggagtgtagtagcatgatcttagctcagtgcaacctccgccttccgggttcaagtgattctcctgcctcagcctcccaagtggctgggattacaggtgcccaccaccacggccggctaatttttgtattttcagtagcgatggtgtatcaccatgttggccaggatggtctgaaactcctgatctcagatggtgaggagggcctttcaaagtgctggtattacaggcgtgagccaccacgcttggcctgaattgcatcattcttacatagactttttaaaaggcacgcttaaaaacacattcctaacatttcttaacttctgaaaccaatcctgaatataaattctctttcttggctagggagatcttgtgcgaaaactcaaagaagataaagcaccccaagtagacgtagacaaagcagtggctgagctcaaagcccgcaagagggttctggaagcaaaggtgagtcctgggatgctaaaataggaacataagtaggtataggattgttcatctttaatttctttggatgggagagacctagaaaagtttctgaacaagtatcatttggtttatctgtttatccataatgccgccttctcctttccctctacctggtagactcctcatcctttcaaaatgcaactcaaaatgtcaactttttaataaagccttcctgaccctgcaaatgctggactcaatacgctatatgaatttccatggaaaggattgtgctcttctttacgacttctcttatgcctgaaaataatgatttttgtttgtttgtttgttttaaggaaaaggtctgtttatttgatacctgctcccagacctttcaaacaatagatctcccatcaccaaacttaagttgttttggggttttaaagtaaccattttgctatagcaatccactgacaattcaaatattgctttat

SEQ ID NO: 124873 - DNA, 2137 bp, Homo sapiens
tgggattacaggtgcccaccaccaagcccagctaatttttgtatttttagtagagacagtgttttgccatgttggccaggctgggcttgaactcctgacctcaggtgatccacccacttcggcctcccaaagtactgggattacaggtgtgagccaccgcacctggtcaagcttagtcttgtaatcttggaaatgatcatatattttcctaaatgattaagtaaagatatcttttatattactcaaagggaaaaaaagacctatggcttctattgtttttaacctatcaaaatcttgtctgtttgataaattttatatttaattctggtgaggaataaactaaattcagatatataagttcagattcccacccacccctccactcactcactttttatttaatctctaacaggagctggcgttacagcccaaagatgatattgtagaccgagcaaaaatggaagataccctgaagaggaggtttttctatgatcaagcttttgctatttatggaggtaagggattaatgacaaaaagaactattgtgttgttagtggctctaatattatacttaaatcaagaacatggcttgcctgttggtatccacttgtatcaggccacaaagcagaggatggatgttttgcttttgtttgcttggagtcaccatttggtgtgatacctgttatttttctccactgcatttattcctggacagcactttttttgattaggatgtagggaattgttggaggcccatgtatgtatttgatgtgtctgtgtactcatgtactctttttaaaatgcaatggagactgaagagtaacagagggccattgtagtactggctaactatactatgccccttcacacaggggcagtgataaaacagtccttagattattctttatggtcatctgccaggagaaaacattcttcccagggatgtagataaatcactgtgaatgccatatgaaggtatataggcaaatacaattcactgatgaaatgtaaaactatatttttcatagtcaacggattattacaacaacattagacatatagtactttgccactgaaagttgacttgagtttggctaagtggatctgtaaatgtttacccttttgaggttaaatagtgcctcaaatacccaggaaaaaattagagaattggatgctaaaattatagatcattgttatcagatgtggtgagaaattattttgtaatttttacggcagaaaactgtaatctgctttttcattctgttctctaagggggaacttttgttgtagattttgggctagtcctacttgaaattacaaatatagaattagtaaatggcgtaagagcttttttattttacttccatcagctagctgaaagtaaggttcttcagtattgagggatttgcattgttgacttgaatacacttttagggagtataggtatcagtttctcatgtctccttgccttcatttgttcagagtaacaaggtaaagtatgtgttttcctctcatattctataggtgttagtggtctgtatgactttgggccagttggctgtgctttgaagaacaatattattcagacctggaggcagcactttatccaagaggaacagatcctggagatcgattgcaccatgctcacccctgagccagttttaaagtgagatcttactttggagtgggggtatcctactttaaataaaataacttattaaattatttaatatacttatctaaataacttcctgattataaagaactactcatttcatgtagaaaatctgaaaaatatggaaaagcaaagaaatgtataccttctgctcacagatagctatgttaagatgattgtgtttgtccttcctgttttttctgtacgtccctatgtatttcagtgttagcagtacactgcttattttcatgtaatattgatgaacatatactcatatcattaactattcatctaaagcatttttaatgatagcatagtattctgttttatggaagtgccataatatgttagtttgtgccatattgaaagcattaaagtgtttctcatttttgactgcaccgaatatcttgatagatggatttttgggtatatccttgattatttccttaatacaagttctga

SEQ ID NO: 124874 - DNA, 1552 bp, Homo sapiens
gcctcggcctcccaaagtagggcagaatttcagaatgtgaaactgaaaggaattcttttatttatttatttattttttgagatggagtctcgctctgtcccccaggctggagtgcagtggggcgatctctgctcactgcaagctccgcctctcgggttcacgccattctcttgcctcagcctccagagcagctgggactacaggcacctgccaccgtgcctggctaatttttttgtatttttagtagagacggggtttcaccatggtctcgatctcctgacctcgtgatccgcctgcctcggcctcccaaagtgctgggattacaggcgtgagccactgcgcccggcctgaaagaggaattcttgccattttgtaactcgtcattattcatttaaggttgactggtggagagctaatttttactattggcatccgttaggttctcttaataatttcagccaatgaagaggaggaattctgaatgatggctctataagatcaggactacctatcattttagctacttgttccaccaataggaactttgtagagataataccaatgtcagtacaggtttcagtggcagaaaacacttcccttaaggttcaatgtctatactgagctgccatgaattcttaactagtcaaattcccagtgattttggcctttgcttagatcactaataataatggcataggcatggattaattgatcctgaagaatagtacagactttatgacaacttgtagaaaagaattgtctttttattgtctagttaatgtcttctttcttatgggaaggaagaatgtgggagagggtgagaaatagatttgaggaagaattttctctggcatccattactgtcatggatacatcattactatagatatgggagcttccatctttgagatggatataaatattgatggggaattatcttataaggtaatatctatgtgtaatttgtatgagaatgacaaattgggttggcatttgttaatttaggacctctggccatgtagacaaatttgctgacttcatggtgaaagacgtaaaaaatggagaatgttttcgtgctgaccatctattaaaaggtgaggttcttcatctccttcaggtaggattgatcaaaataaaaggtttaaactttctctcagatgtctttcattaaattttttattgaggcataacattcaaagagcaaagtgcacagatcttaagtatatagatcaagtcctttattttttaaaaaagttatatgtagataattagttatatacagataatttttctaattagcaaatgaatcaagacaataccatgactgctgttgtaaaatcaactgtgggattcatgtaaattaagaactttatgcttggatttactttttaattgtctagcattgaaactgaaaagtgcattgtcctttttcccattgattgatatatgtcaacactgttcttacagctcatttacagaaattgatgtctgataagaagtgttctgtcgaaaagaaatcagaaatggaaagtgttttggcccaggtgagtac

SEQ ID NO: 124875 - DNA, 1043 bp, Homo sapiens
ctgttttgaagcaattctgcttcataatcctgattatgaatttatttttgttttctccaaaaatcatgttttacatttggaatctctaaatgtaatctccaggatgacaggcagttttgagtgacaaaagtgaacttgaagggaaaggaaggagggtggagactgtcttaagagtctcacctgctccaaaattacctttttccttgttcatcgtatattttgaggatggtaatatcttgattgtctaaaccaaggcaatactggcaatggtgatgtgtataaaagggtggggtcgggtgggggtagggtgaaagttgtggcaggaggattgttctagatatctagggcagacaacattgctgaagttggggtgaggatgtatcagtaaccaactggagttctggaaacaacctccgtccaggtatttggggggcctatatgacagaaaggccagcaagcaagcttaccctcatcactcacttggcctctattcaaatagcctacttttgtctgatctatccagggatgtgtgggaaggcatattggggctggtgagttctatatttctttagaaatttattatgactcagctgtttatgacttaagttttttgtgatttctatacgttattcctggtatcatctcttagagtaatacattccatataaaatacgaggtgtagctaaacataactttctaaggccccaaagtgttttcccagccccagcgcccacccatttcctgtcttctcttcttactcactgtaattacagacttgggtcataacatagcccagtcactgactctggatcaaagcatccacagcacctgcctcatcttgttagttcccatgatgccatctgggagaagatgcctatgttctgcgcaaactgtatctctaggccctacaggtttacggtttaggaaggagggacttacagaggaaagaatgtgcccaacttagagaaagttgggggaatgacccctctgagctttcatgtaaaaagaggaggtcatcagaaactttagccaggtatgatggc

SEQ ID NO: 124876 - DNA, 2680 bp, Homo sapiens
agtgttctgattcttcttgatggcagagttctctggtgattaatctttgcatagctgtatttccttttgtccttttgttagtttagaggtattagattgttcatatgaagatttttctaaaattttattttattttgattgacttatctgtcttcctagcctgtgtgtattttagttctctacagtttcaggtacagttgctgaactgagatacagttactcagaattctgatgattcctgcctcctatctatgagctgagattattgatgagtaaattttgtatgatttgtatgatttcaagtcacacagtgtggtgctttgatatgcttatacattgtgaaatgattaccacagtcaagctaattaacataattatcacctcacatagttactttttttttttttagtggtgagatctacttaacatctactctttgagcggatttcaggtatacagtgaatcattaactatagacacagtgctgagatttgtgacagaacagatggaaagactttggcagcagcattttggagattctaggcagggcccgtaatttatcctgtcccacattgtagatgttcagttgctgtcagcccaattataagctatgtgaggacaaacaccatgtttgtttctctcacatttatatgggcacagaagatgtttcctagttgttgaaagacaactaaaacataggtgcagcaggaccaaataagagacactattaaaaaataaaatttaaaaattaaacctcttggccgggcgcagtggctcacgcctgtaatcccagcactttgggaggcagaggcgggcggatcatgaggttcaggagattgaggccatcctggctaacacagtgaaaccctgcctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgagcgagactccgtctcaaaaaaaaaaaaaaaaaaattaaacctcttttgcagtgtatttcatgtatttttaggatccatttaagcaattttacattactcgtaaaacatctgagataatcatggaagcacaccagaaaatgtgatttttcttgaaagaagagagattgattttgactcataaaattaacttgaaacacttctcccgcaaatagctactaaattgcattcagagaaatctctttgggaaaccattactatgtgcacttcatcgttaggtaattagcttgatgttagcttgttcaattcatgccttatatcctttgccttgaataacactttatttaagaagctcttgctccaaagaaaccaactgtatgatgccattatcagtcatttacttttttgtagcagtaaaaaagaagaaatcaaactgctatgaaagctaaagaaccatttcatttcgcttttaatttcccattctttgaaatgggatgaagaaacttcatttagtgtatacttataaagacttgctaatgctttaaggaaaaccattttatctgcatgtcactattcaatatcttatttcttatttttcatgtgatttttgcgtatgttttcctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggccttgttttttgtttgtttgttttttgtagttaaatatgcaggtttatcgcttacgtttttgctttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacaggtaggattctggaggtaacttaacttagattgtgcctgttcagggtttgcagcaattagcaaattctatgtgttctgggtgacaagatattttattttggcagtcatttgcttttttacagtacttggttttgtacagaatttgttatacagtattattatagtaagagaaaaatcacctgaacatctcaatttgtgggccttggggctagcatgaaaaaaaatgtttagcagagcacttggaaaatagatcttggtttgcattgtgcctcaccaatctgactcaacagtatgtactactttgggggagacagcattggacccacagaaagcaagccatctgggtttcagactcttctgtattacccatagcagtggaataaggccttgcatataagcactttgtaaatatttgcctggagaagtgagtgcgtgaaaacttgccaacagtagctgc

SEQ ID NO: 124877 - DNA, 1041 bp, Homo sapiens
aaaagaaaagagatcttttcctgagcaaaacagaaaaagcagttgcctcctgcctttttataagtgtcctaaggagctcgttgtagtcttagatagctgagagacagagttagtgtatgatgggacagtgcggatgtgtacactgctgtacagtgtattggcagcattactggcaatatcctggagtggatctaagacacattggcctctccttcctggcaagagtcccagcaaacattggaaatggtggagaggttgaataaagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagcggagggacgaaaggcatttgcatataggagatgctgtctatattggtggcaggaggaaatgtggcatctaaaacaaggctgagagtcttttggcatttctcttattgggtgttagagaggcttcctcgcctacatagaaagagactttagtccaggggtcactggttccagtatacccttggttcagtttttacttttcagaatggctttctttttatggatttttaaaaattaaaaatcaaaattagtcatattttaaaaagtaatgactactttttttaaaacaaaaaggaaaaaataattctgaagactattatgtagaaaattaaacttccagttatatgcctctccccaggtgttttatgtctcttctctgtattgagcaaacattttctataaaggaccagatggtaaatatttttagctttatgagtctctgtcacataactttgttgttttttacagcttgtaaaaaacagcttttaaaaaatgtccaaactggctgggtgtggtggctcatgcttgtaatcctagcactttgggaggccgaggtgggaagattgcttgagc

SEQ ID NO: 124878 - DNA, 2802 bp, Homo sapiens
caatataaatccatccagaaaggaagactactttgtgtacagtgtgaattatatatttttttctttctttttttttttttttttaagatagggtctcactgtgttgcccagattggtctcaaactcctggcctcaagtgatccttccacctcagcgtcccaagtacctgggattacaggcatgagccatcacacccagatcagtgtgaattatattttataggcttattagctgcctgatatatgaggctattcccatttcaaatatttatgaaatttgaatgaagattatatcatcgaattatcattgaatatatgaaaggtttataatctgcatgcatttgtgaatgaacccaatataagtaataataagtaagtaatgtttttattgattatatctttttagggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgcttgtttaaacctattattttacctatccctttgttcctttcctattctctgtacttgtagtctgacgtgtgcccactcaatgtttggcctttaaaagaagcatatttagaaaaatgctctgaatatctttcagaacgttaatagtttttctcagctgtttccaaaacgcacttcacacctgcacctacctacgtgctctttaaataaagggtacctggtgaaagctttttccattaaaagatgagtgccatttgatagtagctgaaataataatttagctcacttggtctgaaaatcagcaaaatagaaattttctttctttagtaggcagtgaagttatgagctgatttcttaggggtaggtcagtgacaggaaatagatcttgttttgagcattttagaaatacttatcagaagttcttatgctatgggttgggtcattgctgattagataatatctcttttttctcactgtaactggaaaagtttctattgatggtgttaattttggatgagagttgtctgaatgattttgtggacaggtgtttcatcttgccttaaaatcagcataaacaggatctggagtactgatagagagctggcatggttttaagttgatgattgattgttctcaggctcattttctgaaatactgaggcagtgctgtagttttggattccttgactacttcatacaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaagggtaagatatcagatgtttactcttccatgggctccagtcagttgtgtcatctgccaggttctgaaaggatgagattaatttcttaagattttttgcaggtaagtactgtatcttggctgcatttaaaagactgtctttgccgagattttggcattatagcctgaaaaaagatttgaaatagaatatactttttttttttcctagtaactgtcttaaacaaagagacttgtccagccaggctgaggaaggaagggttagaaactacatctactatctctcaggtcacttctctctcctttttggaggtttagaatactctctgtaattgtttaagcatgaatataaacaatagagaaggccgggcacagtggctcatggctgtaatcccagcactttgggaggctgaggtgggcagatcacgaggtcaggagatcgagaccatcctggctaacacagtgaaaccccgtctctactaaaaatacaaaaaaattgtccgggcatggtggcgggcgcctgtagtcccagctactcaggaggctgaggcaggagaatggcgtgaacctgggaggcggagcttgcagtgagccaccatcgtgccactgcactccagcctgggcaacagagtgagactccgtctcaaaaaaaaaaaaacaaaaaaaaaaaatagagaaaagcctttaaagaaatacaacaaaatccagcactgaacagtgtaaaacttacaatatccagcaaacaataaaaattattatatatatgaaaaagcaggaaaatgagaagtaaagtcagtcaaaagaaacacccagaaaaaacaaacatgatgcagtaagtacataaggatgttaaagcacttattataaatatgcttcatgtactcaagggtgtaaaggaaaacattaacatgtgaggtgagaaatggaaaaatatatgtgtaatatggatataaacacatgttttttatatatataaacaacatgaaacatttagaggcaatatctcaaatgaaaatgtcactggatgggattaacagtagattaaacattacagaagaaaggtcattgaacttaaagacatagcaactatccaaaatgaagcatagaaaaaaatgagactgggaaaaagatgtccagtgggacaatatcaggcagtctaatgcatgtgtaattgagagtcctagagagggtgtatagaaaaaatattatacagtagctagaaaatttacaaatttgatgaaaacgctaaaactacagattcaagaagcttagccccaagcaggataaacacgaagatgaccacatgaagacccgtgagaatcaaatagctaaaa

SEQ ID NO: 124879 - DNA, 3576 bp, Homo sapiens
taaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgttgctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagaggtatctggccttctctttggcatttttagccttagaaatgtgtactgcttcttactgatttgtgttggattttgatgtgtttatgctccctttcctttttttttctttttaattttaatgaacggcttgtatcagacagagcccagattctcaagtcccccggtttaattatgaaaatatccattagcacttctctaatattttataaacatttgtgttgctccaggcttattctccagcagtttgcttttatacttgtttgtttattgggcaagagaaatatgatcctaagaatttgttgccatagttttattggtaggctttggagggttagacattttaatgttttatttttacagacgcgtatacatgtgtatgtataagcttttccgtgttcatatattcaaaacagtgaatcatgtttcagtagttttggtcaataggaaggcagtaatggagatggtagaagcacagaaggagaaggatgagtggtaagggaaaggaaagagtagctgctttaattgacatctgcctgcctaatttatcacctttgagcacatacatcaagtgcctgttctgtgcttagcttgatacagaagtaatagggaaaacagaagcaaaagactgcttttttttctgaaggagtttatagtctaatccagaagtcgtgaatttctagcttgactttttagagaccatctggctactctggagctgtgtccccatctgggtgtggttctcaaaagtgtggtccctagaccagcagcatcagtatcccctggaaatgtatgagataagcaaaacctccaccccagacctactgcatcataaactgggggtggagaggcagagggggcaggcagaactttcttagttttagcaagacctccagatgattctgacgtgcactcaagtttgagaaccattgctgtgtggcagccagtgtttggttttggctgaggaacagtagccttggtcagagctctccagtttgccagtcttatgtaattccctcacacgagttacttgactgagtcctgtttgttctaatagttaaatttaatacacatgaagtaacttcaagggacatggagatttagaaaagttaggaaaggctttgtggcagaattgagttgtctgggggaactggtgggcgttttgggctagaagagcatgaacccatgcctggcatgacattgtttggctctgtgtaaggtttcctgagttcaggatgaatcttcttcttaaaaatctgaacaagttggttgatacttggcttctctttccttgtctctagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctgaacaaacttgtgatctatttgcttgtgtttttacattttcagcaaggctgtttctcccacgtttgggtagacatgctcatggcttaatgttaaacacagttaacactttttaaaaaattaacagctttattggggtataatttacataccataaaaatagcctgtcttaagtgtacagttcaatgatgtttagtatatttacagagttgtgcaaccaccaccacaaaccaattttagaacattttcatcactccaaaataagtctcatgctcatttacctcactcccattctaacctcagcccaggcaaccactcctctactttctgtctattgatttaccttttctattctttatcttattctgagaaaatgacgcagtgtgcaggtactgtgacagcagtctccaagcaggtgaaatgacttctggaaaagcctgaggtgaggatggggtggcaggagtggtgctttagggctgctaaccccactgtttgcagattct

SEQ ID NO: 124880 - DNA, 1050 bp, Homo sapiens
gctcatgcctgtaatcccagcactttgggaggccaaggcgggcggatcatttgaggtcaggagttcgagaccagcctggccaacacagtgaaaccccgtctactaaaaatacaaaaatcggccgggtgtggtggcacgttcctgtactcccagctacatgggaggctgaggcaggagaatcacttgaacccgggaggcggaggtttcagttagctgagattgtgccactgcactccagtctgggcacagagcgagactccatctcaaaaaaataaataaataaagtaatgacaaaaaccataattacttttgcaccagcctaatactttggatcagaaagggattggaaccaagcctcacttcccttttcattggcaaatacatttgtcatgaggtagaggctggatattgaatctgcaagccctcttttgttccttcccctgggtagcaatgcgtgatttctcctggatcacctgctctaaagcaggtctctaaagtgatacctgagtgagggagacgggccggcagcagagctctctggttctgtctgtaccatgtttgcttgattttaagaacaagcagttgaagtgctgttttctaaatgaagagactctttacccacgagtttgcgtatgcatacgcacacacctcttctgttcaagcccaatgtgtatttaaagcatgggtctttctggcttaatgctctttgaggccttttaaattatttatatacctgtacgtaccggactgtgggcttaacaagagtgagataaatagcattgtatcttggagaagttactcctgtttattacttctcccaaaaatgatgggggaaggtcagattcttttttttttttttcttgtgcttagtgccaaattttatttttctttggaagactgacattaaacgtgagaaaaacaaaggataacaaaaattatctttattttcaaaataactttactaaactatactgattacaaataatacagtctaatgaaaacaaagccacttaaaaaagtttaaagaagacatgtatgtgtaattttctc

SEQ ID NO: 124881 - DNA, 1064 bp, Homo sapiens
gcaaaatggtggatatagatggtgttccagaaaaggaattcatcaccaagtctaaagaacatggaaataatcttactgttttcatgagctggtactaaagatgtcagacgtctcaagttctttgtgataagaacttgcaaaatcgtttttttcattagaagtcacatgaagtagattcattctagacctttatttactactcccttaaccagtgtaattgcagggtaatggcagcaactgtcttagtcagtggagtctattccttgagagggctggatgccctagagataaatccaaattatctctggttatagttgccctgaaatgaaccttctttcccaaaggaaaactattatctgtatctcttgggctgggctaggatggagaggctttgagagcattgcttgcaccggcatctttgctgatagtctgacaatgtttaaggcaggtgtttgtggcatttggccaacaccaaagtgaaatttagttgaagattcagtaagtaagtggatgactaattttgctgtgcctcaatgttcgcctgttgttgcctgttcaataattcttggttattgagctgcctctaagcagtaatttagttaaggctgtgtggatatctggaggactgtctcctctagaaattgggatgtgatttgggagtatcaccaggggttgcctgagaggcgcagcctgcagcttcgccctcttggctaagagccccttcacttttgctggcaacatgcccccctcttgctggatgggctatcttcctttcgtgttgaaggacacacctttgaaaatttgttgcctcagtaaaagatgttggggcagtggttctcaaccctggctgcacattaaagtaacttgagctttaaaaaaaaactcatgtctgggctcctccttaaaccaatttaatgagttgagggtggagcctgggcatcagtatattaagtctcttaggagaagcaccactaccactgttgcaccttgtgaactttctagctgtgtgaaaggctggacccattgctctctcaaaaggggtttcctctgagaatatgaatgtg

SEQ ID NO: 124882 - DNA, 1033 bp, Homo sapiens
atgaacaaatgaatctttccctgcagggcagctctacattctgtattttggtataaaaattggcttagttagaaatggctactcacacacaactcaccccttggctcaagccccacgtctgtactctgcaaaaggcctgcagccactgaatggttgggcacgaaggcaggtttccaaacttaatagagtggtgccctttttgaaggaaacaagacatcaaaagcctctgtagtacactcggagtcctcatgttgagaaactttagctaatgttgtatatttaccctaagaccatcttccatttgacaccaaaaaaagaggtaactggtaagcatttttaaagattatcactaaaataaaagtaaatttaaaaatctttataacactggtggactctgagaagaggttccatgcagagaaactataagacttcaaggtcttttagggacaagagttcctgggctggtcaaggcaccctgaaaggaacagtatcactgggtaactggtattggcatttcggggttggaccagatgtggccctgccttcgagccctttacgacctgacggtgaggcctaacctcacatacagtgagggtggccatggaggaggcttggccctgggcctagaaaggtgacgtcgccccgtgcagtggtgaggtgggtcctgtgggacacacggcgagcgcagggcctcgtgagcactcctgcagcctgttcacatgtgggtccgtgcctcccaagatgtgtttcagggcctggggtggggcatctaaaacacagccaggcctaagcaccaccaacttagggaattcttgctagctaaattagagtgttttagttttatcttgatgttaggggtttataaacttgggtctgtagttccttcaaggatttctgtggaggtgtcattgctctatttatacccaactgtgtttttctaggggaatggatctatcccatctccaaggggtcagctgcccaaatgaagtccaggtctgattgcaggtcatgggggcctctttccagattgagc

SEQ ID NO: 124883 - DNA, 1066 bp, Homo sapiens
agtgatgggggttatacagagtcactgatggaagcgaggaaggagtacagcaccgctgtccctggtgggcacctccagtgtttgctgtgtgcatacctggccaagaagtgcttgcaggtggggaggggctgggtctgaaaagcggaagcccgggttcccgaagttttgtggttcttatagcccctcaaagacaactccggcaaaagggaggctgagactaggggcaatgcgtctgttgccaggtgatgccagtcttacctagcatgtgcgtgtccatccacttcctatatgtctgtccatgtctgaacaactctctcattcattataatctaaccctcttgttcattgcaaaatgatgttctgtttcacgtgggagagtggtaggagtgccgaatttgtattcaggaaacctggactctggtcctggggttttcagtttcactcgccttgttgcttgccctctagtatgtatatcaccagcatattgggtatgtgtgggatgctggacatcctcatcttgttactgactctagcagggatgcttccaatgcctcagcgttaggtaggatgttctttagggttcaaataaaaccctttccttcccttgagcatgctaagaattatttttaaagaaacatatatggatatttatttttatcaagtgctttttctgcatctatttagattattttgtattttttaaatctcttgatatgaattacattattagattttctactgttaaaatagtcttgcatttctatttggtcataatttctctcaaactcatggctgatacagttgtctattttattttatatttttgtattttatgtttacaggtattagatttttagaatcaaggttgtggtaacctcattaatcatcattatctcaactaacacgtagcaatttctgtatgtagggtgctattcctagtacttgatgtattaactcatttaattctcacaacagtcttttgagggaagactattattagccccattagatgaagaataaagaatagatgaagaatctgaagcccagagaagctggacacttgcct

SEQ ID NO: 124884 - DNA, 1066 bp, Homo sapiens; identical to SEQ ID NO: 124883

SEQ ID NO: 124885 - DNA, 1066 bp, Homo sapiens
catcatgaggggagtgggcggggacctgctgcctttctcatctgagggcctgtccatggggaagggattgaccattctgggggctctggagggtgatgcgtgggttgatgggaaatgaacagtgaactcattatcagccagaagtctggagaagacagccgtgagaaagtagaggggctgccttgagaggtggtgggaaccccttcactggggggttgggatggttcaagcagagttcacgggggaccactcatgggcggcatcacagaggaggttcttacgcatggtagagagttgtactagaccaggagttggcaggtgttttctgtaaagggctcaatagtgtatttttggctttgctggcagtgtgatctctgctgcacctattcaactttgccatcatggtatgaacacagccatgggtggtatggaaacaaatgggctttgctgtgtgccagtagaacattatttacaaacaggtggtgggggcagatttggcctgtgggtcacagtttagtaaccctgcactagagcactggctctcaaacccggcacactgtggaatcacctgggggaatcttaaaactactgatactggagtctcaccctcagcaactggggtttaattggctggtgtgttttctgaacatcaagattgtttttaggaacttcgtatcctagatggttctaatgtgaggtcgagtttgaaaacccctagtcttgcctgtggaagatcagaggacctccaagatcccttgcaaatctaaaattttgtttctcaaggcccctgtaaggagcttacaaagattttggcccatgtcagcacaggctagcttggtttaaagatgttccagaggtaagaccctcattattgagtttctctttcatcaaatataagaagaatgagcctgaaaaataaaaagagaagagatgaaccatgctagaaaatgggcttccctgctagaattcaagaacaacttctgcaggaatatgcacactgaacatcgtattgttgcttgcttttaaaacaaccagtaaaactctctcttctttttataggaaataa

SEQ ID NO: 124886 - DNA, 1034 bp, Homo sapiens
aggacaaagatacacctaatgtggtgctgaagcaggccacaagtggggcagaagagagcgcagagctcatgtaaccacaggctgttgaaggggctcactgccagccgagatggtcaggaaaggcttcttggaggaggagaactttaggatgggccttgaaggctgggtagacaattaacaccctcaacctgtagacacagaaacatttccctagatgatagaaaacctatggtgatgtccttggcttcacagctgactggttatgaggagtcactttcctcccatgacacactgacaactggccccttcccctaggagtggacaaagggtcttgtcactccctctctgtggcccaaggttagtgtgttgtagaagcagttgccacatcagaggcccttctgttgcagaaggcagggcccctttactctatcaggtgggttctggggtgggtttgggtgaaaccaaaaactctgccccaggccagttctcactggcagcaatggtctcattctttgcagggtggtccttgcggagtcctggcagctgtccaaggctgtgtcctacagaaactcctgtttgaaggagatagcaaagccgactgtgctcagtaagtcagtgctctttctggcaatatcttattttcccaagtcttccccagagtgtccagaaaaaacaagcaaggaagcatgtgtgttccctgatatttcctgtcttctgcaggtcaagaaaggagaggttaatggcagctagctgacaaggcctgcgcagaccagtgttaaggggacttgtgcgcgtttgtttctgaaagcggggagggttctcagtggtgctccacctgggaaggggctgcaggaacgacatcaaaaccaatttccctcctcagacggcaagctgcccgaatcccttccacccaccaggtcgacctgccgacctttcgactgcgtccgggcctcccttccctccccacgctatctcccctctgccaacattcataaccacacattccaggccgccccacagatcatcacttccac

SEQ ID NO: 124887 - DNA, 1076 bp, Homo sapiens
agaaccagatgtgggtggaagctcagctctggccctaatgggctgtgtggcttgagtaacccacctgtgagccccagtttctccattcctaagaggaggttggatccttggttatcctgcataaggaagggaccttccagccttgttggtacaccaaaatgtgggaggcatgggttgcaggtgactgctggaggaatgttgctccacacgtcactttctccaagttccagggttggcatgcttgttggcttgccaggtgtgtagcttgagtcacaggaccacccaatgcctcatgccacgtagcaagacaacagcagaagcagagctagaactcatacttgggcttcctactcccacctctctgcttctgttcttgctgcctactgaagtaccttcctcggctttccctgccctgttaaaaccccaccgtcactaatgaagttcaaacaaggcctggagtttagttattggtactgcaccatggtcagtttcctggttgagataatgggctctggttatgtaagatgttatcgttgggggaagctgggtgaagggtacacaggaactctctgtactatttttacaacttcttttgaatctaaaattatttcaaaataaaaaggtttctttaaaaaataacatcgtttaagactcacccaaatgtcacttctccttaaagctgccctgactcagtcatgtggcctcgtgttcatctggctccagaatactccatgcacacatttttacagccccagccacatcctgcattgagtcaatgtgcagacatgcacctgactccacagtctagacccaaagcacatgtcaagagccatgtctcaccctctcaccagtgcccccagtagcctgcagcataggacagggtcctgtgaatggttggtactcaaggagtgcttgtggaataaaggtggatgggtgcctggagttaccttgatgagaaaagttggtgcctttcccacaggacttgtgggagaattgaagtcacagcctcctctgctctcaggctctctccctccttgctttccttccttctccaccctttttgtctttccccagtc

SEQ ID NO: 124888 - DNA, 1076 bp, Homo sapiens; identical to SEQ ID NO: 124887

SEQ ID NO: 124889 - DNA, 1052 bp, Homo sapiens
aagatgaacgctctgatatggataaattccatcaaagtggctcaaccccaaaacccaatagactcctctggatctgcttgacacacagaagcccagtaaatagtctgaagcacttggatagcatagaagcacttaattcttccacatccaatggagtaagtgatgatgctggcattttcacttcaaaacgattgatgaaggggaggtggggttgtggatgaacatgaaagtgttatcatatacctcttgtcacaggttagactgggaatggatctcaccaaggtagttctttcagtatttattcttgaaatatcttttaaaaatgtatgcagatatttttgcacatccagatctgtttctaagcatttatgaccagaaggatcccaggaaccaaatggttcaggtgataaaagggtacctctcagcctttcatgcaggcagaaaaggattgattgccaaaaggccatacaacctgattttgggtgagatctttcagcatcactgaacatcaccaaatgacacggaggaggacgcagagaaagttttggacacagttgccccaaacagtgtaacattcctggctgagcgtgttttccagcatccacctgtttcaaccttttatgccgagtgttttaacaagaaggtacaattcagcgttcctatttggacaaatcaaaatttcttgggttgttgactagggagcacaacgtagggcaggactgcgtcttgtgtctagactaggatgaacgtgacatccttacattccccgatggtatgcacgatctatcctcacagtgccctgggcagagctaggaggagaatgcaatattaattgttcccaaatgggctgcatgcaaataacttccacaccaaacctttctataggagcaagaagcacaaaattgccattaagatttttttctccaaatgacaagaaatctttctgctcattcaaagggaaatggaatggtgtaaagtattcaaaatatgcaaggggaaaatttagtctttacagataccaagagggaagtgagttggaagaacggagtgaa

SEQ ID NO: 124890 - DNA, 1052 bp, Homo sapiens; identical to SEQ ID NO: 124889

SEQ ID NO: 124891 - DNA, 1106 bp, Homo sapiens
ctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccatgtcaagggcccaggctcatttgttctacagctgcaaagagcgtgatgtgcactgtctgtgctgatcatggctggtatggagaatgtggtagggtgattcgccccagagcccttgtgaggccccaggagaatggaggtggacctggagggtaagctggacctggccaagtagatgtgggaaaagagccttccaaggaggagggacctcttggccatggggggacaataggacagggataaacagagggactggggactaggtgaggtccttggtacctgtaggggagcatgtggggagagggctgtctgaaaatctggatgggcagagcctgtggagccctcacattccagaacaaagatggcaaagttgaaataggaaaagtgcaataatcactcatgaaggggatatagtagtctgagccttgtttgttccattcattgatatcccaccagtttcaaaaagaagatgagaacatgcagaagtgcggtggcctgctgatgaagaagggggtgaggagagaggttgtgtgaaaagcacagtgaaggactcctctgcagtggtttacaagaacaggatggatacaggagcccaggggcagagcactagcctctcagggtttctgtcacatggctgcccatatgaaggctgccggccctgtaccccaccctgtctgtgcccagtgagtgctgcagttgggactgtgagggggctgtgtagaggtgggtgtgtacgcacaggaaccaggggatgcacccctgctgtgtctgctctggcccagggagaagcctaggagagccaccagcaccggacagtagcttgtccccagcttccatgtgcgcctggggctcaggacacaagcagctcaggagctgtgtctctctgcagtactggctacaggagaccccttttattttagacgccaggcatgtcag

SEQ ID NO: 124892 - DNA, 1054 bp, Homo sapiens
atgcacacacacccctgtacacctctagtgctgtttccttacccctgggcccggggctccttcctccctgcctctttccctcccccaggtacctgtcccaccctgggggacaagcccaaagctccttctgcccactttgaggcccctcccctgctcacacccactccaggcagaaagcctcggcagctgggtgtcagggcgggaaggtgctgcctgaggctccaaaccgttggttccaggtgtggctttgagattaaacctggcgcctttcctgtggcccttgataagggtgatcctgagtgtttctctggcattttctgtttaaggcctgtctgaggttcagcaaagtcccacctccccacggagccctccatgataagcacagcactcgcgggtccacctccctgtggcctgctctgtggggagcccagggttggcaccattcctgggccctgcccctcccctcccctccccagcacaaggactgaccctgaggagtgctattaataattatatcaggacagttttgtaatcaggaactgccgtgcacgggaactgtagtctgcgggaggattgttctgttactgattgatctcccaccaccgtgcccttcaaactccgggttcagatccttggattgtatttgggggttggagctcagatgaggggaatcctcttggtgggctggagcagtcgaaagcttcttgaagggggaggattgaaactggaccctgaaggaaagtgggtgggaggaggggcagagagcattccagataagcagagggtctgggttgtcaggggcaaggggcctggggagtctgggggtggtgggaaggttaaggatgtcagggctggatcctgaagggctttgaatgtcaggttaaggagcttgagctgtgagcactagggagccatggagggtttcagagcaggacagtgatgggtccaagctgtttgggaagactgatgtggcaacaatgtggaggacagatcagaaggaagacgctaacttcttagctggggccatggagaggaggatccggtgtgagagagc

SEQ ID NO: 124893 - DNA, 1054 bp, Homo sapiens; identical to SEQ ID NO: 124892

SEQ ID NO: 124894 - DNA, 1032 bp, Homo sapiens
gattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtccttcaggcttcctgtagtttttcttcttttgatgctgtgtccccacaaatgtttctggattactccacaaggaaatcaggccactgctagagacccagtctgaggaggagccactgcctccccttctgccttcaagacccctgatctcaggcaatggatacagccacaccacagaaccccatctgagggacacagggtcctgcccctagtaggagacttccagagcccagtgggatgactttggagacctgggggcagggaaaaggggcaggcttctgatcagtttaaatggaccgatgggagccatttctgattccggagtatggaagggatgggggaaagcagggctgaagtctaacagccccctcatcccctctaccctccacagagcagggcccagggaacactagggattgctccaccttcctccctccctccactcacatttgcaacccatctgacctgggctgggcgtctcatgggagacagactcactcat

SEQ ID NO: 124895 - DNA, 1036 bp, Homo sapiens
ggatccctcatctatccctactcgtcccctcccttgaatcatagggtggggctttataaaatagagctgagctaattaagcagaagcaaagggcagccattaggtgggaaagaggaaaagagtaaaggcccagttggaccaccaactccatgaccctttcctgctctgggcctcaggagcttctcttttaaaatgagtggagtggggtggatcatgttaatagccagaccctctatagacttcctgtgtgccaggctctgtgccagcacttcattctatcaccacagcagctggagggtgggggtgggtctattatgacccctattttatagataagtgaactgaggcacaaggaggtactttgcttaaggacatagtccattaagaggcagaggcagcctgtaccctcaactgctgggatgcaccacctctaaagagtgacatgctgtgggtcccagcacccccccgggcgcagcaccagccatgggatctttgaagggcccttaacaccttaattttcatgtctgaaaaatggaggaaaaatgatacctaccacataggattattgcattaagtgataaaagcctgtgagaagtgctaaggacagcgtatgggatttactaagcacttaactaagacactgtagttattaggagctgtcatcttggagtgttgggggtttccagggctcccaccttctgctacatcccagttcttctggggagtagagagacatctctaggaagcaggtcagcgccacttggaacaatcctggaagcccctctggaagagcaggggagaagttagggagcagatctgggcttcagagggcagatggagagtacaggaaggtggagagaagcgttccgctggggaagggtggaaagggagcagtgagtaaggtgggtgggcaccgtaacagccagcacttcaaggcgggcactgggttctctgtctctgtctctctcagacacgcacgcatgtgcgcgcgcacacacacacacacacacacacgtacaagaacgcatttaaccct

SEQ ID NO: 124896 - DNA, 1032 bp, Homo sapiens
acccacccatcaatctacttgttcatccagacgctgaagccagaaacctgggagacatccttggtacctctctcccctgcactgtgttggcctcgactctgcagcagtaacaaatcaatcttaaaatctcagaaacttagcacagtaacatttcttgcgtgcatgtatcataggccagtgtgatcagcagaggtaggaggtggagctcaacttcacacagtcattcagggatccaggtttctaccatcttggaacactgctacccttaacatgtggccttcaagggtggtccagagaaggaagaaaggcaggctgtggaagcttatgagggacattttagaggtggattctgcacttccaccctctcaccattggcgtgccctcagtcatgtgatgtgggtgaacactaaccgtcttttgcagacttgccagccaggtccagccagtgtgttgccaagccctgtcagctctgctcccgactctgtctgacacaggactcctctccaaccctgctgccattgctccaaatcaagctttttcatctcacccctagactatagccatgtcctaacaggcttccccatgtctgcatgtctgctattggactatatgatcttccccacacaaccaaatccaagtgtgactccttgtcttaaagcctctctgtggtaggtcgaataatgcccccaccccggcctgagaggcccacgtcatcctaatccctgaaacctgtaatatgttactttacataacaaaaagaactttgcagagggaattaaggatcttgaactgagaattttatcctgggttatttgggtggacacagaataatcacatgggtccttataagtgaaagatggaagcaggagaatcagagaagagagacttgaggatgcaaagctgctggtttcaaagagggaggaaggggccatgggcccaggaatgtgggtggcctcttaactctggaaaaggcaaggaaatggattctcccctagaacctccagatgaaatgcaaccctgctgacaccttaa

SEQ ID NO: 124897 - DNA, 1045 bp, Homo sapiens
aaaaaaaaaagtcccagaacatcaaagttgagcccccgaatggttgctggaggttgtttggcttagacccctatcttcacatgggataccaagacttcaggagtttaatgatgggcctcagatccccatctaggatgaaccaattttccctcttgcctgggactgaggggttgctgaaatgcaggactttcaatgctgaaatcaggaatgacttgggcggacaaggaagaactggtcaccctatccccacccagtgagttgtagagtaagaatttaaaatctgcccccgagtgctggccccacacagaggatctctcagccacttccctctgtaggggccttgtgggtttgtagatgttgatctgagaagctgacacccataagtgctgttattgttcaccagggcctctaccttttagcatcgttttcaatgctgtagcacaaatgttcagtatatgaagtgtctaggcaccttggcaaatacatagaggtctgagggagcatgggagattttcttcaaagactagctgcttgttggacatctgtgtgttgagcagggtcaaccaaatttattatatctgaaaatttttaatcagaaatgtttgcttcagggaaaaggaataaagcattctactaggtacttgagtgaaatttttatcatttaatgctcacaataaccaatgaaacacatattattatttaaattcttgtagaaaaggaaactgaagcttagcatgatttaacaacatgccagaggtcacatagctagcaagtagcttaatctggttttaaatgcagctctttctcattctaaagtccaaaaatatagaaggtttgggggaaactggggaagatatttagtccactgctttgaaaaatgattgtcctgggcaaaagccccaatccctgtgaggtattcatggttcaataaattaggaagcattgttcattccaccctggttgggagcatctcaaggcatattagcatagtcctgctaccaggactgttcctgcttaatcaccatttcctaaatgtattttgcca

SEQ ID NO: 124898 - DNA, 1073 bp, Homo sapiens
gggttttaaaaacatgagtgctgggcctccacccctgtactgtgggggtgacgcccaggcaacttcctatttagaaaacttcccctgtgatcctaaaatgtagcattgctcagtggcacatcggtcccaacatatcaaccttccagccagaggaactgcgtactgtcacacacacaaaggcaaaggcgatgctcccagcttttctggaccacagaatatgcaccaccctgcaacctcacctaacctgcttctaaacattgttttcagaccccaacttgataacatttcagatgaacatttacttgtccaacaggtttttccacaatcctacttttccttatcctctttttcctcttcacaggcacaaaacagcgttctcacggctcaccagccccaagcaccagctccacgtgtcgccttacgttgccaggtgggtaaacagcattgcaccattatcttagtgaccacagacaatggaaaggcctggtttctcgggaattgggttgataaactgagaacatggccccatagttatccagtctactcacgttatcagagagctttgtctctgtcaccctcatttgtgaggcccctctaggaatggacataaatatttctataattggttcacaatcgtccccctcacctatggaaagaatagaattttggtcctctttgatgttcatctgtacatgctatggaaggatctgccttgtagaggcagatcgtgcaagggaagtagtgtgagtctgtggtgagatcgagactcaggtttaaatcccagcttttctgtgttcaaattgtgtgccctcacatgtgcttcttcagcttcttggaatgtctgttttctcatctgtttgggagaagataagaattagaaataatgcttgtaaatttagcccagtattgacatagtgctcataataatctctactatcgagaaatatggaaggcatgtatgacctctgttcgacccaatctcacatgtactggcaaatcataagtattcatgaggatcaagtataattattgtttaatataaggggcacttattgatcattctgtctccatgc

SEQ ID NO: 124899 - DNA, 1071 bp, Homo sapiens
gaaaagcgcagtattagggtgggagtgaccccattttccaggtgccatctgtcatccctttctttgactaggaaagggaattccttgaccacttgcacttcccgggtgaggtgatgctttgccgtgctttggctcacgcacggtgcgctgcacccactgtcttgccccactttctggcactccccagtgagatgaacccgctacctcagttggaaatgcagaaatcacccgtcttctttatcgctcacactgggagctgtagatagctcccagctgttcctatttggccaccttgcctccaccccacttttttcttaacacctaacacagataaagtcatgcttcatgatttagtatttactaactccataagtgctaacagattttcatacattgactcccagcctcccaaccattttgtaaaactctttcaggtcaaggtcagtggttataaaattctttcataaccctctctagcctaattcaatgccagactgagttaataagtaggtgctgattgatgtttactgcactctgtgtttatttctgtctcttgcaaggaaaccaattcaaattcacttctagttgttcctccctctaccctcaacttttaatccttataagaaaatcttttttggttttcttctaaaatgtaacagattactctcaaaaattacaggaaattcagaataaatatacaagcaataatatgattgggagaaaaagaataccagtcataattgcatcacaaatatagttctaagagtaactcagcaagatatggacagaagttatatgaagaacattgtagtcctttactgtgggacataaagactgaataaactgggaaatagtccatgcttctgagtgggaagacttcattttttaagatgaaaatcatttcatccctaaataaatgtttaagtatataaacaaacaagcagatatttgctgagcaaaataatctagtgtttcagcataacgtttggtgttaaacatcgtacaatgaatttcccaccttttttttaaataagacttactgtgaggattgaataagataatatatgtaaa

SEQ ID NO: 124900 - DNA, 1043 bp, Homo sapiens
tctttcattactctggtttcttcatcttctccatgctgcatacctatgtctgattactttctccacagctcctctgattgtgccttctatgtttgaaaaatagcaacaaatctccattggcttcctgttggccattaaatgcctatcttcttgtcttggattttaaggctgcctacacttgcttccacctaaactttgctgctttgtctgttaccttgttccattcaccctaagttccagtcaagctgaactccttactgactgtcatatttgcctgatttttttatgatcctttcttctttcatattctttccagtactctaaatgttctcatttttatctgttgaaatcccatcttttcttcaagatccaattcaaagaccatccctttcaatggaaacttcttaggtatttccacctaaaagagttcctgcttctctaattctgtataagagttagtggggtgcatgtcattccttgtggcatcactgatttttttaagtggggaatatgctccccaaaagcattgggcatgacagatctttattaaatgtgcattgattttatgaataaatcagattgggatccttcatatatttctatcatgggtcagaactaacgtcatagttactaggtggaactctgggtaaataagtttggattgtgactcatactttcaaatggctttgcagttcactgcatactcccacacgtagactctcatttgaccctcacactggccggtgtagaggcctgtgaggtcagcaagacagatggcatgcatggcaagaatcagtaagtacataattgcttaaatcattgactctgcctttcttttctttttttagtccctgcaacatggaactcaagctttgggtggaaacactgagagtattttagctttaatcagtgcttcaatctctgtgtttcctctactcaagccattaatcctggaggtgcttagtacagtatcagatgtatttgctcagggtggatcattctgaatatttgatattcaggtatctgtgtggttgtgcatcatt

SEQ ID NO: 124901 - DNA, 1105 bp, Homo sapiens
ttcctgcattttggtggacagaatgcagtatgttttattgttattaattttattttggttttatctagtgtctaagtttcttggtggaatcttttgccttctttgtatacattccttaattttctttgaaggcttcagaatttgccttctgtctcagccactttaaggttctgtatccttaggcaagttacttaacctctctgagactcacttctgtcaagtcgaaagtaggtagaacctctcagggtttgcaggagttgtaagtgagttaacttgtgtaagaggaatggaacagaggaggtgctcaacaaatgtgagctccccagccttctcattgctttccctctgtgtgtaggaaaccacagctgtggtggatgtcctcactgctcattataaatcattgcttagtagaaggaaaaagaataaaaagaaagcatttttgatcaatttttgggtaaatgcattcatgaattcaataacaacatattgagcagttgccatgacaaggaagaaacactagcagatgtcaggtaagccatcattctttccataagaataacagatcatgaccatgagcagtcataagtgcaatgtggtgggtaagctctggccactatgggacacacagaaggagtgttacccagtttggggggccctagaaggtctttggaagtgatgtttcagttgagaactgaaggatgagtagggctcagtcaggcctcaccaatcttgcccattcaaaataatctgagagttggatcttgagtaatttttatgagttgcattttctcttgtgctttaagagctgacctccaaactccattgtaagatgataccatttgggttgattttagggctgtgtctaaatgggagaagattgaagggggaaactttacaatatctgaagctaagaatatatctatgaacgaggggcgtgtcaggaaggtgagttggactgaaaatcagacttctggtctgtctttctttgggtctaccagatgcacaacccatcttttgatgtgtatgggtgacagttgcaaatagttcatttatttagccaaccatgtgccagttaacgtgcatgcccttgggatagatatagaga

SEQ ID NO: 124902 - DNA, 1079 bp, Homo sapiens
tgctagaatgcatggggccagccaagcatcctcatcactctcacctctaagttctggaaaatgaatgccaattatgaagtgggtgagcatttatgatttagagaccattttattcctttgttaaggtcaggtgaatggaactttacttgagcagtgaagagaaactagtcctcacttctaagtttatcatgcttttgggaagcaggtaatcatctaatagataggaaaataattctgagagtgtgatggaaagaagtattacctgtcattgaggaaaaatactgtatagggcatgccccaccctgaatctcaggaaccctgagagccaggtttgaaatagcccctggtggtggcttcacctagaaggaagtttgacggacccttctgtgatgtcgcttgcaatcatcttgggcatggattcccccagtctttggttcctctcttcatctgtcctccctccctgactcccaacttcatacctggtcccgttcttccagagcattctaccttattgacattgttcatgaactaggggaaccctgacagtgagttgcagctttgtggagctgaaactttgtcaccatccacagccgcccagccagcacccaggagggaccctcttgagtagcgtgtgatattgatctgaagaaacttacctcctcactattggtatattttctccttttcttccgcacaagagagagagatgggggtgggggggtgaaagggagggagggagggaatgagggaggagagagagcgcgagcgagagagcccctttagcaagaaaacatcaagagtttttgagtgtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtga

SEQ ID NO: 124903 - DNA, 1121 bp, Homo sapiens
tccttgggtaaatgagtcagcagtataaattacaatgaccaaagcaggagatgcagttgacattttgcagcaaacagatgcaaaagggaatgggattttggaaacacaagtgacaagcttgctttgagagtcagctggaagaggtgatcctggtgtggggttgaatgtttgggaaaatggggattaatgctctgcagtaaattctcaccaaggactccactcttgtgactgcagaagactggccattaactaggtgggaaagagcttgctcttctgaaaggtaaaccctctaggcagtcattctacctacccttctatgtattcttgaaatgactgcactttctatgtgcatactttagtttaatgagacagatagggtgatcgtcttgttctggtttgccagagactttcttgcatttaaacctgaaaatcccatgaaccctcttagtccccagcagacaggatagcctgtcaccttagagacagctgtggtgaaagctgtagtttgaagttagacatctgtactgactagtggatcactttgggccaattgcttgcctttctaaactttccttaggaaaaaaaaagtaataatgctgaattcacaactacaagttgtgtagattcagcaagacagtgctggtaagaatactcaacatagtgccttgcacacagtggatgtgcaatacatttttttccttacaaaactatagtttttgtgccatcttggcttttccattttagtattttaaaaggcaagccctgaaagcaagtaagtgggagacttatcctctgtaaaaacctttggtaatttctgctttaacctcccatagactatcttcctggctgagcagtgggatctggaagggacctccagattcactcttgattgtgttcagagctgatggctcaacatgttcctggcagcctaggctagccagaaatgcctgtgttttttatgtagaggtcgggggacaggagagaggagccctggcctctcaatcttggtgtcagatttgggtcactgggaagtcagcatctgcccagagctcctagctttagaaagctgtttgaggccccagggtttagtgaccagcagggctaggtccaggtaacccagc

SEQ ID NO: 124904 - DNA, 1024 bp, Homo sapiens
cttccgtacttctatgctgctccctagccacagcaggtatagggacatttgtttcctactcagcatgcatctttcctttccatggtgacagcagcctggtttccctttggggaagtttggctcccctacttccagctcataggttgatcccacctcttagcccctcaggatgggtcctgaatcccgtgactggccagaagaaatacaggattcctccagccatgatgattgcctggagatgggcaggtgtttctggctgggtcaatcaaaacctatctgtggtttttcaggaattactgggaaagtggtgctgcctttccacaaaggctgccaagctggtagtattcatgtctggagctgccaggggtcctgttgcaccctggggaaaatgcctacctgtatacaaagctggcacagaagagagacagagagacacaaagtcttggtggcttcatttgagcccctggatccatttgaaggtagataaagcttggttttgtgagctgatatagtgtctctctgtctctctgttgcttaagtcaccatgagttccttttctgtcacctcaaatcaagagtctgaaacactagactctttatcactgcccaccatggcaagccctttatgcttgtgtgtttctgctcattgcctgggatgcccatctccatctctcaattcagcagcattctatttatctgtccaggtctgggtcagatatccccagtgccttcccaccctacctgggcagaatgcgtgctcttgtagcgtggggtcacacacatcattgcactttgtcttacagttagctacatgtgcgttagaatttctggctctttacgtaagggacaccaaatttcagacactttaatttatgtctgtaatacttcgcacaacttctgtgaatagacatgtaatatttgttgaactaaatttggcagaaaaagaggacaaataaaaggaggaaagatagaaaataaaagagaaaaagtacattttgccctttaaaatgtgagtcttgagcttt

SEQ ID NO: 124905 - DNA, 1110 bp, Homo sapiens
gagatttgtttctggccaatttttgggagggaaaacctacagcaaacacaccaggggaacatgtcctttatattgctgcttctcagacattagtgtacccaagtggcttctggagcaattgtttaaaacagtggttctcaacctttatggcaccagggaccggtttcatggaagacattttttctacaaaacgggtgttggggggaatggtttcaggatgaaactgttctacctcagatgatcataaggcacatgcagcctagatccctcacatgcacagttcaaaatagggttcatgctcctatgagaatctaatgccgccattgatctgatagggagtagagctcaggtggtgatgctcggtccccgctgcacacctcctgctgtgctgcttggttcctaacaggccatgggctgctcggttctgtggcccaggggttggggacccctggtttacaacctagggtcctgtcctcacttgcagggattctgacccagtggatctgccacaggaccaaggaacctgcatcatcatcatcatcatcatcatcaagtcacttccctagctgatcacacttggataaacccagattgacaggcacagtttgcctcccttacttgcttgtatgtccaggttgggtggaatccattgttgcaaccctccttgagtctagttcactgcccagcgcccaggtggtgctcaatccacatatgctgaaggatagaggcaatgtgaggtgaatccttttataaagaaccgtttacaatgcaaagagttgcccactaataggtctccatagttaggtttgcatcttaatggttgaagttttcttaaagcagagatatacctcgctcgattcaggattttgacaaagcaacagcatcctgaaaagaagaagtgaataggggtaattatttttgaaggaatcaaagccatgtcctcctgcctttggtaaagatgtacggagttgcaccatttattagtgcttctcaacttcggctgctcactgggatcaggggcttaaaaaacactgatgcttgagtcctacccctagaggccctgtgtaattggtctggggtgtggtctgggcatcaatattttgtaacatt

SEQ ID NO: 124906 - DNA, 1010 bp, Homo sapiens
atttagtaacaaatatcttgaaatctttttgcatgatttttaacataggacggtataacaaatgctatgtagtaccttgctgttctcctaatagtgcttcggtggttatgtgcagatgcatgtattttaaatttttaacagccttctactaaacaacgtacttactaacaggcttaatgcttcatttcctaagtgaaaaggttcaattcattagttactgtggagacttttaaattgaatgagaacaaagtgatcaagaaagacaaccttcatattaaaccaccttgccaagatttgaccattcatggagacaattagctaatcattaactggacttactgtagtcaagacttgaagttcccctggaatattattttattgagtcaaagattagctgacttacagacagggcaaggaagaatggaagtttcttttcctactgttagctcactaagtttaaagagaaaggtaaccttttacttttctgatattttctattactcttctaattcatagggatatctgtgtttgccttacatggcattgcagcagcatcatcttctctccgatgtcaccgttcgggggtttgttgctggagctactaacatcctttttcgacaacagaaacacctcagtgatgccattgtggaagtacgtttatgtgtgagtgtgtgtatttggccctgctcatcccagttttcctttcttaactacaattatgaatacatagtaacaacattagtaatgataataactgcatactgtatgccatgtattctaagtattttatgtgtattaactggtctaattctcataaaaacacagtcaatagcactgtcctatccacattttatacctgcagaggctaagtaacagagagatgaagtgatttgtacaatatcaaacagccagtaaacaggtaaaccaggattccaacctgggcaactgggcctaccactacctcatgatttttaacatgtgtttgttgtttaagtaatttcaatccttct

SEQ ID NO: 124907 - DNA, 1074 bp, Homo sapiens
aaagtaggtttcgggagagtttttcatttgtaaaagacagctgaggaacaagccctcgtttgttaatgagatatttttaaatgtttgccaccactaacaatgtagcagctgagacaccaaaattaaatcctttaaccccaaatcatttggtaatctagaaagaaaacttcagtctccactgccatgtagcttaattaatttgcttttaagcaaattaattaatttgcttttttaaaaatatttgcccaggaggctgtaagcactgaataatagtagctcacttttttttttgaacattaaatatatgcagggaccagtgttctgagcactttacatctagtaattcatttcatccttacagcaatcctgaaggtagggaccttgtcattgccttttacagaagagaaaatgaagctcacagaggttcataagaggcttaggtgggatctgatcccaaacagtttggcttaggcccatactcttacaagtaacaaggtcaaaagaggaaattcagcccaatgaactgcttgaggaagtgttcttagaacaacttctttatgctgtgtatggaactgtgtatctcattcatttcctttcctagcaacaaaaggtactttgtatttcaccttcaaagtaaacaacatgcaattaatatatgaagtaatagccatttgtatcagttctccaaaccatttctaatcttccaagcggaggaaacacatatggatgctttcccatggtattgataaagctgaaaactttatcagttttcagtatattcttttaagactttttttgttttgttttgttttgttttttgagacagagtctcgctcttgttgcccagtctggagtgctgtggcatgatgttggctcactgcaacctccatctcctggtttcaagtgattctcttacctcagcctcccgagtagctgggactacaggtacccgccaccacgcctggctaatttttgtatttctggcagagacagggttttgccatgtcggccaggctggtctcgaactcctgacctccagtgatccgccctcctcgacctcccaaagtgctggga

SEQ ID NO: 124908 - DNA, 1047 bp, Homo sapiens
caagtgtttaagaccagaccctgtctctacaaaaaatcaaaaaattacccaggtgtggtcacacaggcctgtggtcctagctacttgggaagctgaggtgggaggatcacttgagcctaggatgtcaaggctgcagggagccgtgaccactgcactgcactccagcctgggcgacagagtaagacgctgtctcaaaaaacatttttttaaatttttaattaaaaatgtattaattatgttggtctttcactgtctcgtaacaaaagttaagacatttttccttttgtttttctcctctccatccaggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttg

SEQ ID NO: 124909 - DNA, 1694 bp, Homo sapiens
acatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcctacagttggacttgacctgtcctagaagtaccctgtgtgttgtccatgtggtttctggcctccttcacagttaaacggcagcttcatttattaagaaaccacacagaatgaactaaagactcatgactcatttactctcattttgacatcgctttgacagtggtgcccagctttcaaggcagtgacctctgcaggaagaggcccttagcttctgtggaatgctaagtgcagagagctgcaaaaagtatcaagcagagcctggtcacaagataatgtctcattaggatattgtcccaagcaacccattttgcacctggactgataagtgtcaaaatagcccttgatattgccactgaagactcctgccacattttcatgtatatgttcatgtactgggttcccttacaactgttctacaaaacaggctttaggatgtgcttcacagaagaagtgacaaacttccttgccccctgggaatgtgtgcttcctt

SEQ ID NO: 124910 - DNA, 1067 bp, Homo sapiens
gaaacttgaaatctagctctgtagacttgtagagaaagatcaagagagcaaagtgttgttatggtgtgtggactatttggatgtggaaaaaattagccagcctggaggttcccaatcagaatgttgtattatgttagaaaggcactactttccacctttctgaccccttcaggctggcacaagaaaggaggctggttggaagcctttaatcttgagtcttatcccacagcatgactgatgatataggttgatgcaaaagtaattgcgggttttggcattaaaatagcaaaacctgcaattgctttttcaccaacctaatagaaagtgtcacccagggcaggttttgcaagtgtggggttcctgctggtcacacaggacctcgcattcagaaggaccctgaacttggttgaatgtttgctgctgctgttttgaacgtcttaatacttttttaacaagagaccccacatttttgttttgcattgggccttgtaaattgcataggtggttgtggctttacttgaatctgggagtagagaaagcaggttgagaaaagagcttcctacattgtgttccacttatatgaggctgatggtagaattcttttgatctcaaagattattattttggggctttttctttaggataattaatcctttatttgggactctagcagaggccacattcttctctgggaagaagttttgcatgacagatgcatactactttatactaacaattaccgatgtattcttaatttggtttcagctatttggatggctcttttgcaaagtacatcctggtgctgttgtttttgctatattagcagcaatgtcaataccaggttcagcaaatctgcaaacccagtggaatactgtaggggagttcagcaacttgccacaagaatttatagaatggatcaaatatagtactaaaccaggtaaaaaaaaaaaagtcatattatttaactgtttttcccacaattttatataccactgcaaactccaaactcttaaaccctagttacttccactgatcttactctttctaagcaatgttgcttttagaat

SEQ ID NO: 124911 - DNA, 1200 bp, Homo sapiens
aatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctaggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtggggcgccgccaatctaacatgagcacaggtgcttcatgacaaacattactagcatgttcaactgcaccatgttctggcactgtattttgaatgacattaatttattaaataaattgtatatattcaatatctatttttcttttgttatgggaatggtctgctttttaaattttgattttgctaggtcaaacttagctagtaataggtggtttcttccaaattttgtttgatgaagattgagagatatgcataggctttccttaggctagtgtctttctaccctgctggcatgttagaatcatctgattctgatcatcatctttagaagcttgagatgatgcctgaacctcaccccaaacaaaatggtttctttttagagcacatcattgatcatgtttatagacttgaactgcccctccactgcctactgaatgaagtccagattccttaccacatttaaggctctctctaatttggctttaaattacctttacagccctaccttgcattgtttttccataagccttatcttctgattaggctttcgctatgctttatgcttt

SEQ ID NO: 124912 - DNA, 2348 bp, Homo sapiens
tctggttttatgtgactgtgttcaaattgaggaaaccagaatccagttattcaacaacaataattttctctatactatgatttatttacattttttcatatagttctctcaattatatataaagtctaggaaagtatgacttatgtgtgaatttccttacctattctttaaggctgttttgttttttaagagcctatttattgttgtactgctggttcctaaatagaacagttaagtaggccactgagcaggaaaaaatactgcaaaattttatagtcttctgagtttattactaccagaagaccttatctcagcccagatgtgtgtatctgaaaataaaaattacactatgggcatctgattaatatacttacgtcttacataaaagtaaaatgtgtctgtcctggccctatcagcctgttttttttttccttctcattctaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttag

SEQ ID NO: 124913 - DNA, 1675 bp, Homo sapiens
cctctcttacctatatatgggcattctacttagtattctccatgatgccagttgcctttccatcatgatttcctgtatataatagatttttaggaaagtgtcctgcatatttttagagaattgtttgagtaaatgaatttttaacagctttattgagatgtaatttacataccacaaaatctacccattttaagtatataattaaatgaattttagtatatttacagttacacaaccatttccacaatctaaatttagagcacttttatcactttgtgtctatttatagtcacagaccccattcttacagttctaaggaactactaatctaccttctgtctctatattttccttttttagacgttttatataaacggactcatatactatgtggttttttgtgtgtggcttctttcactgagcataatgttttcaggttcatttatgttaaagtatatattaatacttagttcctttttattgctgagtattatttcatggtatgaatataagaagtgaatagaattttgagattttcactcaaaatggcatggtggaatagtctggtatatatttgggactggattttattcttatctgtctccctcaaaaatttcattggctaggcacagtggctcatgcctgtaatccgagcactttcagaggctgaggcaggaaagattgcttgagctcaggagttggagaccagcctgggcaacatagggaggccttgtctctactaaaaataaaagaaaaaatagctgggtgtggtggtgcatgcctgtagtcccagctacttgggagactgaggagaatcgtttgagcacagaaggtcaaggctgtggtgagccatgatggtaccactgcactccagcctgggggacagagcaagaccctgtctcaaaaaaagaaaaagtttctcttataagtaaataccctaaataaacacctcttattgtctaattgttcttttcagctctacatttgttttacacaaaacccttacaactttgttttcttcatctcccctgtagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtaagcatatatatatttttttagacggagtctctctctgttgcccaggctggagtgcagtggcacgatctccgctcactgcaacctccgcctcccaggttcaagtgattctcctgcctcagcctcctgagtagctgggattacaggtgctaatttttgtatttttagtacggggtttcaccatgttggtcaggctggtcttgatctcctgacctcgtgatccacctgccttggcctcccaaagtgctgggattacacgcgtgagccactgtgtccagcctacaggtaagcatttttttactcagttacatacatgagttgtagcttattggtttattatgtggtttattttgtgaggaaacattgttaaacattttttatttatgtttttgagatggggtctcgttcggtcacccaggctggagtgcattggtgcagtcatggttcactgaagccttgaactcatgggctcagg

SEQ ID NO: 124914 - DNA, 1254 bp, Homo sapiens
atttgttgctaccagacaaataactaagagatctggctttggtaatttaagttgtctattttgaaagagctttaaaaatgtgtacttattcatgtgttcgttattttctgtgacagttatattttgtatagaaggcaaaagttaacttgaaattacaactggtaattttcttgttttttaattttaaatgtagactaagaatcttcatttttgtcatgtttcacttttatggtaatgtctaaagttgaacttgaaataaatatgatttctatttaaggctgccattttaaacgttatattctaaaaccgtactggcctagatactacaactgaactttttttctttttagttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcaggtaagtacttttaatgttttaaatagaaattctttgaaatgttatttaattttttaaaaagccacatctcaatttttgtttttaagttttgcttaaggtttctattcagatgatgtagtacttggcaaatctcattcttgcatgtgtaagagacacatgaaagaagttttataaaggttgaaatacaagaaatgtgttgcaattaactaaggtaaagttttaatgttgggaaggcagaaaggtttagaatattctttttccattaaaagagaaagaaaaatgggataatttacactttgagattttaaaatgctgcctttagaaaacagtgatctctgtttttaaactgacaagttataggctcaaatagtaatttttagagggtaaaaattggtg

SEQ ID NO: 124915 - DNA, 1063 bp, Homo sapiens
cggcggccgcggcatctttcaaacccgagacgcttccgccgcgggcgggggaggggcgcgggcggccggcgccgccctccgcaccccgcggcggccccagggcggcggagctccgggcaggtccgcggggaaggggcggcccggtacgccgctagctgggcgtttccggccccggcaccgggcgcctcggcgcccgcggggctcccgggcggcgccttggcctcggctcgcgcccgcccttaccgaagtaaagctgtttcccttaaagactcgcgacgtgttcgcgacatggtgggccgaaggaggacacccccttccttctgtattccccccgcgtacatctgaactaaccaagagaggtctagacgaacagagctcctgttatggtctatatcgacttaaaaaagaaagcagaaactgccctttgaaacggaaaattgtgtacgtgtttactttgtgaaatctttaacttccttgaattcgaccacctccttctccctacggattgaacaaccggggaatagaaaaatcgcttagtttggtgtggggcggttattttgagttaacatctttttttcccttgggcttagctatctaagaactctacctgcctcaaaaggtagaggagcgtccatcccacgggctaccacggtgaccccttccagtgaaaataggaaaagaattcaaaatacaaaatgaactttaaaagggtgtgtgtgtgaactatcttctgtgtcaattagccttatgaagacgtaggcaacaggactggtcacgtgttgtttatacttgaatctgtacgtcgggctcacagcatttaggcattgagaaacgaaaccctatcaacgctgtgcactgaccaaaatgatattttcttttatcgaggcaactaattaacagggatcttccccctcttccctctgagttgtacatttttgccgaatttgagtagtatgggtcttagatctcttgtaattgtgaatgacttagtttggttaacctttgataaggacttttttccccgacttttttttctgatctaaagtaaattgaaaagccagtc

SEQ ID NO: 124916 - DNA, 1044 bp, Homo sapiens
gcttttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccaggtaccgcgcccttggcgcccggcgcggcctcagcggatgcgcgtccctctctccggacaggcctttccctcctgccggacctcccctagctccgccccgtgcagccgcgctcctcccttcttccgctgcccagatcctcccggaccccagaccctccgccgcgggtgagcctcccggccctcacgtgccctaggctgccagccggggactggacccttggaggaccttgagcagcggggttggggcagaccacgtcctccctttcctcccagcgcatggacacacgcaaaatcagtgtaaaataatcagtgtaagtggaggccacgttgcacaactggacccccaagagtggatgttcgtgcctgcctctcttcgccctttcctgttccttccctccgctcccttgggaatctagtcagatggtgcttctcacacagaacaatgatgaagaggc

SEQ ID NO: 124917 - DNA, 1033 bp, Homo sapiens
atttcttgcttgagttgatggtaattaattccagtagaacaagttgtcctactatctagaacatctctagggctggcagccactgtgaggtagtgtagggcagttgaaagagcatggaggatctaccatccattcatcaaacgtttttcagcgtctatccctcaagagagagactagtcctagtctagtatgcttcttccccatccctaccacttacagcctaggctattacaacatggtgtgataagtacagtaagacagtagcacacactctgtctctcatagagttcacacatagttcttaccatgtgccttcacatatgttaactcatttaatcttagaataatttgtttaacttctcaagacagtgaggtaggtacctcattacaaatgaataaactgaggctcagaaagttcaaatgatttgcccaaggaacataagtactaagtggttgagtggagatttgaacccaggtagttcatggccataatctatggtctgtagtccacccatgtatatgacagaagaaaggtaagtagctatgaaagcacagagaaggtttaactatatatttttgtgtctgtgtgtgggggaggttaggatggaatcctggtatggcagggataagacccaaggatgatgaaaattcacctgggaggagctcaggggtgtgtctgcagaccccaaggtccaggcttgtcttttgataaatattattatgtgcctaccacatacctttttgggtatacagagttctagatgctctagcacagtagtgtttaaactacatatacttctgaatcacgtagagagcttgttatacagtttccgattcagtagctctgggatagggcctaggaatttgcttttctgacaagttcccagctgatgctactggtctgaggaccacactttgagaaccactgctctaaaacaggggtactgaaatgggatatcaatttacaaaaataaataaatagtaaataaataaatagaacaggggtccctaacccctgagccatggacctgtt

SEQ ID NO: 124918 - DNA, 1149 bp, Homo sapiens
gagacagcgtctcactttgttgcccaggctggtgtgcagtgatgcagtctcacatcactgcagcctctgcttcctgggttcaagcaattcttgtgcctcagccccctgagtagctgggattacaggtgtgcaacaccacacctggctaatttttgtatgtttagtagagatggggtttcgccaccttggccaggctggaattcatttattcatccaacagatatttactgagtaccaactcttgcaggtgccaaggatgtaacagtgaataaaacagaaatctctgccctcatggagcttacatactagtgagaggacaggcatactcttaagttatatggtaaagtagaagttggtgaggactatggagaaaaagcagtaggagtgaggggtgggagggtggggcgacaggctcagaaaggtgagaggacagtggccacccagctaatataactgaccttcagattctggactggggagctctcatgcctcacacaaagcagccagcatgcagtgagtgccttgtgagtattatgcatagatacctctacccgttccagggaaggaaggatttcttcttgctgaagccatatgaaaggctttgaggaggagctgatgcttgagttgggccttgagcatggatgggatttcattccttgaagcggggagtgtgtttaagagagtggatggggtggaccagagtctgggcctgagtagtgcatgctcaaggaacagtgagaggctccaatatttgggtcaggaggcaggggacctggcactggaagggtgtgggagaacccagtccttgggaggcctgggtggctgagctaggtgttgtggactttggtatttttttttttcatcccatggattcaagttgccctgaatatatgcttctgttcagaatcttgtgaagggaaggtttttgttcagaggagtaaggggattgaggtgctcagtggatggactgatagtgtaagtagaaattctagagatcagcctcattggggcttcattttacacagggattcatccagcttctaacattccaggtactgggatacagcggaggataaagctgacaaaagtccctgccctcaagtcagggttggggtgaacacaagcccgtcctgcagacttaagcagaaa

SEQ ID NO: 124919 - DNA, 1296 bp, Homo sapiens
aggtcatgtgtgcagcatggggagcttattggagcactctttttctagtgggagagaatgaagccccgtttgcaaccccttggagagaggcagaaagtcacctcagtccatgattctggaccctcacaaggaattggagatccttccaataaattcccactcctttctgcttaagtctgcaggacgggcttgtgttcaccccaaccctgacttgagggcagggacttttgtcagctttatcctccgctgtatcccagtacctggaatgttagaagctggatgaatccctgtgtaaaatgaagccccaatgaggctgatctctagaatttctacttacactatcagtccatccactgagcacctcaatccccttactcctctgaacaaaaaccttcccttcacaagattctgaacagaagcatatattcagggcaacttgaatccatgggatgaaaaaaaaaaataccaaagtccacaacacctagctcagccacccaggcctcccaaggactgggttctcccacacccttccagtgccaggtcccctgcctcctgacccaaatattggagcctctcactgttccttgagcatgcactactcaggcccagactctggtccaccccatccactctcttaaacacactccccgcttcaaggaatgaaatcccatccatgctcaaggcccaactcaagcatcagctcctcctcaaagcctttcatatggcttcagcaagaagaaatccttccttccctggaacgggtagaggtatctatgcataatactcacaaggcactcactgcatgctggctgctttgtgtgaggcatgagagctccccagtccagaatctgaaggtcagttatattagctgggtggccactgtcctctcacctttctgagcctgtcgccccaccctcccacccctcactcctactgctttttctccatagtcctcaccaacttctactttaccatataacttaagagtatgcctgtcctctcactagtatgtaagctccatgagggcagagatttctgttttattcactgttacatccttggcacctgcaagagttggtactcagtaaatatctgttggatgaataaatgaattccagcctggccaaggtggcgaaaccccatctctactaaacatacaaaaattagccaggtgtggtgttgcacacctgtaatcccagctactcagggggctgaggcacaagaattgcttgaacccaggaagcagaggctgcagtgatgtgagactgcatcactgcacaccagcctgggcaacaa

SEQ ID NO: 124920 - DNA, 1050 bp, Homo sapiens
tgtatttatttatttagtagaggcgggggggcctcactttgttgccccggctggtctcgaactcctaacttcaacttaactcctcttgccttggccttccaaagccctggcctgaccacagccaactctttcttttttgtgtgtgtgaaagaataggtaactattttgcaaaatcagtttaacacattttttttttttttggagagagttatgctgattcttattgaactagatttgctggcaatattcaaggtagtctaaaatttccaaccctacaagtactgtccagtggagatgttcctgtatcagtaactcctaggcagggtttttgctttgctatggccccattacatctgtgggcacatttttacaggttggtttttactgaggaagggactatttatacttttctttctctttccctaccctttgggccttcagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttgtaagcttttcttcctcgtttataaacacgtcagcagaaacaatgagaacacttttaggatgttaagtcaaacagactggagaatcttggaagctttagattgggggaaaatgaaaagcagtgaactcatacacagctaaaatttccatcttaggtttatttcttctagatgtgaaagaaagtgtcattaacacagatgtactgaatgataccctcaatgagaagaagactgttttttctcttttctttcaatttcatttggaggaaagagggaggaagaatgggtcattttgggattgtatagcggtgactgcttgaacccttttggcccacattcaccttgggagcatcctaggtgtttatttatctggcctgaaaggcagcaactgtgaactcagtgtgtaatctttaatttctagctggtgtgatcccccccaattcagtgcttcattttgatgtactt

SEQ ID NO: 124921 - DNA, 1040 bp, Homo sapiens
tcccaaagtgctgggattacaggcgtgagccactgcacccggccgtgtaagtctctatttctaaggaggcttatgcacgttttggttcctttttatagttttcccatggaagcaagagggaaaagatgaatgtatgtgaagctatggagaggcatggggctacacgggagatcagggaacccttcgcaatttcttctcattagagcgtgtttgattagtggaatagctggcctgtttttgtctatcactagtataaatgcatgctttttatttctttctaaacttgaggacatctgccctgtgtttgggggaaaagatccataaatgtctatctctaggatgggtatgggatcatcgtttagctgatatttgggtaagaaaaaccgtacggagagatgagttggaaatatcctcatggtgtggaactttttccctttctcattacctttcagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatggtaagtccgtctccttcttggagccactctttcctacccttatttttattgcagtggttaattcagttgtcaccacatgaaacccactagacctttcggtctagacctacactggccaatatggtaaccactagctacatgtggctattaattagctaaaatttaaaattcagttccttggtcacactgctacattttaggtacccaatagcctcacgttgctgaggaccaccatagtggacagtgcagatacagacccagatcatttccatcactcagaaagttctatttgacagtgctagtctggattgtctgctgtctgatgattgagttgcagaaatttccacttacttatagtcattggcattcataagtaaccccctctgcccctgttgtacctgccatggccttggccaccaacctctctggctttaacatttgt

SEQ ID NO: 124922 - DNA, 1144 bp, Homo sapiens
tatcttgctttggatatacttaaagcattgagttttactttttgcctctaaaaaattggccgttcgtttcaaagaacaagtctgtgtacagttctccagaaccagaccagagatttggaattttctcctttaaatgtctgtggtttgcatttattcacaaacagaaacccacagaggtatgtatttgggtttgcctgtgggtgcctgcccacctacataaagccttgattttccagcatgagtccagaaaatatggtcatggtagtctcttatgtcattaataccaattttctccttttgctgagtcaggttttagattataccatcagcccatggttggacaccatgggggcccattcaagacctggaagaacatttgtttccttggcttcaaaacctcaagaaatgaataacaccaaccccaagcctgttgagttgtaaagtacttcctaaatcctgtgtcccgtttaatcatcttctcccattccattctagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccaggtaaggaaatgattaaagtcttcaattgccagaacattgtattaaataaagtctgccattggctggaccatgatttaaatactctgtccatgctgatttgtagttggcattttcatctctaatacaagtttctgttttctgatacttagttctttcctcccttccttccttcctttctttctttctttttttttgagacggggtctcgttctgtcatccagtgtggagtgcagtgcagctgcatgatcgtggctttctgcagccttgaactcctgggctcaagcaattctctcatctcagcctccttagtagctaggacgataggcgtgtgccaccatgcttggctaatgttttattttttgtagagatgggcttaagtttcttcataggctcttgtaaccatttctttcttgggggctgttttagatggttctgcaggaagacaggagagactcaccc

SEQ ID NO: 124923 - DNA, 1079 bp, Homo sapiens
gctaggtgtggtagcatgtgcttgtagtctcagctacttgggaggctgaggtgggaggattgcttgagcctgggaggttgaggctgcagtgagctgtctatgatggtgccactgcacaccagcctgggtgacagagtgagaccttgcctcagaaaaagaaagtatagtgttcaatttacattagctccatttctgtgtggtgcttctcataacccacactgcattcataacctgatgaaactggagggccacatggcgtgtccctacaggtggctgttcacatgctgtgtgggggttcttatttacccttccaggggagcatgtttcctggctgtgtcgtcagatactgtggtttacgctgttccggagtctggaggcctctgtgtgcctttgcatctctttcccaactaatttgcacagctgctgtggaggccctcatgaatgacctctttctttcctttcttcttttctagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggtgagcatcagcatcacctgccttcctcactagctgtggctgcttccacattgcttgaaacagggcttctttttctttttcttctttctttttgagatagggtctccctctgttgaacaggctggaaagtgtagtgtgtgatcatcgtgtactatggcctggaactcttggcctcaagtgatcctcttgcctcagccttcagagtagctggcactacaggcacgcaccaccacaccctgcacagaacttcttgagagccaaaatattgaagctaaagtccagcttaagactggaattcccaaatagatttagtttctagagttgtcctgttatttctccttgtttctctgcccattttcctttaccttttgaaaatgttaaatcctacaccaaagtcaaaagcacgttatggtgaattccactttgttttgccagttgttaacattttgctatatttgat

SEQ ID NO: 124924 - DNA, 1071 bp, Homo sapiens
ttggctgggtttgagtttcctcatctgtgatcaacttagccactcatctttcaggctcaacgattccatggggcaatagtccatagtcttgaattttagtccaaactgtgctcattacaggctgtgagacccacggcaaatctgtgcctccgtttatccacctgtaaaatgaggatgaggttacatctaacagccctttcagcgtcagtcttggagtcctcctagggttctgtatctgggtgcccgttttcctcacttggagggccttgaggacatacctggtgacactggggaggcccatgtgctgcagcctgcaggggtcattcattaattccccgtgtctgtcctttagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtaagggcaaccagaatggtgtgggagtgagcctggagggtgacagttgcatgctcccaccatcctcctctcttgggtagatgctggttgagagcttttatctccatgctgccccactgcatagctcgtggctgcatcactgctcaggtgcattgtgttaagagtttcctattaatggtcttgccctgctgcaggtcatttttcaccccatgaaattgtctttctgaaaagcagatctcatcgtataactgctatctttccttccttccttccttccttccttccttccttccttccttccttccttccttgctccctccctccctcccttcctcttctttcctttctttctctttctctctttctctctttttttccttccttccttcctttctttcttttttttttttttttgataaagtctcactctttttttttttttttttttttttttttgagacggagtctcgctctgtcgcccaggccggactgcggactgcagtggcgcaatcttggctcactgcaagctccg

SEQ ID NO: 124925 - DNA, 1547 bp, Homo sapiens
ccatctcaggtcttgctgaatccaaaagccagggttttttgtcttgtttttgtttttgagacagagtctcactctgtctcacaggctggagtgcaggggcacgatcctggctcactgcagcctccacctcctgggctcaagcaaaaaggaccccattccactatgcttctccactctggaacttccacagtcttgcctggattttcatggccttgacagttttgaagatgacagccagacatttttcagcatgtgccccaatttgtttttgtctgatgtttcctcatgattagatagggatttgcatttctttggtagaaatatcctagaagtgatgtgttcttctcatgggaacactctcagtgccaatgggttggtgacctaacatgaggctcttctgtttcattttaggtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtgggtgagtaagcaacgctattcaagggtgttgggggcccgcttactatctgaattttgtgctttttggggtgccatagttagaatcacagcatgcttcttacatgtaatacccaaagagtgtgtggtttctatttttaaaaaattatttagtatttttgtttggagacccctgtgaattcagtgagccacgtcaatgctccattaccctcttgagaaagaaccagtttgagtgaaataaatcttggatcttcagacccatgtgtgggaggtgtccccaggggagctgtccgggaggtttctctggggtcagactgagcacgtccttctggaactgtttcctgggacaggtggaatgctgtaggccgttgcttttcacttctgagcctgtaggctgtccaagacagtttcctttgggagagattagttgcaagttcttgaaatactggctttacctcatcctcacagtggttatgttttactccatcatttcagccacaatgtgtcctccacgtggggattcaataactttttttttttcagcgacagggtctcactctgtcacccaggctggagtgcagtggcaccatcatggctaactgcagccttgaactcctgggctcaagcaatctgcccacctcagtctcccgagtagctgggactacaggcatgcaccacctcgcctggctaattttttattttttagagacagagtctcgctatctttcccatgctggtcttaactcctgggctcaagcgatgctcctgcttaggcctcccaaagcactgggattatcagtgtgagccactgtgcctggccccaggaaccccttcttttcagtgttttcacactgctgatatctggacatggaggagataggaagagctaactggtaacaatgataggcactgtggattgatattttttccccgtaaaagaattgtaaagtacattgttcttcctaccaatcccagaagaaacgctttaaaaatt

SEQ ID NO: 124926 - DNA, 1699 bp, Homo sapiens
atgtttgcctccctggttcaagcaattctcatgcctcagcttcccgagtagctgggactacaggtgcccaccaccacaccagctaatttttgtattttttgtagagatggagtttcaccatgttggccaggctggtcttgaactcctaatctcaagtgatccgcccgagtcggcctcccaaagtgctggaattataggcgtgagccaccatgcctggcctctattctattccttaatttaaaaaataactaaacgctggtcaccaccctctaaactgatttcgtgagtcattaacgggccactgcctacagtgagaaagtgactagcctctgctccgctttcttgctttggtcagaagtcccactctgagtgaggctgctggaggttggggtgggtgctggttgttgggcttgactgctgcctgccggctgacaccgcctcccgctcctgtcacctggacagatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagaggtaactaactggcctctgtaggaaggtgggaccgaagagctcagggagcctggtaaggccgtggggccggttctgaaggtaaggacttctaagggtgaggccagctggctggagggcttgtgagatgaccagcacacttgtgtgccaagcgcttttacacacaccctctcgatggaagctcaccattcctctctgaagaaaccgattccctaagaggtgtagggcatgattccagggcatacagtctgcatttagttctcgttactgggtgctcaatgcctgcctgtatgtgctgagtgtattctctgatttggccctcacagcagctgttttttagaagaaactgcacagagaaggtaaatgacttgtccaaggtcacacatctactcagttgtttgagccaggaccacactcctctttgtgaagctgggcaatagaaccatctgttctgtcccacccctggggaattccagctccctgcctcttccacatctgctattgaagcacatcctccagccttttcctctctctctccacatcatcagcccttctggatctttctcatttgcatacaaatgtgctattattttcccttccctggatgtgtctgtttctttcattgctttccttcctttacagcaaaaacttcaaaagaattgtgtgtcctttctgcctccaattcctctcctcccattctctcctaaacccactcctttctggcatttgtccctctatgcctctgagcctgaccttgccagggtggccaatgtcttccgtatcgcggaatccagtggtcagctcttacgctcctcttaacttcaacacagctgattcccctacaggacgcatctttctctggcttccaggacaccacacttcatggtgttccttctacctccctggtacgtccctctcaggcctcttgtccctgatcgcttcatgttggagtaccccgggctaagtcttgacctttgttcttttctctgtctttaagtcactcgctcagtggtcttatcgggtccatatcctgatggcgtctggatttgtagctccagtccagtcttctctctcca

SEQ ID NO: 124927 - DNA, 2065 bp, Homo sapiens
atccacccgcacaccccgcttggggcctgctttacccaaagcctttcccgtcgcagtcagtggcatcactggcctccagtggctcaggcgagagcactcggtgatctctgactcctctctttctctcgtaggccgtaatggtcctcaggaaatcattccagctctaccttgagagcacacacagaacctgacgcttcttaccacccccaccctgtagcatcttagcccggggcctgtcatctctttcccgggtcacacacagcagtggtgttcatgaagctcctcctgccctcacagtggctgttctcacacagaagctgggtcagacccgcagaggcccctgtctacagggcctcacagtggcctgtgaagaccctgcactttctgctcgctgtaacctctttgccggctgtctccctctgcccactttacccggccacacctgcccccagtgctgtctgtgaccacccaggcatgcgtccaccttgagccctggcaccggctgccctctctgctcaggagacatctaccccagataacttgttcggtcctttccttctcatctttcaagactttgcacaaatcttcccttctccttaaagttttatcctgaccactgaattcaacacttcatccctttctcccttccttactgagctccgctttttgatttttttctggagcatttcactttgtaacttaatgtgtaatttacctatttttatgttcatgtctaattgtctgtttccactagaatgcaagcatcacaggggcagggtgtttgtgtattgatgtatttcaagatctagaacagtgtgctcagcacatagtagaccatatgttttgatcatatgaatgaatgcctgcatccaagaatgttcttacagtcttgggtggtcttgggggtcagcctttggtggggaaccaacttgggagaaggaatagctctgacggctgctgggtattggctacctgaataataagggctcttggagtcatttagcacaagggtttttcacctgcatttagagaaaaaaaacaaaacacagatcataggtcatatagctgccaaaaagatcttgtctgtgttggtagcccagactcaagttccagccctgtcacccccagactgctctgtttctggccccaggcctggcgttcatggcggctgaactcatggtctttcctgtccccttcttttccagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaa

SEQ ID NO: 124928 - DNA, 1323 bp, Homo sapiens
cacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatattatctggttttctgatattttattggaaggctgaagacctatgagaatgcaccatgcagtcagaatccccttgatgaaaacagcaggacttcactgcatttactgagggagcgcactctacttatagggagtgtcagtcagggtcctggccctcctctgggactcctgaagagaagctaaggaaaggactgtttagaggggtgtgggcgaggctgggggaactgaggctgttgagtgccagtgacagcagtgttggccaccgcaggaggctgctaccaccagggcctgagagctcaagaggaggcagtgggagcagcacaggaagggctacctggaggcgtaacagagggatgcagccagctgcatctgacagtgcggctgacactgcagcagagcgagggacaaacgccccatcccctctgtgcccccattctctgatgcctgccactggct

SEQ ID NO: 124929 - DNA, 1993 bp, Homo sapiens
atagctcaggtgcttatataagcaaaccaattaggtgttcataggatctggaattaagggtaagaatcacggtcaaattgatcacaatggcaggtctaaatcctgaagatgaatgatgaggcagagccagagatgtggagtgggtagctggactgtacagagagatgctggctcctaatgtcgcagtgctgctcagattcagtcaccacgagacccagctccactgcttcctgtctcggcttctgaaacttgcagacttgtaccttttactgatgttttaaatgggagaaaataattttcagaggtctcagtattttctgaagggcagacaaaattttccctgaaatatctttagacttaaataatttctgaaaatattcaatctaaatagccactatgacaaggactttagaatttatatatcacaaaagacaggcagacggagagaaagaaacaagaagaaaacaaaaaaccatggtaggtgctcaataaatatttgttgactcagtaaagatagttttgaccatagaattaaaaaggttttgcatttcatatttattatcagtgcttcaatatagaatgttttgtaatgattagcaacattgtaaacaccaccaggtttttccaacactaactgctagtcttttccagtaaatattttttccccagacaaaataaccaaacctaacacaatttcaagagatggtgataccatcagcataataacccaaattacaaaaatggcaatacttaaaatcatgcatattatttcaccatttcataaaacttattttaaaatttctacaaactttcccagtgtaaaagactcctcaaaagctgcatgataacattaaactacaaaattcactttggaaaagtagggagttatttttctaattttagcttttttttttttttaaatgggttaaaagatacggtgaggagtgtgttgagagaggtggagaaaaggagcttccagtcaatgcattcaccatatctgaaaatacttcagttatacaaagggaacacttcgagagtaaggatatattataaataagtctctcagcaagatgaacggatgaacagttcaattgcacccacaggagagaggtcttcttggagaatgcttgtttatagaatcttctgtaaaatagagttggctacttctaatgattcatcttgtactaaaacaatatcataagagtccatgtacttttctaaaagctcatccacctaatcaagagatgaacaaaagaaaattaacatgcagggcaaagaaacaaataatttcagtatgaatctcgttgttagatctcttgggcaaaatgcaataaattaaattcactttcaaaaaatctttgaaatgaagaaatattttcaaatccttaagacccactgacagacatttttccacatggtagcttttctccccaaaatgctctctctccagtccagtggctttcaaatggggtgatttttgtccacggaacatttagtaacgtctagggacatttttgagtctcatggcaggagactgctatccagcatctagtgggcagaagacacagaggcctcctacagaatacacatcctcccttttcccagtacctatagcatgcatctcagctcctttttaaacatcaccagtataaagaacaatcaaaatgcatgatcacaatatgttttggctgggcatagtggctcacgcctgttatcccaagcactttgagaggcctggagaatcacttgagcccaggagtttgagaccagcttgggcaacacagggagaattcatctctaaaaaaaatttaaaaatcagccaggtgtagtggtgtgcgcctgtagttccagctacctgaggggctgaggtgggagcattgcttgagccgggaaggtcgaggctgcagtgagatgtgattgcatcactacactctagcctcggtaacagaggcttgtctcaaaaaaaaaagtctctaaaataactactttctca

SEQ ID NO: 124930 - DNA, 1202 bp, Homo sapiens
tcaaaaatgtccctagacgttactaaatgttccgtggacaaaaatcaccccatttgaaagccactggactggagagagagcattttggggagaaaagctaccatgtggaaaaatgtctgtcagtgggtcttaaggatttgaaaatatttcttcatttcaaagattttttgaaagtgaatttaatttattgcattttgcccaagagatctaacaacgagattcatactgaaattatttgtttctttgccctgcatgttaattttcttttgttcatctcttgattaggtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaactatctttactgagtcaacaaatatttattgagcacctaccatggttttttgttttcttcttgtttctttctctccgtctgcctgtcttttgtgatatataaattctaaagtccttgtcatagtggctatttagattgaatattttcagaaattatttaagtctaaagatatttcagggaaaattttgtctgcccttcaga

SEQ ID NO: 124931 - DNA, 1035 bp, Homo sapiens
tgtatatgacacttgccataacaaagattttctctcttgttcactaagtagcatcttcagtatgtagaaaattcaaactacaaacaaattttaaaaatggggttgctctaattcattttactgcaatcagagaaaggattatgcttccataggttgggttgagtttttatgtgtagaattaggaaaggtttatagctagtttcctttcattaccttactaacatatttaagctaagtctgggtttgggaggactgggaaactcagtaagaacatgcatatcacattttgagacatgaggtatacattcattagtgatgaacttcaatctctaaaatttaaatccaaatatgaggaacagattttctcacatggaagaatgttttgtaataaagataataattttagtttgtcttaattgatagtcttttttcctttggtcataaactccaggtatactaaatcacatggtttgcttgttcagcaagctttaccaaaagctaaacttaaagaaattgtggcagaatctgacgttatgctcaagtaagtttcttggatgttttttgctgttattgttcacagacttgaattattgctatttatgtagtcagttgtactttttaaaaataagattgaatattccttatataaccatatccaaaatatgccacctatcacaaaatacatagtggtaagataaggaatttagaatgacgtattagatcttggtgtaggtagtaagagccttatgagatttaaattctaatttgtattttgtttctccagattaaaaatgtcaagacttaaaatttttgaaccaaggccatttaaaaattttttagcaaaatacttaggaaagacatatgaaaggaatgtataaatcaagttaaaagggatttaagtatacttttttttttttttaaagacagggtctctctctgttgcccaggttagagtgtagtgacataatctcttcctcagttcaacctctgcctcctgggctcaagcgatccccttgcctcagcctctcaagtagc

SEQ ID NO: 124932 - DNA, 1028 bp, Homo sapiens
actgataagttttaagtatttttgtgtgtataaatggtaatgtgggagctgggcttggtgtcccacacttttaatcccaggactttggaaggccaagatgggaggattgcttgaggccaggagttcaagatcagcctgagcaacaaagcaagacctcactcacttctacagaaaattttaaaaattagctgggtatgatggcgcatgccttctacctactcaggaggctgagatgggaggatcatttgagcccaggagtttgaggctacggtgagctaggattgtgccactgcactccagccggggtgacaaaacaagacctcatctctaaaaaagtaataacaaaataaataaacggtaatttgatgtggtggcttgctttttaaaaataatgccttaatatttttatgtctttaaataagacaggtttctgcttggtatcaaaggaacctggggaaagaagaatgaaaactaattaattaattttcttttacttttagatgccagaattccagaaaagttcagttcgaatcaagaaccctacaagagtagaagaaattatctgtggtcttatcaaaggaggagctgccaaacttcaggtgaataattatcaagaagccttggctgtgtgtgttggctcatgcctgtaattccagcactttgggagactgaagcaggaggatcacttgagcccaggagttcgagaccagcctgggcaacatagtgagaccccatctctatttaaaaaaaaaaaaaaatggccgggcatagtggctcacacctgtaatcctagcactttgggaggccgaggcgggtggacaaggctgaggtcaggagttcgagaccagcctggccaacatggtgaaactctgtctctactaaaaaatacaaaaattagccgggcctggtggcgcatgcctgtaatcccagctacttgggaggctgaggcaggctaatcacttaaccccgggaggcggagtttgcaatgagttgagatcatgccactgcactccaaaaataaaagctta

SEQ ID NO: 124933 - DNA, 1051 bp, Homo sapiens
ttcttatgtgagtaatacacagtttagcattcacaattttattaccttatcaatgtagtttacatgtttctgcgagtatcacaattaaagcagtcacagtttttaaagctatattcatgaatttaatctttttcactttcctgtaagacagagtcaagtagacctttaaaagtaatcagtttgcattcaggtactttaagacttgctttaaatcaggtaattttttttcatgtagacataccaatcaattttcattaattgacttgtaaactatcatcagaatgaaatactgtgataactaaagttttcagttatcaagtttgtgttaagtgaagttcttacctcttgcttcagtctttagacttgtcctacatattccttgtaaagaactctgctatagtagagaccttaatctcatacaaaaagcacacaaagtaattattttccagtttccacattttccagttcacatttaaagactctgaagacttaaaatgttaaaacttcctttgaagagagttcgtagatcaagggcagtattttctatttttgaacacgtcttctacacttgatgtgttttttccagcaactcttctcttgaagcatctgcaacagatgaccattggcaaagtaagccagaactttatataccaggtataggtttacaagcctattggtttaaaaatactctgccctaattttcagtgtcttccttagaatagtgccagaatgctgacattttacacctgagtctttacactttttaaatgataagaccttagagtaatttttgtataaggactgcagtatcactttatgtgagattatctttgaacaaagataaattctggtcagattgctagtgaggactggcaagaatgaaagatctttagttgaaatttgcatagtattcatgaattgttggtatacttaccaaaaaaaaaaaaaaggtcctaaagttggccatcaaatttcttatcactctttgtttttatttgatgagaccatgagaaagatgatcattcttttaccaacttatactgactttttt

SEQ ID NO: 124934 - DNA, 1010 bp, Homo sapiens
cagttattatgggtagtaataaagattatcaatttttattttgtgcatgtgagctttacccaggattttatagaatgggattatcactggtatgttttatgaattgataaaagctagattactgatttataacaaattatatattgaaaattaagattcaaaaatttatattacagtaaaagcctagaatattatggctaagttatatttaaataattgaattatctatattttataggtttttttttcctttaaatcagagaagttagatcatgctgcagatcatttcttaaagcagtttgcttagtttttattggcagcctgcatccaagcccggcatctctgggtagtgcttgtcacctatgctgttgtcctaggacaaattcaaggacagaagaactcagggtgtcttaagggttgtcagtataaattacttagtttccatgtgctgtatgtggtttacttatcttgaaaaaatgctattagatattagaggtagtgaatgtgggaaggatagaggaataaattctaaacattgaaattgtttatttgcataaatatccacaaaattctgactcagtagctgctttaccatttgggaaaattggttaaaattgcccatttttaaataactagcttttgaaatctgttttttcctctttcctcctatatctcttctacccctcccactctttgctatttagtttcatttttgttttatgcctgtattgagaaagtttcactttgcagcgtgtgtgtttctttttccccaccgctgagttgaaaatctaattaggaagaattatttaaatgccccaccaaattattacagccatacagaaaagatgaagttacagtttgattttgcatgtgctaatcacccgaagacagtaacattaaaaaaaaaaaaaaacaaaaaacccaagcttaagaaagtcaaatagtacaggttactgaaaaagtataggaaaaattgatgtttggtactgttgcggatactgtgtccatat

SEQ ID NO: 124935 - DNA, 1021 bp, Homo sapiens
ccgcagttggaattagatttctactggggcggggctcgagcgaaccacggcctaatcctcattagcagagaaggataattaccgcaatactctgccctgccctgacagcagctcgtgagaccctgagtctgctgaaggccgcctccagcctgggctccgggcacaggccacacccctcccgccgcgtcctggcctctcccatcgatggcgtgtgggtggggcttcgtgggggcggagctgcgcggggcggggcgtcgctgcgcggggcggggcgtcgcgggctcgtccgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatggtgagtgtggaggctcggcgcgcccagagcacgcgaggggccggctgggccgtccgctggcctcggcagcctgtgctgggccgctgttcggtcgcgacggggagctgccggcgtcgcctgtcaggctgggatctcgctagctcgggacgcgcagcttgggggacccggccgccccgcgtgcggccactccgcgggcttggtgaccagggttgggtccccggctgcggcccttggctgcccgtggtctttgttaggtttccgtttgaaggaacaaggcagaaaatagatgaatcggacacaggctactttgtgctgcaaaacccgtttctctagagataagctgcatgtcctgggcaggtggctccttctctccctgccttgctcccgccctccccccggatccgcgtcaaaccgttgccgctaatctagttgcaattcccgcagaggactagttttatgttggggctgccgtgagttagattatgaaaatgtgcaatatctaaa

SEQ ID NO: 124936 - DNA, 1039 bp, Homo sapiens
ttgtaaatgcagttattgagtggtaaaaatgtacatcagagatatagcatgtgtgtgactgtaaaacatgacagggccttcagggtataataaactattctagcataacaggccatttctattattccaggaagcctggtttactttaattctatattttgaggtagtgaaactttttttttttaatctcagaatcttatttggagctccccagtcattgctatataaggacagatttttctgcttcaccagtaacttttctctaagaacagctacattgtttttggtatagttcttctggtacatttgtttcctgttttttcaatcaggtgtaacttgtctttttttctagttttgaggggtaactaagatgatgttggcaccggaagcccaggaaaaagccaggcaagggtggctccaaggggagcaggagagaatcccagcgctcttgccatgctgtttatacctgttcccttttttaggaagatgagactaagccagaagattgcataccagatgtaccaggcaatgaacacgccagggaatttctggctcatgcaccaactaaaggactttggatgccactggggaaagaagtcaaagttatgcagtgtgagtgtgggagagtttccctaatccatgcaacttacatgcctcaatttacaaagagtgtttacttcttttatttaacttgttctcatcacagccctcttacagccaaggcacgttctccatcttctagataaggaagcatccaccccaccccccaccaccgtgccatgtgaagaagaaagagggctgtcatcttaagccaggaagaaagctctcaccacaaacccaccttgctgggaccctgatctcagatttccaacctacagaatgaatgagaaaaccagtttctgttgtttaggccacccagaatacggcattttgttatgtcagcccgagctgactaagacaccatctttctgcaggtccccttagcctctctcccgtgttggatcacccattttcctgtgtcttgagtcttctttattat

SEQ ID NO: 124937 - DNA, 1223 bp, Homo sapiens
ccaaatgaaaattttttcacttttccctttgtctattcttgactcccttttccaatattcattgtcttctaaagggtcccttaaactatgcataagacgagagtccgaatgaagaaaacattaaatcattaagtgtttctctatgttgcagccattctgaagtattaaaataagagagccaggtgtcatggtgccatggtacacaactgtagtcccagctactcaggaggctgaggtgggaggattgcttgaggccaggggtttgagaccagcctaggcaacacgacaagaccctgtctcaaaaaaaaaaaaaatacttccctaaaggtttaaagggtcaagggacagacctgagctaaaaatatttgcatattactcttttgggaggaggtacaaattgctttaggagcctgagagttgctctttgagtgcacaaacacctcgccttcagaatttccttcccatcttgctgcctgtcccatctggagacttgcgtgctcagcattctgggtctcctctgggttcagtccctggatggaaataaggaaggcctggccagtcttagatggcaggtgccgctcagcacagggaggagaagcattctgctcttctcaggtgattgcttgtctgcaaaccagtgataaaagcttattgttgctaaaatctctgattaaaaatcctatagccccttttttgcagtaacttgatgtgttatgtttacattaacatggttgataaggttttgttttttgttttccagttacgaaaaacctcctcctgggcttatcaaggttagtgtgaagtttgtactcttggttattccacaagacatacttgtagactcagtaacttgttatgaaaaataattgcatgatgttaaatctccttttaccaaaagcctgtttcttttcctgcagatgaatgaggggtcataatttttagttttgtcacaagcctctgcctttgcagaaatttcatcagccatgtttcccttccctgaagaaccagtgcaggcccacgtggattccttggccatgcccctcttctctcttgctggggatggcatctctaagctccttttccttgtcggcctcacccggctcagcccctcggtccatcctctgctggtttcttgagctcagcagctcagagagcagtaaactctgaggagatctgacagctatccagtcccgctccctggtacaggcatccctcctgcagct

SEQ ID NO: 124938 - DNA, 1067 bp, Homo sapiens
cttgaacccaggagttcaaggctgcagtgagctgtgatcacgccactgcactccagcttgggtgacagtgactgcaaagataaatgcatacctcttaactgtcacactgtagaacctaaactgtgcgtgaacatacttcagttttctaatctgtatttagtagttaaatactactttcagaaatatatttttgagtatactacattaatgaattgttcagccccgggaaacaacatgaaccacccttctttaaacttgtgaaaccacttgtaaaatggactttgggaatgccattgctgataatattatatttccaaatgtgcaattgcatcacactcattttcatcttggcaagaacagttacttttttttgagaatttggatctcaattcgattggccatatattttttgtataatgcttgtggctcaaaaggattcatttattggatttttggatttatagactttactgtcaagctccttctagtctctatgcataaggtatagcattaatgtttctaatgaatggctacagataaactatcatcttcacaagttgtgcagatttccattgtttttgctccattaggcctatgtcatgccacagctttttgttagaaatattttaagcacctactttgggaaaacactgtaccacacttacaaagctaatcctgttaatacacagttgtttactatttaatcttgagggaacagatctgggattagtagtatttctcatccattgtccatcaagttgctttctcccacatcttatagaaggggagaatgaatttttttttttttttttaagacagagtctcactctgtctcccaggctggagtgcaatggtgcgatctcagctcactgcaacttctgcctcccaggttcaagcaattcttctgcctcagcctcctgagtagctgggattacaggcacccgccaccacgcccagctaatttttgtatttttagtagagacggggtttcaccatgttggccaagctagtctcgaattcctgacctcaagtgatctgcccgcctcagcctcccaaagtgctgggat

SEQ ID NO: 124939 - DNA, 1049 bp, Homo sapiens
ggatgaaagttttaaagagatcaaataagactgggcacggtggccgactgctgtaatctcagttcttttgggaggccgacgtgggcagatcacgaggtcaggagtacgagaccagcctggccaacatggtgaaacactgtctctactaaaaatacaaaattagctgggcttggtggtgggcatctgtaatcccagctacctgggaggctgaggcaggagaatcgcttgaacccagaaggcagaggttgcggtgagctgagatagtgccactacactccaacctgggcaacagagcaaggctccatctcaaaaaaaaaaaaaaaaaaaagagataaaaatgacttgcttttgaaaatgtgtactttttagaacttaattgaactatcataattgtacctaattttgaaggtagttttttttaataatatttaggtatcagactgataactatagtctttctgttttgtttatgttctggtttgtactgattctgtcatattgtttgctggaatttagtaaaaattatatgacatcacttcatttgtatcaaaatttggtcttgtaggggacagttagtaaaatattttgtattttgaaaaatttccttttgtagaaattctttacaagaaaaataaatttattggacctggaaaccattcataccataatgaaattacactagctctatttggtggtagaaaacaattgttaaatccttgctttcattatcatattataatactaaaacctacattctagcttattcttatgcatcttcatgttttttaagtgacctttcaaacagtttaattctgtattattgtatcattgctatttgaaatttgtatttggtttatagtcatgggctttttttttgtgatctagtcattaccctcttaaaaagaaaacttattataactattcttttgtttactgcatataaatattatccccttacattttttaaaaattgtttttcttgcctataattaaaacagtgggatctgcaggaaaatgtgaaaggagaaaattgtattggtaaagcagaa

SEQ ID NO: 124940 - DNA, 1018 bp, Homo sapiens
tataacttatactcctcttttcttctcttgttacaactgttagatctgaattagaatttaatatatgtcccttttgaacaaaccatgagaagtcataaattaatggattagttctttggtactattatacattttattttgaggaagtgactattatagcaataccaatctttctgatttagttatcatagtcagatgttttaattcttgctctaaagttatatcattttaaaaattatacaggtaatctattaataattttaagaaaatttggaaaaatgcagaaacttattaagaagaaaattaaaatcacctttaatactaaagtttagatataaatagaaatacatgtacttttaagtcaagtactgttgaaaaatgtagtgtggttttggtgaacacttagagactttgtagattgtaattaaatcctcccttcctgggttaaaatggtaaactgtgattttaaacagttcttcattttttttaagaaaataaagatgctagagctcatcattatttttacttccttaggtttgtctgaattgtataaataattgtgataacatgtacaaggatatctctgagataaaaagggttgtttatgaatgaattatccatttgtgagattaatactaacttcctcatatgtgtgtaaagtaacttcttacataacacattaaacctttcaactgttcatgtataatatatggcctaggtgtatgtgcttgtatatgtgtgtgtatatatctatatgtatgtgtatctgtttctaattttataaacaataaaatctaggtttgaacagaagccatagtctttgctatataattgaaacaacatgtgttttggtgtaggcaaatttaaggaaagtcgtaactctcaaacaattcatctgtttagaaaatggtttcaggactttatatgttaaacccataattctattacaattgttgagttttgtaacaagaagcatttgttctttgacttaagcctttagcagagtttaacaattaga

SEQ ID NO: 124941 - DNA, 2063 bp, Homo sapiens
gcacaatagtaatgtctaatagaatgaattatctgtagtgaatgcgtagtaaatcattagcttaaatgtgttacatattaatgaaattcatgctttctagatgaaatgcaaaaatgttggtgattatctagttatagcttccaagactgtaaaatgattcctttcttttttatactggtaaagttacaaaataatgttttattatgtaaaatctttatgtattaaaatccaggtgttagaattagtttgtgctatcaatttcctaaaagagatatacttttccaaatgactgttttcttagtgtctcttttctgtattttcaacttacagtttctgaaggaacaataaatactttgattggaaatcataataacatgctgcatatttatcaagatgtgacactgaagtgggccacccaacttccccacattcctgtagcagtaagagtgggctgtttgcagtaagtgatttaatttaacacagtttttaaagaggatgttagtcaagaaattttctagaagttctatgaaataatgacaagtgattttattaaaaaattacaggtgacattgtagtatgaatgtcaataataaaagtaatttaaaatataacttttattggaaaggaaggataattagtgctattaatcattttcatttaatatttctagcaagatatccttagtaaattaaaggtaaaaactggtgaagacatcaagaaaatggtttacttgatagattattcttcagaatacaaaaatatttcttttagcatttgatgagtcccttttagagaacatttattgatagactgtgacgatattacactgttcattataataagttctcaccttgtttcagacgtttcattaagtcaagtgatgcagaattgttaatgatcatgtgtttacacagtttagattttaagtggggctactttgtatttaaattgaaaaacagaattcatactttaacattaagtttacaaaatttatcaaaaatgacagaaatgagccatctaagtgagtaatttttctaggtcatcagtataaaaactgagatgccgatgaactttttagcatcttagattatgtttaggaattgaaaatatcagcaaacgtatagaaatacaactttccataaagcttcatagattctcagatgtattcagttctacttatttataatattttattgagcatttaaaggccatacggggcggggcacagtggctcacgcctgtaatcccagctctttgggaggccgaggtggttggatcatctgaggtcaggagttcaagaccagcctggccaacatggtgaaaccctgtctctactaaaatacaaaaaattagccaggtgtggcggcgtgtgcatgtagtcccagctgcttgggaggctgaggcaggagaattgcttgaacccaggaggtggaggttgcagtgagccgagatcacaccactgcactccagcctgggtgacagagtgagactgtgtctcaaaaaaaaaaaaaaaaaaaaaagccatctgtagaattcttcagtgacacctatagtttctcatcaggatggagttgttttctcctattaagggcttgagtgtaatattattgttgaagctcaacgaagggtattcatatttgcatcagtgttttatctaaagcctgaattttagaaaaatggaaacggtgttttgaaaacattgaatattttaaaaagaagttgctttcttatgttttatgagaaaaaacatataattctaattgctatgcacttaacacaagttatagttattttgtgtctgaaaaataatttaaaagttttgagattggcttttgcaatgtccatcacatggtctttttaaatttaacagaatattcatactcaccagacattttgtatcagatttacttagaaggatttagaacaggaaaaacatcttgccagcagggcaacatcaagtatttcacttctggaagagtaattcttgcaggagtctatatatccatccaaagctgttctctttggtctcttaagtgacagttcatttgcaaaaagacagatcc

SEQ ID NO: 124942 - DNA, 1695 bp, Homo sapiens
ttcagacacatacatgtaataatttaggagtgcactgttaattgcaataagagatcttgtgccttaactagataacattgctcatgctaattgtacccccagccaaccaggaattagcaccgtaagtaaacatacctttccctcccatgcagttcttaagctttcatgtgtagtagccaccttaaaatgatggcatgacactactggaaaattctccttctgttcgtggaacttactatatttgagaatacctaagtcacaactgtctttctcattgccattataaaagcatgagaaagaatgcaacaggcaaggggtgcagaaaattggtgggactcacacagcagacacaatgtcttcctgatcctgtctgacagtttctatacaaatttctactataaatctctccttatgaccttttataacaacagcagccaagatatacaaccatgcaagtttccatcataataaatcctgttaattgagaaaatttttccatccgttccaagtgaatgaagatgtggctaccttgagtatgtgtgcatgatgcgtgaccatctattccaggcaactaggcgagtggttgttcatacctggcctctggtgttgtatttatatatctaggataaaaatttggtattatatttcctaagggttatatttcataagaggcagaaaatagcatggaaaattcttgtatcaatgttttatattttctccttaatattctataattattttcctgttaaaatataagacttgtgatctagccaagtctttaactcttttttggctcaaacacaactattctttgttactgttgttattttcattacctatctccttgatttgtattttgaaagggcctagcccattgttggggttcaataaatatgtgcatgagagctatcatgattgtgcaactaaaccaaatgcaaacccttcttgttacaatgtaaaattctgtgattattgtctaagtagacatcgttgtgccaggaaaagccagactgctctttttcaaatggcttattactacttaaaggaattttcatttttacttaaaactgagttctcataagactttcctggtcactattttcaactctctacttggattgatggctttgcacaggttatttaccttctctgaacctctattttttaaactgtaaaatagggatactttttcatctgcaaagttattttgagtcttaaccacagttggttaaaggcatgggctcaggattctggcagatagcagttaaattgtggttctgccacttgcaatcaaagtggccttgggcaaattacttagcatctctgagccacagtcttttgtaaaatggtttatgatggtacctgtcaaacatttttgtaaagagtaaattaaataatggcacgtaaataatttgttagcatggttccatgaatatagaaaattgctaatattttttatcattaatattattcattttatttaaaaatatatgtacagactagtattatattattataatagtagaatatttaaattgtgtcttgtttgtttaatggactagctagttgaaagaaagttgtttgtagcacttgcatggtgtcttcctgccataataaccatcagggttttactaaaaaggtattatgtttacaatggccagacatcattgaggaagtttagtttgtggcatgatg

SEQ ID NO: 124943 - DNA, 1044 bp, Homo sapiens
ccattttggtgcatttctcttagtttaacagttatccttggttaaactaaaaaagttatgccaacatttctttgggaaattgtacacatttgtttgactgcagttgatggtgccatataatgaatctgcaaatgagaccattaaaaaaggcaaaaatttttgcaaatgaatatatttatatcctaatgtattttatttataacttttaatataaagtaacaagtagaaccctgatgttgcccacgattaccttactgctatctaaattttaccaaaaatcaattatatatctgatttattctctttgtctgaatgtatggcaattccctgacttagcatagtgtaggtacacaaaatcaaataatggaataggacaggaccttttaaacaaggagccaaataaactgtgtaaattgaaacctgaataatagtcattacaattctatgatggtttttggctacagtgacacacagaatcctacctaggagatgcctatggtgatggagagagataggtataaggagagtgtacttttctgagattgaggcagatgttggtgctcctactgctttatcagagtattcattcctaagaaaggaatgaagtaatttgtacccaatctgtgtttgacatttttcattttttgaaaggtacctagtattaattgtagtccagcaatctgctttacagaaaaatcctacaaatgaaagaacctagtatttcttccatagtaaacagtcaaatgattcataagtcacatagaattgtccttgactcttggatagtattttctgtgggttccgtgtattcatctctttttaaaacctgcttggtaatcaaccaagccttcatgtatgctgtatggcgattttagttcctttttctgattcagtatagaccagtcaaagcaaacaagagaaaagtaaggtgtagctcattgtctcagacaccaaaccaaattccctggggaactgagtaggattatatttttagaaagcagaatagtagctgggtgtagcagcttacccctttaatcccaacac

SEQ ID NO: 124944 - DNA, 1050 bp, Homo sapiens
tatttattacttcatttaatacttagaatcatcatgtgagggtggcattattgtttatagaggaagaacctgagactctgagtagagttaagaaacttgctcagtgttacacagatattaagcattgtattccaaagtccaggctttagaatatcaagtggcaattttactttaatcattgtcaggtgggacatagacagcctagattttctttagcaaaattatggtcagggtaaagaaaaaggaaatgtgtgcgaactgtttgtacatgttcatgctacgtatatgtatattcatgatcatctaatagtcattgtatacacacctattagacaggtaacaaaatcttttggagagttccctcaattctgaaattatatctgaaacaagtatcagaggactttttttgggtgtgtgactttgttgatttcacttatacctaagtttagcttctttgccttcaaatgctaatgctgattggcagaaaagctttgccaaataaattctctattttattataacattttcacataaatttgttagtcaaagcaagactgattggttgagtaaattgaaatggaagaaattagacttaccctatgacttggcttatgttttgatgctattacatgtgctgaggtttttctcctcacttcaacactaaccctctgttgtagcagagggaaaatgtttactgatctaaaagttggtgtcagatgacatatgtgtgatgtaatgactagtagtcattaatgttctagagaggcagatggctgacttttctcttctacaaaagaggctgtattaggcataattttaaatagagatcctgtggtttggagtttgctatttgttactttttctgtactttaaacttccttccactctgtttatttgtatggtattgatatataaaaatcattttaagtcacgcagaagcctaagagctttttggtccatgggtttttaaatgagcatgattttggctgataacacagaggaatatataatgaaaccattcagaggcccactttcctcattgtcatggac

SEQ ID NO: 124945 - DNA, 1046 bp, Homo sapiens
ccaccagtgcacagaacagtaacataattgaaataattcatgactgtttgacaaagacctcagagaaaaatgtgtgttaaagaagagatggcttattcttcaatttattttcatgttccctgttctctttagggcgtggaatccagtactgatcatctcaaatgttttcttctctgcacccatgagtcccttgctttatatcttacttttctttaggaagcttagcctcatcagaacactgtctcttttcctgttgttgcttgaaattcatacctccctactcatttgcctaaaatcttagtttcatcttggtcagtcacctctcccatttctcccaggtagtcagcaggctaagtagtgactcagccccctctctgtcactctcccaggagacaaccttatattctgtcttgtcagaaagattgagactctcagctatgtctccctcattgtctcaccaacccttctagaaacttgtctacatctattcccaactttcctgctgtccttcttgtctcaaaggatcaggtacgttatttctctttaagatcaacccttcccttgatccctttgaccttctgctagcttctggaatactgatttatataaaagccagtttgtctggctgttatatttttgatctgtcccttgctcttttgctttcttatagcctaaaaacatgttgaggtttatcccaacatagacctgcctcctacaacttttctttgtgtttctcttctagatgcaacctttttctccttttcacacacgtctcgtaagatccatagtacttttatttttttgctttctcacctcttatttcatgtatccgtctaatatatatatatatataatcttggccacagaccacagaagaacttaaaatgttggtgttttttttttttttttttttgctttatatatctccaatatagtgcagaccctgtatatgcatacgggaataattatatgcagaaatgcagccttcttttagccggaaaggatgcctggaacatgtggataagcttggatatttgtctaatgtt

SEQ ID NO: 124946 - DNA, 1019 bp, Homo sapiens
aagagcatttggtgctttgtttggcctgtttttatttgataatctgtatacttcattaaaaatcatcaggttcagagagattactgataattgcaaacttaattcttagcagtagagactgtctggcatacaaagcccttaaaattaccttgaattttttttagcctagagagtttacatctttatgtcacatcaaagagaaaaaagaaaacaaaaaattggtggtggtgggggcagatggtggaagaaagatatgaacagatcctgagaataatggagtttttaatttgaagaagttttggaaattaggttcagttacctcatttcacaggagaataaaaagaagcctcaaatattcaatgacctgcccaaagttctgcgttattaataactgagatgggacaagaaccagggtttctgagacaatttgttggttttgaaagagattttggggtcagacaaatctggttttcaaccctgactacctttgtaagctctggcagattattgaagtgctctgaacctcatttttatcttctgtaaaatggggatgatattccattgtgtgatttcatgagataatggatttgaagactgagcttcggttctgacccttccaaatggcttatcagtgctggctcccttccctttgctaggtcagtgtcttctctacaacacagtgttgtgtattgtagcaagtcacttatgccaaacaagaccctgactattttggcaatgaggtctgggtttgctgcctgaccagcaccagacacggggacactagtatgcacctggcttatgatgatactgttacgaggtttgggcaggaatccatgctgaagccatgcagcaggtgctttggttctgtggcctcgggactcctgcatttccctactcttgtttgatagcatagccgagaaatccacagagacagagatgatgctgaggagcccactgcttttttttcttggaaaagaaatgttccatggaaacttttcctgtgaaccctctttgagaga

SEQ ID NO: 124947 - DNA, 1038 bp, Homo sapiens
gcaggatgtgcacgtttgttacataggtaaacgtgtgccacggtggtttgctgcacttatcagcccatcacctaggtattaagcccagcatgcattagctgtatttcctaatgctctccctcccccacagccccctccagaggccccagtgtgtgttgttcccctccctgtgtccatgtgttctcataaacaggcacatttttgagagacagtctagtcaggtgatggatgctgtgtcgaaatggacagcagcttgcgtgtctggtctttcctccttaaaaggctcagaaactaaaggcgctgttatgagaggagttggaagaagtggggaattaagagacttcttttgggacctagttaagcagagatgctattgtcttacttttgaaataccaagtgggccttgctgtattttattttagtgttgagcttcagatacctaagccagtgtcttttgctgctcacttatgagatccagcttgaccttacagtggcaatcatgttaaaagagaacaaactaaagtaagcacaaacagaaacttagaattagttctaaacaaatgtggatctaattttttacattaaaataaaaccaaaaggaaggctgactttaggtaacatttatcaaatttagactaaaataaaccaagaagtttataaggtccagtttgtggagtaaaatattggcatgaagagaacggaaacattgcatgtaggaaaatgtacgggagtagaattagagaaggaaaaatcactagtcatgacccgatgttactacagccacaccagcttacttataataggaattcagtgtgttacaacaaagagggttctgtaaatgcaccatgataaaaatggcaaatacttataatagctgctattttttgagcacttactgagtgccagctattgctaagcactttacctacattatctcaattattttaaagggttctgttgtacagagggactctgtaatgttttgccttcaataacttaatgcttttaaagagcatttctttatgtaaacacttcccc

SEQ ID NO: 124948 - DNA, 1093 bp, Homo sapiens
ctcattgttaatagatgccagataaatgttttccagattatcttgaatttacttaagcatggaatactgtataaaacacataagttataaagcattagccatctgagataatttctgtgtaacttgacttgtaactgtgacatagtttatttaacatgaactttggtggtgagatttgtacatgagtgaggaaatttaatatatgatttaaaatatcagggattgaataaaggaaaaagaaaccatctacagcttttaagtgtcaattggaccagtcttttggaatctatctgtccatcacaagcttgtctctgctttagccccatctcagacatttaatccttgtctagaagggtaattagaaaccatctaatttaggttatttctattgaggtaaattgagttaagataactgaaacttgccttggcatttaacctctttggagtcagagcatggctcaccctttgtgaaaggccacgcagctgacctctctgctcccacaccagtcttctttccaaacagcgacctgagagtgatcatcaaatagagccaagtgctatatcaggttaactccagggtatttttaatggatatatagagaagcatcagagtgttatctgtcagacacatttccaattctgaggggaaaattcttttgaatttcacataaattctttacctggaaatacagattgatttatattgaagattactactacacaagaagtcatagcttcttagataactgtgtatatgtccagcatatctttaagaacagtttttgggcagtgcctcatgcctgtaatcccagcactttgggatgccgaggtgggcggatcacctgaggtcaggagtttgagaccagcctggccaacatggtgaaactccgtctctactaaaaataaaaaaaaattagccggacactgtgttgcatacctgtaatcccagctactcaagaggccgaggcaggagaattgcttgaacccgggaggcagaggttgcactgagccaagatcctgccactgcactccagcctgggcaacagagtgagactccgttgcaaaaacaaaacaaataaaaaccccacagctt

SEQ ID NO: 124949 - DNA, 1279 bp, Homo sapiens
tagagacagggtttcaccatgttgggcaggctggtctcaaactcctgaccttaggtgatccgctcacgttggcctcccaaagtgctgggattataggtgtgagccaccgtgcctgactgctggcgtatgcttctaagaaatttccactttcagtcagtttgacagttgaatccatgaacacttggtctaaacgcccttgatactaattatcatattatgtttgccaaagaccaggaaagagatttagataacaatattttgcataattcaggctgtaaaataaatcatagagaatgagcagtgtggtttgtggtgtgtaagttgtttgtagaatacagatatgaacttttaaaaataaatgttctcaagaaagtatcagtggcatgtatttgaagtactttggaaacatttcatcaaattattacgtttgtagtggaattgaggggtgaacattaataatgttagaaagtgttttttaaaatagtaagctaaagttttacaattgattaaaatggaagcaagtgcattctgatctgacaaattattactttcttctgattgagaaagaaaagctaattagcacctcacaaatcaacagtgatgatgggaagctccactataaatgtgccaagtataaggattattgttcctcaaagaaggtgtatgcattaagcataatgtgatcaccttttttttggtctcattagcttggtgtttatcagatttctttagttaacccaggtctgcttatagttataagcagccattacctgcattggtccttgtccaattttcacactgtgtaaatatagacagaaagaaaaaaacactccttagaaatagctttgaaaactgaggaagtctattggaaacataaagcatatttggcatcttatatgtcatgtatgaaaagttaatggacttggtttttatgactggcttatggaatcggtctcattattgtactgtcacaccttgtatatggctaaatgggtagatcatgtactcatttctgtgaaaaattatgactactttgtagtagaactggcaccattaccaagaatttatgaattggagattgattttggtaaaaatggaacttgttttaagccaaatatcttaaaacccaaacccttcaatcctaactgttcatgagaatgacttgatttttgtttgatagaaagatggaaatggaaaaggagacttgcttgtcattatgtctgcttgttcataaagagaaatctggaaaagttaattccttcatattctgagacgtagc

SEQ ID NO: 124950 - DNA, 1071 bp, Homo sapiens
taagtaagagcccagaacatcgcatgatgggaggtcaactaactgctttttattctaggagctctagctcatgctttggagtctgtcgctggtggagaggacatgcccagtataatctattctccctgctcacaactgaagacaaagccttatcaatatatgcagaccttaaaatacagttgaaaattttgcgaaagctcttattttagggcaagtagtggctggtttagttgcttccaaaatggctggattgtccataattttcagctgtctagggaagttgggagggcagagtgcatctttccccgcatttagaaaaatagtacatgtatgttgaggggaagtgagtggagaaaggagaggaagaagaagaggaacaaggctgtacaataagttacatccctaggtcacattttaaattttgatggaaccggtctctcttggagaatctgtgtaaggacctacatcctgtaggaggaagcagagcctgggttttcaggcctttaagcattgactaactgctgaatgcaaatgctagcggagattgaactgtgctaatattcctattagaactgttattattttagctaatgctctgattacagaattgcataagttttgagtgctctgctcataatcccttttccctcataagccctgttattttcatagcaattttgcaaaacatgaagttttgcaggaacacatgtattgcatttatgtcagaaatgccagtacatcatggtaaatatctacttagtaaactacttgtatgttgatgcataaagttaaattttataataagacctcagtgaccagattgagaaattgaggtataaaaagtttgtgttgtcctccattagttggaatgttctctgtttattaaactgcttatcacattgttgaaactattttaatccatctaaatgatattgatatggtttggctgtgtctccgcccaaatctcatcttgaattgtaatccccataatccccatgtgttgagggagggacctggtgggaggtgattggatcatgggggcagttcccccatgctgttctcgtgatagta

SEQ ID NO: 124951 - DNA, 1049 bp, Homo sapiens
agttccttttacaccctgtgccaaattcactgtaactcatttggcttctgccagaattggattctaatcctttgttctagaccattagctataatctttagcttcttgtttgttacttattttagcaaaaagcagagaaagattttccgcaaagaaaaactggcacagaatagttaatataaacactccccaaagtggtaaggtaatccacaaatggactagaaatttaaatgaaagtctaattatatatactgataccatatactctcaaagaagaaatctatggaacaaatgaacaaacaggtacattgggatgctgttctgaaaactttattctcaaaaatactaaaagaagcctgtttttatcttttacattttttctctcattcaaaaaatcaactttttacatttttcagatgtgttccattcagcctttcctcggatgactttcacatttcttcttaaagagtgatataaacagttttgctaaatcagacattttctataataagcattattcaaaaaacaaaaaagtgcacagagtcatccaggccagacaactgtctctttttgtctcttttaaaagcacacctgaggactccatttaaattggatagtgctgatctcagagcagaaccagctaattgtctcagagctaaaagactagaaattaaaagcctcaaaccttttcctgatcctgccacttgctgtgttacttgaacgtcacttaacctcttcggacttttattgatctataaatggcaactatttggcaaacgatagggtgatttatggaatgggcactttaagagcattgactaaaagtggttaaattaaaagttaagttgtatttttaaactctaaatagagatattgaggtctttaacactcttttcagacacaatttcctgaaagtttcttttttacagataaatatatcatgcttccagacaaactaaccttgagttcaaaatcatcagctagctaaggaaaattcaaaagacttttcatcctaagataccatacatgttttccatatattctgtgaa

SEQ ID NO: 124952 - DNA, 1053 bp, Homo sapiens
ttcacaatgttgtatgatctctacacctatctagttctaaaccatttccatcactccaaagtaaaacgccttacccaataagcagtttctttcattaacccatttccctagaccctggcaactaccagtctgagttctctctctatggatttatcttttctggatatttcatataattggaattatacaatatgtgatctttgcatctgacttcttttacttagcataatgtgctgaaggtttatccactttgtagcatgtagcagtactttattcctttttatggctgtataatagtccattatgtggctgtaccatgctttgtttttccactcatttattgatggatatttgggctatttccaccttttggttattgtgaatagagctgctatgaacatgtgtgtatgtgtttgagtacctgtattcagttcttttgggtatatacctagaagtagggttgtgggatcatatggtaattctatgtttaactttttgaggaacagccaagtggtcttccacagcagtggaatgatttttaaaagctattcctaactttatgttcattatcaaaatcaaaatgctcaatttggaaacatactttcctcaatgctttgatttttgttattaaaaatagattattctttaacatatccaccactttttccaaagttacttaaaaaaaaaaaactttggataatttccatattcatctcaggagagtttgtaagactctcagaaaaagattccaggcttttaatttctagtcttccgctctaagacaactagctcttccctaagatagcagaagtcaatttaaatgttcgggcacagtatctattttccatatgacttcatgaaaatgaaacaaaaattaaaaaattaggctgagtgttcaataacactttatttatggagttaataaatatttactctgaatgggaagaaaagagatctgcatttgacagttacctatgaaatagaattaatttttttcttctttgtcatgttgctggggtttttgaagatttgcctaaaaagatagtcttttag

SEQ ID NO: 124953 - DNA, 1022 bp, Homo sapiens
ctgtcctatgaatataagtatgttagttatgtctattttaagagtggattagtaaactagattctggatagaaatttttaaaaggggcaattttacattttaatctcatagcttgaataactcatgaattctaaatgaagaataaacaccttttctttggggggcggggggaatagctttaaaacagactgaaatgtttcataagtgtatcctgtcttgctataatttggtcctagaccttgagcagaaaatccttgtactctgtaaagaaaatagtgaccctgtatattgacctggcccaagatggaaaaacaaggaacccttcttggactttgtactcattacactcaaatctttgttctagtcactaagtcctttcataagtaaattttccggaactttctatgctgtaacttttgcttttttcacgtggctctgttcaatgataatggtgtctattttaccttagtgccttcactggcatatataccttgcctagaatcacctttttccttcaacagatctaatttaggttcttcaacctccaattagtcttttctaacaacttcagccttcattttttaatcccatcaaggtcatatctaggaaacattttgatgtttaccactgaattcagtatcacgtgatattttatatttgctttggtttaatagattcgagtttgatctcaacagattttttttttttgagccagaatctcactctattgcctgcttcagtgcagtggcgtgatcatgcctcactgcagctttgaattcctggactcaagcaatcctcccacctcagcctcctgagtagttgagactacatctacacgccatgcccagctaatttttatttatttatttattttctgtagagatagggtcttgctttgttacccaggctggtctcaaactccttgcctcaagtgattctcctacctttgactcccaaaatgttgggatttacagatgtgagccactgcgctgacctcaacagacctttactgagttttatct

SEQ ID NO: 124954 - DNA, 1130 bp, Homo sapiens
agacccattcctaattagaatgaataaacaagcttcttgttttaggtccaggcttttcagaatctggcttaattgtgttgtcttctcccactcttctttatcttgaacacttaactacatttaggtcaatttctttacttattccttccttacattcaggtgctgtcacaggcaatggaaaaataatggtgagcaaagcaggcttggtctctgccatcatggagcctgttttttcagataatgaagtaattaagcagatactcaattacaaaatgagagaaatagtatgaaggcaagagatgatggaggctcagactttggaagcagcaagcgtgatgaagaggagcaaatgggtatgagaactttttcaggagataaaattgagaggatttggtagttaaaattgagaggatttggtagttgattggagataaggattgaggggaaaggagaggtatcagaaggaacccccagattgctggttctagttggccaatgtgtcattcatcaagaagacatctttggaaaagcatacagtttgagggagacagatcatcagtttagttttgtacatgttgaatttgagagctttctcatgtttgcttttcttacaggaagccttccctgaatattctaccctttgataattattctaatgcttatcgattaattattagctgtttcatatgcttcaacttaataattactgccagtatatctcattgtcatttcatgtcacactgtgtttctctaattgctatgtacgtgtgttttaagtgagagtagaaaatccatgtgggtacaaaatacatgattactatttttgtttatctaactgatcacacttggtagtgcacaatgttatgaagtagtacgtatttggattaccagtgtcactaagtgatttccttgagacacagcctcatttcttatggttaattcatcatctacaaaaatttattagacagcaagtctctctcacggcaataggagtgagtttattaacaggaagtgaattatatcctccgatgtactagaggaatttgttctctatctggaactactttctaattaaagtcatgacatccctaccccgacttactgtgttgaatattatttaaccacgcctc

SEQ ID NO: 124955 - DNA, 1028 bp, Homo sapiens
gtaattagatgaaggcagtaagcagggtagtgtgataagagtaaatggcaggggagaagatacttgaggaagccttactgaggtgggggcacgtgaggtgaggatggatgggaaggagccagcagtgtgaagatgcacttgatgggcttgggcatggcagggaaggctagacattccagagagagggaacagggcaggcaaaggattcaaaggaggtacgaaaggaggccagggtgactggggagaatgatgtgagatggcgtttgtaaggtggactggggccagattatagaggaggccttgtttcaaaatttaggttttattagaaatgaaaattcttgaaacaggcctttttttttatgaacctattatctcttagaccaaatgaaaggtgacagttttaaccttgaatggccaacctgcattcataatctggaataattgtgagcagaagcccgcagcatgttgaaatagcattatattatattcaaaggctaaagactgctcagttctcaggcatttatcacttgaaagtggagagagtagaaaagtttaaaaggctacagcaataacatttgagaaaatgaataatttagagaatgaaatcatgactaatgaattttttaaaaagactcctcacttgtgattagagattcataattttcattttatagcaaaatatagttggctgtcatgcattcctgaccttcttcccctaagtacaattgggcccaacacattaatgccttgatgtgcagacttacgactagcttcttgtgttgaaaccattaaattttaatgtattcagcttaagcgtaagtggtcatagatgattcataatggtgctccctgcttttggtgaaaatgatcatcagcaagagaattgtccccagtggccacacttatcttcgtagatgatttcctaaacattttttgtgcccgtagaagactaggaataaacactgcacagctgttgggtaaagcactatgataattgctcagaaaccgcagggtatttgatgaagata

SEQ ID NO: 124956 - DNA, 1043 bp, Homo sapiens
ttcattgtcttctgtccttcctacagtgtttcacatatttccatgtactactatctcttttttactgacttgtcttacttttagactttctgaccttgagccttcacttctgagccattcctatgtttgcttacttggtatgaggaagcctgattctgtcacataagttgcctattagagtttcaggaaaatgcaacttaaagggaaattaggtggtaactgtgtactggctgaaacatttgtgagctcccaaaaaatgcatcactgccaggtaatgacttctgttcaataagtctatgtagtcaacagaatgatgttattcagtagtttattttcttttgttgtttatcttggttccctgtctttttgttttccagggtgcatgatgatagcagagattgttttaaattctatattcagttcagagcttctgggttgtgggtattgtcttgccagtgaatgtgaaagacaggcatgtcatcacttaagttttaacagtctatcttcaggtctgacttggaaacttgcataatagccagcatccaaatagggttgaaggcagagcccagatcaatacaaaacattaaggctatcagtagtatatatatatatatatatatatatatatatatatatatatatataccgctatatatactgcttatatatatatatatatatatatatagctataaataaattaggatacctcttagactgcagttgtagagtatttatacaggtacaaggtgagaagtggaagagatggtgtcccagtatcttatttgaatcacttatttactattggggaaaaaaaatgtaaggagtgtggtctgcggataacatctggaccagttttatctacaaatgtctatttaagtttccttccattagacagattctgttgacttctgccttatgggtaacagactccattctatactcacaccttcacatatttatagacacaatattgatatactgatggaaaagattggttctcattattgttaagatattggcataatgttaggtcagtgatc

SEQ ID NO: 124957 - DNA, 1017 bp, Homo sapiens
ggtaatgagaccaataaaaggaaagggagataggaatgatgatggggttctgttcgccttcagaatggaagcctgatgtcatgtggaagtagatttaattagatgtgcatttcttaaggaatccgtaaatcaagtccagactgttctctattaaatttttagggtgagcctacctgaagttctatctttgtgcgttttcattctatctgatgatacagtgctctttatgtgacctgaaaaatatataaactcatttcttctcccagcagcattcaaactcagcagtctctctcttctttaaatgtgcatattccatatatctccctggataccaggactctcagtagctgttgctattttgttctcctactttgaaacatacttttctgaaatcacctaccttgttatttctcttaacttttgagcagtatttggtgctgctgacgattttctccttgagcactcttccccaggctccagggcatcactttccactgattgtctcatctccttggctgctccttctcagcctctttcatgggcctctcttctctgcttagcctgagaagttggtattccttcagattctgtccttggctcttctcatttactgggtggttttaatttctgttattagttactttctgcatgctgatgacttctcaatttgaattctcaccaggtcttctctcccaagctctagatccatacatccagttgtttattgaccttttccacttaaatgtgacagaagtaccttaatctcaatattttcagaaactgaagtcattatcttccataccccgtcttaccccaaaacctacttctctttgtatttaatatctcaggattagtactggcacctataggtgctcaagctagatttaaatagatgcataaaatctcttgccctgaaccatatctctctgtccccacccattagcctagcttaggccaccactattgctacatttgctttgttgcagcagcctgttctcccttcctgtagtctttctt

SEQ ID NO: 124958 - DNA, 1069 bp, Homo sapiens
tggatttatcctaatgtattagaactgtctttttactctcacatttcccttctagactgtaagttccttaaggttagcaatgggcttatctgtgttgtaacttgttagtagttcctggaacatagtggatactacaaagctatttcttgagttgagtgtatgcatgaattactgtgacaattccttactgtttccatagtggttttgccaatgtcatcatgtatcatatcttctcttattttcagaatttctcttctaacttctataagagcttaacttcaaaacatgttgaacagtatatactgctaaatgaaaaagggaaatacagaatggtgttatggtatgcttcccttcgggtaagaaggaaggaatataagaaaatatatgtgtatgtatttatttgtgtaaaagaaattaaagcaggataaatcagaaactaaagagattggttacctataggaagtgaatggcaaaggggtagaaagaaggggagagagatggaaacaagataaaaaggataaggagggtgcaattcttttctgagaagctctttgtgttttgcttgattcctagaaacatagtagtgttttgcatactccctctctataaataaatagatcaataaaaccaggatgtaggggaacctaaaattggatacaaaaatataacagatgagcctgactttattgtgaattgatattgataacatatttacactgaagggggtgggaaagaaaagcactaatctgggtattttgactggtattgtgaggctaagggtaaaaagtattatacacaaacgcttcgctcaagttagtgaatttgtgtatcctagcagtgtggattatcaattctgaaactgctttatgtgtatgctaggattaaacaaagaagttagaagtacagaagtgggaaccctgtagtatcaaactcaatcagaggttgtagtatgaactcatggtttttagtatatacagatgtgtatatatatatagtagcatacagacatatatatatatgcagatatataaatgcaaaaataaaaataggccgggcgcagtggcccacg

SEQ ID NO: 124959 - DNA, 1039 bp, Homo sapiens
tccaacctcccagcggaaaaggcagataatactatgtaaaaattagaattgattttggtttccgttgcttcctcctaatctctcagcctaaattcattcatttaagttgacaactaaatatcgtgtgcctgttgtgtgccaagcgctgttccaagacttaggatactgtagccaccaaattagatagagatccctgccattttggaactcttattctcacaagtgaagacaataagcaataagcatgataaataagtgaactatgtatgtgagaaagtagtaagtgctaatgttaagtgttacagaaaaagaaaatgtgtgtcagaaaaggggtgggggccacatggtcataatttcaaattgggtggtcaggataggctttgttcacaagacaatttttgaagaaagacttgaagaaggtgagggaattattcatgcagaaatcagagggacaagtgtttcaggtaaagggaatggtcagcaccatccctaaagtgggaatgggcctggtgtgttccagggacagcaaagaggacagtgaggtggtgtggtaggagaggaggctggagggaccagatcatgtgcagcctttgtgcagacatttgctcatttgcttttcctctgggtgaaatggggaaagccattttgaatgaaggaatgacatgactttaccttttaaaacgatcacgggttactcttttgagaatagactatagtgggggtcagaggtaaaaatgggcagtccagtttaagggttactcagagaagcaatttagcaatacagtaattccctccttatccatggaggatgtgttctgagactcccagtggttgcctgaaactgcagatagtactgaaccctgtactatgaaaaaatgttgtgttttcctatacaataacaggcaggcagcatatgcagcatggatgtgctgaacaaagggatgagttacgtcccatgcaggatggagaaggatgacccaggatttcatcacactacccaaaacagagtgcaatttaaaacttgtgaattatttctgga

SEQ ID NO: 124960 - DNA, 1049 bp, Homo sapiens
tacttccaccatctttgcacatttcagctagtgtcctggaggcctcagatgacaaagcagtatggaagtctccactgaagtggcaagggccaatatcactttcctttttctgtgttctactcaattataggacacctaaatcagtagggcctatacttgaatctcacaaagattttagttaaacaattcttttgtgcttttactttcagtattctttctcctctaggagaatacaggcatctgtggtactgaacttgggatgatgtgagtgacagatgccaagttatgttggtgatagcatgttccttctgtcaggctcagtcagtaggtgattctcttgttgttcatctcttcctccctcagggtggattttctctcaggagaagccgatgagtgaacctctccctttcactggacctgcccagacatgtcagaacactagctttggctcatgctgggaccccccaccacagctggtgccaacagactgtacacttgtttttctttgatcatatatggcctagattaggatagtcccaagagcttgccaagattgggttgcagcctgtctcaaaacacaaacttaaaattgtttgacaagaccaatacccaggagcatcatgagtttgaatgaatagtgccggaaacctctagtctctctgcgcagtgttccttgatggaggccacggagtgtttactatagaacttcatgacattgtacttacaacattttagattttgttaaaattttaggaaattgccacctgatacaaattagagaactgcacataacaatggataccaaatagatattttggatttatttcatttaaagaccatagtgtctgacatacagaaactcaaatgtatattgaaagggtgaacaaaaaggatgccgtgacttcaattgctatttagaaatgaaaatgaagtttaaatgtaatcttatttttccgtagtgtgctcaggcatactaaggaaaacctcaaagacttctaagtataattttgtcaatacagtgagagagattcaggtatatcttaattaag

SEQ ID NO: 124961 - DNA, 2621 bp, Homo sapiens
tatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaagtgtttttcttgattgttattttcattttcaccttgattgtgatcaagttcagcctcgttttgtagtcagatagccatgaactggtttgagtcagatggcagtcctgagaagagagggagggatcataaacagtgggggtagactctttggtcttgttgttggtagtggtaggtactgaggttatccaaacttttcctgtatttgtggtagagtcacttacattccttttttatccttttcatcaagggacacagtaattcattcaaactatatattggg

SEQ ID NO: 124962 - DNA, 1016 bp, Homo sapiens
agtttagtttttcttaaatctagaaataaaatgaagaaccatttaatgtgaattattgttgatgtctaagttgggactgttgcagcttcacagtagtcctatagttgtgtttgttgtagttcatccctgttcacacacagggtaccttactcttacatgtgatagcgaagtgaagaatttaagacaaataaataagtgaacaaacacaaagagaccaagtttgggaatgtaggggtgtgttaaaggtcaccctcttctccacaacttgtcctcctcctgccttctgcttttgacctcactgatgccccttagcgggaacttccatggggaatttcctcctgactggattcttcttcatcgtcttctagtctaattcagtgctttcttccaaatgtgttattgtatcgttttagtcttgaaaattttatgcccaattatttttctttaaagagccagaacaaaaatagtatactcaatgtatagtcggaaagcagccgaagaagtgaagcgagaactgataaagttaaaagtgaactattacattctagaagagtcatggtgtgtaagaagatccaagtgagtatcaacacagttaacattttataatcataagacatgaaggttaattcaagcacatggcacatgctttgctggtggcgggggtgtgtatataacataaagtatacatggaaaaacttcttcttttttttttaaacaggctctcactctgttgcccaggctggagtgcactggcatgatctgggctcactgcaagctccacttaatttttgtatttttagtggagatggggttttgctgtgttgaccaggctggtctcaaactcctggcctcaagtgctactcctgccttggcctcccaaagtgctgggagtacaggcgtgagtcaccacgcctggcctgaaaaaactttttagataatgatttggagactttcttttatagtctttataaatatcttttttttttaaataatgatttgtatgtgtatactacctt

SEQ ID NO: 124963 - DNA, 1033 bp, Homo sapiens
cacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccaggtaaaaaaaaaaaaaagaaaaaaaaagtcatattatttagctgtttttcccacaattttatataccactgcaaactcttaaaccctagttacttccactgatctcactctttctatgcaatgttgcttttagaatatctaaaacaaaggagatatcaatcctgtttaaatggtttgcaggggaaatgttatacatatgttcttagtaatttattctgccattttttatagattttaattttttcaaaatttattcacagtcataaatgccacatttaaaataatttttcctgtgcttattttcttaatgaatttttaatattagtccttcacattccttcttgaaataaactcatggaatgtgacattttattcatgtgtggaaagggagactttgttgtcatctgagtatcaaatgattgaatactaaatcatcttccagaactccttgttactgtaaagctttcctagtccatt

SEQ ID NO: 124964 - DNA, 1790 bp, Homo sapiens
acaatctggctccttagaatcatggccaattccaggaggtatgacttttgaccagaactgatctcgactgataaggaaagtgttatagattcaagcagcagctggtggattctaagggctggattacagcctgtcatcagtgttgtagagaatatttgtactggagatacgattttagattagatgacctcctcattattgctgaatatgaaagcacagtgactgtgttttgaatgcttccagctgtgattatcaacctctgagccagctctccagttttctgagtgcactgttaagaagaggtgttgccaacaacgttggcatggtggaagcagcgctgaatgtgaatttgaagccagaagatctggtttcaagactgcagtgcttcttagtagttgtctacctacagggcaatcatttaatccatatgaacctgttgctcatttacaaaacgaggatgatataatctacccaacagggttgttgaatattagctttgatcagatactatacaaatataagattatgttgttgtgattattattttctgagttatctctatacttatattttcattaaaagttattttacagtttagaagatactttatttaaaatatcatttttcccaacacagcttttctaaagtgtttcaaaatctatttacagattattagtgatatgtggggtgtcttagctaaacaacagacacatgtaaggtaaatatgctattaagaattttattacctcctctgttcatttattaaatagatatttacagtgtattaattgtatacttacatgttgtgtacctaatatttgataattgatgtttttattgtggtcatttcccttcctggcatttcttcttatttcctatctgtgcagaacacagcacatcacttattcatccttcagatgttatccagtacagtctgacagtagccctgcacataatctacactcaaaggacacagttttgtacttcatttcagcagggaaagtaaattattacgtgagtggttttaggaccagtggactgcctttttggaaatgagcagggaaatataaaactggattcatacctcactttttacagaaaataaatttcagatgaaccagagaattatgtataggaaaaaaaaaacccaaaattaaccaagagggtttgtttataacctgagagttagagaggcctatagcatgcttggtattttccaccatcacaccctttgtcttactctcttaccatttgtcaccctttgtacttaaatgttgatgtgtgacccgtatctcctgaagggagcgatcatttttgttcaacagtttatatacagtgcctgcaagatagtaaaggatagtagttgaatgagtatttacatatgactaatgaacatgaaaaggtagtcttgatcctatggtaaagccattcaggttaaagtgaagaccttttcacttcttatatttctaaaaattaatagtatatccaatgcttgcaagagtgggaggtagtagatgggagggaagtttggcaatacacagtaaaacatatagtgggcctgtcctttagccctgcaggttccaccagtgcaagtgtaccctctagagatgctcacagaaatacagagatgatggggagagatgccttttgtagtattgtgtgttatgtgagaaatggaaacatccaaaatatctactatgatacatagagtggaatgttaggctatctttctggaaataggtccagtatacattattgaatttttaaaattgccagtgtgtgtgtgtata

SEQ ID NO: 124965 - DNA, 1372 bp, Homo sapiens
gttataaggattttgatactttattgtatacctgtgcagcggagtttgactttatggaaaaagaggtaagatgtgatttctagttctgtttcctaaggttttggcccatacatttttcataaggagtgctcctcttatatcagactctttatgtgctgttatctcagtttgaaggaaaaggaaaatctggcagcttagaggaagatttttctgtttactttagtgcagctccctgaaatatatggcctttactcattttgataatttagaaatacacattcagactagcagtggttttctaggtgagtaaacacagaggcatttcaagttgccatttttcagtgatagcattaatttagtcaagctctcaaactcttacatttccactcattttgtggttatttaaatagatatttgctttgaaacatcaagtccaagcttttcattccaacagcatttttctttctaaaactgtattcagagatttagaaggaaagcagagagtagtttagtggattgtgagacagaagcctgtaattttgcttgatgttcttgaacaagcaactctcattcgtcgtgttatagtttactagtttctagtagcatgccataaacagatattgtgaagacaaaatgagataatacaaaggaaagtactttgatattttaaataagtaaatatttaaataaataaaatattaatttgcaatactttatgagctggtttagttcgacaagcatgtatatatgtgcatttttaacaccatccatgtggtactgattaattatattatctgtgtcactccttcagagtggtatgtgtatgtatatgaaactggccaacaatactctattgacatgttagtttccctcatgatcccactgtgttagcccagtgtccagagttccagaccagtggatgagagggcaccacacaggaaacttttatctaccggccatttggagttgagtgtgttctgcagaggtactgtttactccagtggcctgtcagtcttcatttattgtgttccggcaaatggttttgacacacagtggctgacaaaggtatatgagttttagtgttaaacctgctgaaacaaacaaaggaagcatatcttgcaagacattgaaatgcatgttcataggggttcaagactccttcaaatattagagaattaggatgtggtgaagttgtttaatgttattgagaacatcatacatactgctacagtctgagagtattaaacataagctatgtgatgaaagaaataatttattgagacatagcatgacttcagctaatttgaagaaaatagcaaaactgtttccagcataccattcctcatcactgtaagtatcttaattcataggg

SEQ ID NO: 124966 - DNA, 2117 bp, Homo sapiens
aatcatatttttgccatgtttgaagtagttttagctccccaagggtaatacagtttggaagcattaccacctgaaaatacttcagagaagtatttagttgatccattaacatttcatttgctgtttaccctaagagtcagtaatttttagctaaaggaaaatcttatgcctgtatgactactgtccaaaattctgaaaatgttatatacctcatggctcagagataaatcagatatgtcaaatcagtcatagacatttacatatggtgattcctttttcaactttaaaaagtcacgcattcacctaattgactttggataatagggctataccttgaagtcactgactctagaaatgagcatgtggatggtatgtggaaagtcaaccatgtgctaaattttagatacttgagaatcttattatttagaagaattttttggtacttgaatttatgtctataagtattaactgtgtatactatgttatttttctctactcagggtattctggcaatgaaaccacatttcctgaaaataaatgtatctgaacttagtttatgggtgagaatcaatctattttaatgcttatgttttttcttctctaaaatatatcattggttttatgttttacttttaagaaaatgatctatgcaactcaggggatccaacagttttatagtattttagggctcagttttaatgtaccaaattgccctttttatgaaacaagttaaagttaatcctgggtatgtagtttaaaaattccagttttatttattactcatgtttcatctgagaaacagtgcatgtataagaaactgttaaagggaatttaactgcagtggttgtgtaaatcttctataaaatatattaattttgataagattgtatgattatatttttatttttagttactgtcccttgattttgagcaacatgcttgattttaaattgagatgcattttctagcattttctcttgtagatagtaatatgtatttcatgtatgattaaagcatttatttttttcttcctagcctatgtctgtggaatatgaagcatcaaagttatttttgttttcttttgtttaggttattcaaggatgtttttggttatttggaactgtcatacttaaatacttgacatctaaaatttttggtattgcagatgacgtaagtgcattttttacttaaatttgaaagacttgaaaagaatcgaataggctaagaataaattgagttattcaagtatcactattaaatgaaattctaggatgaagtctgttcacctattattttatttaatataatagaaagtaaatgtaattgtatatagattttcgttctccaaaattagtttcttaatctctttttttattggtccttctatgtcactaaaattttaacgcaggaaaactgtagataatagattaaagatcgaattttaagctctatacagtcatttttctctagcttctttgtaactggtaaagacaccatctttagagccttaattggagatcgtattatagtctcattcttttttctctccagttttcaagtcattacttgtaaaaggcttttataagcctttatagataatgtaatccaagtgagtcttatttagagaagatttttgtttatttttggtattagggtagaagggaagataaaatggagaagtctgtcttataattttaaagattctctctgtccataattgctttgcctattttattttggtgttttaatcagcacatcctaagtcaggaggctatcaaagatttaatttaaaaaagcagcacaagaaccaacatggaaaaaataaactatttttttcctatagtgtatttttattggtgattttcttctttctgtactagattaatgctatggttttgaaactgggttatgtgaagtcctaggacttcccaggaatcttccctgagggctgtctactcccctgtctcctagcctctcttttacccagggcagtttaacctcaatctctttcatacaggttttcataagaacaagggttatttttgcttaaaagattgaaaacacatggaccattaaatggttggtctacaatctgtggaaagatttttaaaactata

SEQ ID NO: 124967 - DNA, 1022 bp, Homo sapiens
ttgcatgtgtatggaaagctctctgaaacatattacgaataaaagcaagaaatagtacagcttgtggggtaagtgtccatttgtggttttacaaaatatataaactagaatttatacatgttgtctggaaggataaacaggaaactgttgatgatggttatctctgggagtttgaagtgtgagatggagaatgggctgttttatagtcccttttcaacagtttgaattttgtttattatgggcatgtgcagttttcacaataaaaaacaaaggttttttgttttatgtgcattacttatatttttttcttggatttttccagatttctcttgcactttgttttgttttgatgtttgggaactcaatgttattaacttcttattatgcttcttctttggtaattatttgggtaagtattccttaacacttatatggctgtttttgaaactaatggtttaacaattttttcttcactggcttaggattcatcagggttttctgtaggaaccatcttaagtgtcttactgaatattctagatgtatggtgttcaagtactcaattctaaaacagggaaaaaaaaaacaaggaaaaattagtatcatttcagaaaagtttctatgctttcttctcccttcctcctttgcatttttaatcctactcctgctccactttttgaacccctttcctctcattgcaatcttgtaacagccacccctcttcattccactgtgctcagaagatcaaggccttggttactttttcttctgttttttgttttgttttgtttttcttgttttgttttttgccccttgtctacttgtatggactattcagatggtttaagtaaggtgatgattcagttttattttgctaaatcactaccaagaacaactttagattatggagagattattttacagaattagaacaaattgatggaaggtcatctaattctttctgctacatatggcaggatgactttgtttttttgtttgtttgttttgttttgtttttttaaggt

SEQ ID NO: 124968 - DNA, 1049 bp, Homo sapiens
tcttctctcattagtttttataattttgatgttttcttttcctgttaattttacagttgtcataatatcccattattttcattttcttaataatttatacatataaaagaacatttataatgtgtaaggaagttataaacacggtcataaaataaacaaccaggagcctactctccaaatggataatagaactttattgttacttttaagtcctgtatgccctgagctcatcccctcactgttcctagaggtaaccactattctgactttttgaattgtaatcaatttgcttttctttataactttacaatatgtggattactaaatagtacatatttttattattaaatgttcacattctttgtaaggtttatgcaaatggcattattttataaataccattttttcactcagatttctgctacttacatgtaactagaattcaaatattttcactgctttatattttccatcatataaataaagcataattcatttattcattttcttgttgaaggacatttaggttctctcctctccccccagcttcttattttagttataaataatgctgtacattcttcacatatctcctagggcacatatgttgagagtttctctagggtatttacctggtagtaaacttgttgggtggtaaattatgtacatgttcaactttataaatactaaattgtttttctaaaatgattggactacttccaacagcaatatatagcagcttatgttattctacatccttttttattttatcaatctggttcgtgtaaaatggtatcttgtaaccttaatttgcattttctctgattcataatgaagctgagcatcttttggtttgtttatatgcccttcatgtttccattgttgtaaattcctattcagatcttttaccagtttgtcttgtgtccaaaagaaaatgacatctattttagtcaatgcagtgtaatccattatttttgttatttatgttgatgctccaattgttccacacttgtccaactatttaagctgacttctctttccttttaaca

SEQ ID NO: 124969 - DNA, 1060 bp, Homo sapiens
acagtcagaggtttgataaccttaatttttaagtagggaacagtcaaatagaaaaatagacaagaatatgaataagcagttcacggaagagaaaatgcatgttgtcaaaacaaaacactaaaatgctactgcatacaagtaggcagtgagaaaagggttttcacctatctaaggagaaaatttgaaaagcacatgagtctgcacgaggggtggagaaacgacctcctgcatactctgtgacaagagtgtggactgctgcagtgcttccgggcacagctcacatcctttgactcacgtgtctcacagttaggtccctcctgccgaaacaaacgtgccagcatttacatgtacgaggatgtttaaccattttttattatagcaagaaactgaaaaatatttatatgcccggtaatatggaatggactaaataaatatatttgtactatacagtatttgccatctataaaaataatccctttaagtttacatacattgattaggaataatctttatgctagaataattagaaaaggaacaaatttcagagagatgttatattgatcacatagaaaatatatgtttgtgtggttagagagagagatttggaagaacagacacatactaaaatgttcttaggtgaataggattgggagagggtagtgagaaaatcactttttttcccctataaacttctatattttttgtcttgttagagtaagttcaaaacactaaaatgtatttatttgttttttaaaccgttaactctatcttaacctttctaatgtctaatcacttgtgatgaagcctgggcctagcctgtgtgcttctcttctgaagaagatgtggtacacctttcaggagagaaccctggcgtccacttcctggcctgtactgctttctaagctcctctgtctgatgctctcatttcagtgatccatcacttcagacactttctggcttcagtttctttgcccctttatatttcatttgtgctgtctaggctgataatcggtaggcaaaaatcacacagtcttatgattactgaccctgtagatttgtg

SEQ ID NO: 124970 - DNA, 1048 bp, Homo sapiens
tcggatatgttttggtgtttggatttgaccttgtgggcagggatgccattgaagggctgtgtgcatggagtgggattgggtccattcattgttaaagacaacacactctgcagtgtagagggagcaggctttgggtagggggtgtcggaggctgtagcagcccaggggaagacgatgggagcctgagctggtatgatggtggtgggatggagggaagtggacagactctggaatactaggagggaggctccaggggaagcatttgttcagaggagagtgatatttctaggcaggagaaggaggaagcatctgggaagaggctgcagttgttggataggtagttgttcaccatggaatgaagggcctggagcacacagtggagaggtctgcgtaggagttgaggagtgtggtgtttgggtcagagcagaggctcacctgaacacatggtcctgcctggtttttgggccagtaccaagagcaacaatgacatgaggtgtggtgtgtttggctgcaagctttcaaaaaaggaatgccagcagtcttttgattgaatagttctattttcagataccctttcattttctttcatggacaagacttggtgctaggcaccatgggtgaattgaggagttcacaatctaataagtaaataacttcagttagaatcggcagatagagagttaaattaacggcgttaatcacttgcttgaaacagactggaaaggaccaagctgagaacttttctcacccttcccgattcttatcctcattcctcatctttctttcctatctctttacttagtaaccagtgaatcccccccaccgccccccccaccgccgccatgagtataggggaaggttctcagctctgaaccaggcctgcttggcatttcttcattgggctaggaaggtgcccaagccttcagtctccaatttaagattggaaattatcttaatttgattatttccaaatttttctccattttctctttcttaagcatttatacaataagaaaatcgtaagagttatttaatatagttttgaatt

SEQ ID NO: 124971 - DNA, 1109 bp, Homo sapiens
tttttaaactgaattttcactgctttgtatatacatgcatatcttttggcattattcaactttttataatcaagtacgtcagtggtcccttgccccatctgtcttccccaccctgtgtatccctttgtctagggaaagccactttcagatctttggaaactcagcaattctgatacgtaaaaccatagtccgcagttacattattatgactgtaaaaatattgcttactgctgaattaagtggtataaataattgtttatttggtaacttaaaatttttcctgtggttaattattgctaatattttgttttccttggtgttctgtatgctgattaattcctctccagatctacagctgaactgtaaacacttattttgtactttgtcaaatgtataaaatccattatttcaattctcccactcctatcccctggggcctccctcctggagcctctgtctctggttccatcctagacccgtccttccctgggcttccgtttagcgattcccttggagttttgtttaccaccatcctgagaattcccctttcctctcttgcattggattcattgtgttttggaccccaggttggtctctttctggtctgtttcatccttttgaggatcatatcctcaggtaatttccaagagagtcacagagataattttaaaatacatttgtctgacatgtttgaacatttccttttttatttttgtactcaattactggtttgcctggttgttgatttttatttttcctcagacttttaaaggctttgttcgactgtattctaagatggagtgtagcttttcaaaagtctggtgctattctaccattagttccttttgtgtgtggctagttgttttcctctggcaccttttgggttcatctttctctctttagtcccgtaaaaggtcatgatgtggtagatattatttcatccttctcatcgcatactttgtgcgctctatctgggcacttactttcttcactttggaggaaaactttttttagtattatttccctaatgacattctcttctccatttcttttttcctgttttcttgaaagttagtgattggatattggacttcttgaagtcgaatttt

SEQ ID NO: 124972 - DNA, 1114 bp, Homo sapiens
gccagtatcacactattttaattattaaaagtggtaagacttaatatctgttaaaacattccctttaattttcttgttagttttctagatacattttagacacttggaattttgactggaattattttatgtttatgaattaatttgagggagaattcatatcttaaataattcggtctattccagtagacccagtatcttttacttgtgcaaatcttcttttgtgtctcttagtagagttgtagagcttttgaaaaacataaatttagcacttttttttggcccatattttgtccttacccatggatgaacaattgaaaactgaccagtgaagaatctgcctaggagattctgagccttgttttactacatttaaagggagccaagtggatggtatggaaagggaaaatatggtaattgtcaaagtatctcaaaagtattctagtaatgaaaattgtttagtatattttcttaagatgcctctgtattttttaaaataggtaattttggccagttggtaccggatttataccaaaataatggacttgattggtattcaaaccaagatatgttggacggttaccagaggagaaggactcagtcctattgaaagctgtgaaggtaagtttctttctgtaatattgtccagttatctgttgtaacataataaacttatctagcataataaacttacactgtaaacttagtggtataaacaacacccattttattatgcatatatagattctgcaagtccagaatttgggcaggctttagcggggctggtttatgtccatgatttcagggacctctgctactaagactcaaatgtctgggaaggctggaattaactgagaggctacattgctcacattttggctcctgggcatggaggactgtgaggctgagctcagctggaactctcagctgggacacctacatgtggcctttcggggtgacttgggctttttgaaagcaaagtacctcagagtagtagtaaggcttttcctatggcagctgaaggctccaagctggacactgtatgacctcttatgacctagcctcagaagtcacatagtgttgcttctgccatactctgttgaaagagtcacaa

SEQ ID NO: 124973 - DNA, 1602 bp, Homo sapiens
attttaaaaatagtggtatcagagtcgatacatcagagtatcaagaccatttttttctttttcaataagtttctggataggcatatctcttttgtatttgtgagtcttaaacccagtttaaactttggcagctactggtactggctaccagggcagctccagggaaaactgaagatgcaaatacaagacgtagatttatcttgtgtttctgtcttccctcatactgccacttagactctccgttaggcttctagtattttcttgttttttttttgtctcacatattatttcacccttgctatctttccaaagtagtgtgccaagctaaaaactgtctcttttcttcaaaagaggaccactccccacccttatccccagtcgcacagggttcttaccttatgctgacttgataggagggaaaataatctgtaaaattaggtggcacccgagtgaaattcatatgtaataatacatcagtgtgtagccttctcaacacatttgcatttttgcatgtaaatccggaggaaaaatgactgatagtgtcattttggggattaaaataagcagttagaggagtatttttggcttgagatttcttggttcatgataaattttagttccataataaaccactcactctattcataagatagcattttctaagagtgatattagtataagtaataggattttctaagttgaagtatgctgagtcgtattattttttaaatgctgaaactttttgaagctattttgcattcagttatttcaattaagatgcatttatgtgaaaatacatagttttttcacaactttaggatttatcagtgatcagaaacctgtgaaattcattgtattaatagctattacttaattgctttgtttttcaaaaacagtgtatttacttagaagtggcatcataattatgtaccttttgttattttaattgagcatatctttatttcagggactatattattcctatttcaagactattgtggaagcaccctcatttttgaatggagtatggatgattatgaatgataaactgactgaatacccccttgtcattaatacattaaaaagattcaatctttaccctgaggtaaggtactttttccaattgtgatttttcacttttgtaaaaacttttttgtattaaacgctgattctaaatctaagatataattcaatatattaaattgtatttaattttttaaaagaaaatatgtatcttgtggaggaatatgtaaaaaagatcattactgattttgaggagagggctttaattctgtggggaactgttgatttgattgcattgtttagaaaatataaaaactagatttggtgtgcttacagggattataccaagggagcgctgttacttttacatgtcatttgttaaatgttttcttccctttcctcatttaattgagtgcactttcttgagtgggagtggagggaaggtgagcccaatccagcaagtggagatgacatttggcctctcctttatcctccttgcaaaactataaatttgttgatgtggaactctagttcaatagaatatatattttaatgattttgtcagaaggctttccagat

SEQ ID NO: 124974 - DNA, 1061 bp, Homo sapiens
tgaaaaactagtttaattgataaatcagggtcagaataatataattgtttaataaaaaagagattcattattaaagaggctatatttgagactccactcaacattaatatgttcatggtgagagagagattaatttatttaatcttctagatagaaatatgaatttcattagatgtttctaaaatggtaacccaatgacatttacagtttaatctatacttttattgtacttcacttaaaatattctggttcattttaattttaaaatctaatttgattttttagagagggaaattttagtataaatgcaatacatactgagtgaaaaaaatatagatactattgtatttgagtgttattacaaaattatctgcaagttaactgatacttttatttttgcttttagcttactttaaaaaataatacttagagtgtaagttttaacactattgctttgttttgtttttccaggagccatataacacacctctttgaaaatgaccgtcatttttctcacctctcaacattggaaagggagatggcttttcgcactgaaatggttagtttttatttgggatttcatcatagtactttaggaatttaaaaacatttaatattttttattatggaaaatttcaagatgttccaaagtagaaagagtagatgctccaccttctacagctgacagccacagccagttttccttcatctacacccccactcactatgtcttttttattttttatttttatttattaatttttttttcgagacggagtctcgctctgtcgcccaggctggagtgcagtggctccatctcggctcactgcaagctgcacctcccaggttcacgccattctcctgcctcagcctcctgagtagctgggactacaggtgcctgccaccatgcccggctaatttttttttttttttttttttgagacggagtctcgctctgtcgcccaggccggactgcggactgcagtggcacaatctcggctcactgcaagctccgcttcccgggttcacgccattctcctgcctcagcctccccagtagct

SEQ ID NO: 124975 - DNA, 1024 bp, Homo sapiens
gcaatggcgcaattttggctcactgcaacctctgcctcccaagttcaagcgattctcctgcctcagcctcccaagtgtctgggattacagacatgtgccaccatgcccaactaattttttttttttttttttttagtagagacggggttttgccatgttggccggggatggtttcgaacccctgacctcaggtgatccacccgcctcggcctcccaaagtgctgggattacaggcgtgagccatggagcccggccttcatgactgaattttaaaagcaatcttgcttctcactttgaaactcaatatctctattaatagagtacattccttcttttccaattcaaaatagatttctttccctattcaaaatagaaaacaaattaaaactgccaaacctaccaaggctttgtagttcggggagcaggaaaatcaaaatgaaaacaaaattctcagaaaatagctgtgcagtccacctgggagagtacaaagcccagcgtgttagtgataacagctgtaggtagctactcaaggtcgttaagtgctagggatggagacaaccaaagagaaaaccctcttttttttttcttttttttctttgagacggagttttgctcttgttgcccaggctggagtgcaatggcgcaatctcggctcactgtaacctccacctcctggattcaagcgtttcttctgcctcagcttcctgaggattgagcagctcggattacaggtgcttgccaccacacccagctaaattttttgtatttttagtagagatggggtttcatcatgttggccaggctgtcttgaactcctgacctcaggtatccacctgcctcggcctcccaaagtgctgggattacaggcatgagccaccatgcctggccaacccctcacttttatacttggtgaaaatgagactctgagaggctgaataacttgaaagtcatctaaaacctaaggaatagttcttcttaagaatgactttcttacgagggaagtaaaagaatttgagttctttcc

SEQ ID NO: 124976 - DNA, 1039 bp, Homo sapiens
caggaagttaggctatatggtctaaaaaggggaggaaccctcagttccaggaattgtcccccccttttccagaaaactcatgaataatccaccccttgtttagcatataatcaaaaaataaccataagtatgagaatactataagtatccttagtccagcagcccaaactgttctacctatggagtagccattctttattcctttactgaatgaacttgctttggactcgcccggaattctttcttttgcaagatctaagaactctgtcttgtagtctggatcaggaccgttttctggtaacatttgtattcatattatgtgaggataagacttttaagggaaattagaatttattgtcttcaaaacacttacgttgagtagttgtattaagtattgcctaatttaatatctgtacatatatacatatttaaaatatgtgaacatttacttagtgtatttctctgtttagaagcctaattatattccgctttgggatggtgatatatactttccatgctctcctgttttcatatactgtattcactttaaaataaatcgttttgtccttgatgctcttgtgatttctaaggcatttcctcctgtgtgctagtgcatcctcttcgttgaatgtgcttaacatcttcgagcctgagcttggagtcagagaaacccagctctcctccaggccttgctgtatcccagtcatgtgcccctgagcctcatgggaaaataagacccatatctgcctcaaaggcacccctagatcatttttgcttaatatgtgaaagggctctctaaactgcaactgacaaacagatgttagacattttcattgtaattaagttttctaattttttcttaactgttggaaagcacagttttgcttaatgcaaaatatatggaggagattctgattaactaaagttgtgcttaaaaccatcatcatgtagaccactgatttctagatcttactaggggcagtagtttcttcagatcatgactgaattttatttttatttatttattttttgagacgga

SEQ ID NO: 124977 - DNA, 1073 bp, Homo sapiens
agttttatttagttactgttagaactgtttagttataatggttactagtcatcaaagctagtaaaaattacgtctatatctgggtctagatgttgtttaatctcataaagggcagtttcatttcatagggaagatcagttctccatggaggacctttcataattcagtcaagaatcactgaatataaatacatttaaaaagcagaataatttattttcagaatacataaatctacaactattgtagcttgattttgtgctttaatactgctttctattttctcagcattctcactattatttttttcctgagagctcttaatagctgtttgtgtttttctggcatctttctccatatttgtggctgattgtcaggtgtgtttttcagcacgatcactatcacataaagaatgtttggatggcattttgtaattttaactttattaaagcagcaattgttaacataatagcgtagctgtcaccaagaccacttacagaagttctagtatggtttattgtactgatcatgaaaacgtgtgattttatctactagtttacagtagcactaattgtaaacacagtttataagtcacttgaccagttacttttgaaaacttgttacctagacaaattattagtttagggagattgttgtaattgagaagagcgaggctttattaatatttttaatactaaaatttgtccaaagtgctactactctgccctttgggcaaatacttttcctatttcctaacagtaattactactttttataatatagcttttcagtgttggagttgtcaacagcagaatctttttctgcgggttttcatattaatcataaagttcttatgtaattgttttccgctaagtttaaaaagttgttgttgttttttgaaaatgagaccttatttctcactcttttctcatctttcatatccatgggaatgttataaaaatgtagaacttaaaggttaccctcttagaattttcttggtgagaaaactaaaatagggccaggtgaatggcccaatgtaattattgagttcagcaggtgaagtttgggattgaagt

SEQ ID NO: 124978 - DNA, 1052 bp, Homo sapiens
gcaaataggtggttttcacattaatggtaattgaatttgtattcccattgaacttctatttccatacttaggggaacaatagcatcttatactgatagggggcttactctttgccaggctttgttggaagtgctttagatgaactcatttaactgtttactcagtcctcaccatgacactatgattactgtgcttgttttaccacgtggggggaatctgaggcacaaagatattaagtaacttgtccaaggtcacccctagaatgtagaagggccaggatttgacccaggcaatgtgtttcctaagttcatgctcttaactagtatgctatatttcatctcctctaaggggacagtacagcaaaagaaatgaaaccctagagtccaattctgagaaaccctaacattttgtgctcaataaatgttagttttcttgtttcttccttccccaggaaaaagaaggaaaagagggtcatacttagagatacaggaacaacaagtagaaagagcatattaggggtggcataagggccaagaaaagctaaggaagcatgaggcacagggacacaggccatcttggtgtgcttgctttcaaacagacacatagacccaactgagcaccagctgtgagagtgtgtttatgttaattcatagaggttatgccaatgggaatttgggattttaaagaatttctttaatgtttacagccatttttttttctttctaagatagacttctggctaactctaaagaatgtttataatcacctaaacatattttattattaacagatacagttagaagttttctgaatatgtgatgctcattagcatccaaataacaaatttgataagtttagtttatgtaaatataagcatatgttatctatttgtgattgatttttggccaataatatggcatcaatactgaaagcacatacagttttatttatgtacatatgggtatttggatgttgctaatatttgaaccgtggctgttatgcattgtaaatacttatcctattaggctgtattaatttctcttaatgagtgt

SEQ ID NO: 124979 - DNA, 1072 bp, Homo sapiens
ttcgccactgcattccagcctgggcaacagagcaagaccccgtctcaaaaaaaagattatgttcacaccttatgtattttatttagaaagtattttagctataataaattatacaattgagattaatttatacatacactttttagaattgtacattcagaatttaaacttcaaccacatgggtatggtttagtactattatgttttaaatatagaaaactgtgattttaaattctgagttaattttgtgaaaaattcactgtattttacatgaattttgattgtatactctatttttttttttttaacagtgggactcaactgggaggtcttattacagtactgtgcttctttttcaaccatggagaggtttgttttctagaaagcaatttttaagaaatagaagaggctgtagaggaacaaggaaatatactcatcaaaacaatatttaattgtatactacttatgacttcacaatattttaaagaccctcgtgttgtaagttgatattttaatcatgttgattgaaatgtttaaatagctagaatttcaaacatgaaatctcttgccttaattttagtaaatatgtacatatacatatattctgtagagaaaaggaaatattgtacttgttgagttgaatcatattatgcacattatctgatttattcccactaaactttttttgtgggtggtggtagcctcaccatacaagttatgaaatttgaatttagagaaagttaagttacttatccacattccacatttactacatgatgaaactggatttcccattctatgtctgtctgcctctaaaacctcacatatatattaatttatattttataaattataaaattatagttatattttataaaaacttatatattatatatataacatatatattcaacttttttattgtggtcagaataagtaacatatgatctgccctcttaacagatttttaagtgtacaatatagtattaacacaaagttgtatagcagatctccagaacttattcatcttgcctaactgaaactttgtatacattgcactccccttaacaac

SEQ ID NO: 124980 - DNA, 1818 bp, Homo sapiens
tgcaaacaacttggaacttgaagaaatggtatgtgattgaagcttttgtatacttaagatactgagattttcccagcacggtatgggaccaacatgatgaaagaatgttggatgttccataagtatttgtgaaatggcacatgaaagaaaactaacatataaattgtggtggtttcatttgggagaacttagaatattatactgaatcagtcatatattataactaaatgggaagaagtaactttttttttcttgaaaatagcctagaaataaaattatacacatggtaagaatttattgtattgcattggcagttgtcccctttacggaacagtgaggaatttatcaattttggccttaaagatttctaatgaccacatacataccacttcatagtcctttgttctacaaagaatttaactgtattctattatgagctaatgctcgttcatatcactcaggagtatctttcttgttttgcttgaaaggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaacagttttatgggatatttgttcaaactcttcacccattacatgcaaacatttatgtaaattttagtagttgtttggaagggttgctgaagtcttaaaggtcatttacacctctttccattccagatggatatctcct

SEQ ID NO: 124981 - DNA, 1001 bp, Homo sapiens
tgggcaagctgctccacctggattcccagtgtatcccgcgtttagcccactgcagatgctatggtggcaacagatgtatgctcatcagtattatatgcagtagtaagttaatctgagttcattttttaagttactcagtgtgttatttgctttattttctttttatcctaagtaagttgatttggcatttcatttgtttatgtatttaatgttgttttgactaaaggaaaaagggttcacctccagttcacatgaactaaccctgcccttggctcctccctgtcttccctaattacatttagcagtattcagatttttaatataacattttataaatttaagaggagaaaacttaggaatgtttcactggaaggcagcaaatatacatgaagagttagtcaaatgagtaaaggaatagaatcatgtcagggaggccatagcttatgtagggctcaagtgcagctaatatgcttacttgactctcagtatttagtccgttttgattctggtcagcatggaacagtcctagcattgaggacactttctcagccttcattctcctcaactcattctgcattcatttaacatggattagcttctctttaccattctcctctccttgtttctgtgattcttttgtcttccgtaccttttttatctttctggtcactctttctgtgtcctttaatagctcattttattaacatttctttctcagttcatcacgtatttgttactacgtgcttctcagcactcatagtcggtagagaggatgggatttagttgttggggtagttctcttggatttcttttttgcgtggtcttagttgttagctctctgtggatgaatcctggttcttcatctcctgtgcttcatcctgtgtctctgctttattgttggaagatttccataggggaatgagcctttacctcaaattcagtacatctaaaattcaattcctctgttctttaagtgccttctcctttctcacttcttcgtc

SEQ ID NO: 124982 - DNA, 1015 bp, Homo sapiens
tttcatataatggaggattgtgcatttgttaaaaagaatggggaaaatatttttatgctgctaagcagtaatctccctggtttattaagtgagaaaacaagatgcaatagagtaagtatactgtactactttttatgtaagaaaaggaggaaaataggagtatgtgtgtattcagctttgttatgttgttaagcattgtaagggcaatccaaaatcatagaggggacaaggacagaactaaagcctctttgaatgcaccttgtttatagtttttaccttattgccattttttgttagatataattataaaaaaatagagaaatctctaaatgaaaacaagaatttaaaaatgtcaggatgatgacacagttacaagaattattatttcaagtaactttgaaacactgtattttgactagtgacctatatcctaaggacagagaagatcaatgagaaatcttaaactttgttcaatattgttagtaacaatcttgttattgttaatttgagattacatgtagtaggataaaacaaattagtacatttgctaatggcaggtatttattagtgtcattagcaagaaagattttcagggtgagagaagatacaaataaaatgagtgaatactatttaattggaaatgtcacagtgaactcaggatttaagtttctctttataaaaatacatattttctagctctgcttactgaagaagtaatgacaagtaaaaatcagtactcctagctcccagattttggtctttagataccatttcccattaaaatgaatcatggatcctggagcaatggctgattctaggtctggggcatgaaatgtgtaagatgaacttctggggcattttgtgcctgagagcaaggaagctactattagagacagaggtcatgttaaagtgatgcaggagccaccttgtagggactcctactggtcaaaaatgtgcaatttgaggttccccttgtcaaaagtcctcttgtcatacaaaaaggaattggaatttg

SEQ ID NO: 124983 - DNA, 1833 bp, Homo sapiens
gcctgggcgcggagggcggcggtggcgggccccgcggccttctctcaggtaccccagtgcccgctgaccgccctgagcggcccagctgcttccccgatccgcaccgcggggccgtggcgtaggggccttgttgcgttccagcttgggggtcgcggtggggcggggcagtgaccccgggccggccgttgtgccctcatccctcccacccttccttcgtatagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccagtaagtgtgtaaaagctgggggcagctgctctgaccagcagcttttcgtgccgtgtaccctcctttttcctgcttctcccctccagtcttgaatcaaataggtctcttttggtagaccgcgaggtattttgagttctgaggttgtgtctcctgagtgttcgaaccatcattaatattttcctgatgaggttcagttaattagtaagaggaagcagaaatatcaagggacttaagaattggcaggcaaagaccgggcgcggtggctcacacctgtaatcccagcactttgggaggccaaggcgggcggatcacgaggtcaggagttcgagaccagccttaccaacatggtgaaaccctatgtctactgaaaatacaaaaattagctgggcgtggtggcgcatgcttgtaatcccagctactcaggaggctgaggcaggagaatcgcttgaacccgggaggcggaggttgcagtgagccaagatcgcaccactgccctccagcctgagtggcacagtgagactctgtctcaaagaattggcaggcatggaaaagggactactttctttggacttaaagtcatcaacctaatatgcgagtgagagatatatcctttcttaaaaaaaaaaaagataaagcactacaacccgtatcagagcttttattgcttattacactaaaattccattttactttcaacacttggcccagaaacttaaacagaaattgaagatttttttttcttagaaataagtatgtgtcccctataaaaattatactttcaaggttactatatatgtttcaaggaccaaagaattataagttgtagattcgttttcaccacaacccctttcaacatttttctcctgtagaggatacatggacattagtttaaaagagaactgccctccaccccaccaccatttggtgcatccctctcatatggcttttccattctgtgttccattctgaatcataactggatattgcagagataataaataaaatatagacagtacagctccatctgtccccaaagtcagatttgaaaggccgtggttggtaatcaaggagtcttggaatagtttagaaaagaagtataccgtcatgtagagtactgtatatgaaagtgaggctttcgcattctccactgtatacattttttattctt

SEQ ID NO: 124984 - DNA, 1044 bp, Homo sapiens
tgacagtttgaattgaacgtgaggagagccgaggcggcggcatttcctgtgccgcggcgggctggcccccggcgcagagccgcggcctccgcggccggagcagcctgagcgtggtggtctcagccctgcccttgcttctctccgtcccttcgcctttcctcagtctcctcccgggcccgccggcttccgcggccccgcttcctcctgtccccggccgcatccccgtcggcagaagtcccctcgtggggcagtgggcctggctaggagggtggggacgagtgtgaacgctcgggcgagggtgctgtgtgggccaacccgggcgggcggcggcggggagggaggaagaaggatgcaccaggctgaggctgtggtggaggcggcggcggcggctgcagccgcagctccagtcaccgcgtcgcctccccgctcctcctcccgcctctcggggttgcctctctccaggcgcagcccggaaggccggtggatggcgggcgagtcttgagaacggagggagaatcggtagtttggtttggaatttgggcttaatttttaggagtaagggaaagagaacgcctgggaagggcgccccccggaggagatagaaagggtgggaagggtccttggaaaagggagggagcggagatgtggagtggcgaagtttagggaaattaatttttgaaaatatttcaatattctcagttattctcttaacgagccctttcatttcctttcctcccccacatgttggaaaaagaacaggccatttcatttacattttccactcctgagttccatttcagctgtgtgtatagtaagaaataagcaaccgagatttttctaggacatttccatttgctgagttacttttgaagagtacactgtttcaaatttgggtttttacagtcctaggaaagaatttgtgacgtccaggtgttttcttagttactgaaataataacttactacatttcttgagtttattgctaaatagttcagctttaagaattctttcttctggcttttttattttgatgaaaggaaaaaa

SEQ ID NO: 124985 - DNA, 1666 bp, Homo sapiens
taggcttacagaattcaaattcacaacaaataacagaaatgttaagttgattttaattagttcttatcctttaaaaagaaaggatattgtctttttctaatgtagcttaacaatttttgttgcaggctttggtttggagatatttgatgcatacataatacatgaaaggtagtgttaaaagattgtatttcagaagtttgtgataaaattggttgttcagatttgcacattgtcccgtagaagtcattttaagtaaatccatgccagaacttctgaacaagtctgaggcaagttaggaatccttacagaacctaggagaatttagaggaatatgctaggacaacaacaacaacaaagcttgggggagaagagggaggaagaagagttacatctatggcttctaaggtctcagtaatggagagtgatcagatgagggaccagtcagaataaggatagtggtagagcagattagtttcagactttgtataatttgatgatatacatattcattgtagactgtattctgggaattgccgatagagaattcctacctgactaaattgcctgctgagaaatgtgtttcacattttgaattaataagctatcttcaatttttgattataagttgaacattttaaactaatgatttatgtcttttactaagttttgagacaaaactttttgtatacttctttttttgtactaagtttggactgtaaagataaactttattatacaatagaaactgaagaaaaattatgtttttaaggagcagaattgtaaggtagtttgattatgggtttagttcgctatatgagagcatactgttaaatgtagaccattgaactctacagcagtgttttgaagactgcaggttgtgacccattagtggacattgcacttaatattttgagggagattaaattttctttcaggtattgtgtactaggtggggaagtaattttttttaaggattgtggtcaaaatgtacagtatggatgagtcaaatctaaggtcttcgaaccttatgttaggggttggaggtcttggtgtgaggaaggaagactttaaaattaaagactgttaagtccgtgtggctttttcttactttggattcatttatcctgtactccatgtagctcgcatggttagagagatctgaggcctactcctatttgagaggatgttatcccccatagccagaaaccagggtggcttccaaaagaaaagggtagcattcggtgactctgctttaggccttgaggatgaatcttttctttgtttttgtcttcctgtgtccttttgcatcatcagagatctggagactaagctttgagcatgggcttggggaagaggggccaaagaggcagcttggctggcattaagtgttgaaggccgtagaccagacacacactaaatccttgtgacttacacttggtgcagtccagctatccagatgtagggattacacattggggtttgagttcaaaatcttaataatgatttagaacatgggctttgatgttagatatggatgcaaatcttggctttgctactcaatagatacaccagtcagagtaggttagattgtaattttaaaaactacagttaggcgttgttaacaatacggtacattgagaaatcatagagtattttacctacacaa

SEQ ID NO: 124986 - DNA, 1793 bp, Homo sapiens
ggagggaacaaatgctgtgccctaacatagtagaaggagcaaaagggtcaagcacctcccttgcacctcttttataaggtcattaatcctattaataccattactagtgattaagtatcaacatacaaattttgggagaacacattaagaccatagcatatggatagatcatgatatgggatatattttgatttgtttaacatgtctgcctctgatagacattaatttccagtgttttgctattaccaactttgacatggtgagtcacttgggatattgatctcttcacatttgttagtgtatctaacaaatacactaactgttagtttttgaactctttgaagcaggagactaccacttaaaagttgtagtattgacattgtcattatatcaataatgtattgatgttatagtatcataacattgatgttaagtattggtaatattgctgttaagtcattagtttagaacttcaacaatcaagttcattcacttaacaaatacacgttttgtacttgctgtgtgctggccactggggaaactgaattaaatgctgtggcagttgaaatagaggcatggtgattaagagttttcggatctagagtcagacttggattcatatctcagttctaaagcttaactgaacctttggcaaataacagaacttctatttttccttctctgtaatgtgggaatcataaggttattggagaagtaaatgagatagtacatgacaaatccttagcatgatgcctggcatataataaacactgagatgttagcttaaaaaaagttatcagactatattgcagttgactttatgttctgcctccactgtgcttaaagtctaggcctgtgttttgttcacctttgtgtccccaacccataactggcttgcatttagtaaaaaatttgtgatacgatataaaggtatgcagagcatacagtgaaagttcaaagcaggataccttttccatgctggagaaggtgaatctttgaaagtcggtaggagtgattaggtaaaggaggtgaaggagtaaagataattattctagactgagaaattatgttagtatcaggttatgaggttagaagaggtaagtaggcaactggtattgctgtgctgagaatttaaaaatctttattgaaggctttaaaagaaaagtggtaatcgtaagaatcgtgatgataattctctctgttgagagttgacagggcaccaggttggagccattaaattgaaggagtttaatgtagcagtttaggactaaaaattggtcagaagcagggcaatgggaaaggacatgagggggatggttgtaaggtgttagggaagatgtgggtggtgagtaatgagtccagaatatttgagctttctgacttgagtgaatgggtagatgaatagatgctatttcttgaaataggtaatttgaaacatgaaattgagaggcctgggggacatccaagtggacatgtcttgtagggtctcaatactaggaagacatctaggatagaaaataaacattttctgataattgtaaatgtattcatttgtgctttgaatttttatgtttagtaagtgagtttgtgaacagagttgaaggaaattacaataaagtgatttgtgtgaaacttcgttgtccttcaaatatagactgaggtctccagtttctggggtagtactaaaatgtttcctttttttttttttttgagatggagtcttgctctgtcacccaggctatagtgcagtggcgcgatctcagctcattgccagctccgcctcccacgttaac

SEQ ID NO: 124987 - DNA, 1031 bp, Homo sapiens
tccaaaacaaaaaaaaaaaaaacaaaaaaaaaacagtttttagagagatggctaactcaacttcagctgtgggcgaaaaagataactagaatgacttagctggcaagtagacccaccaaaaatacttgtttgtgttagtgcatggtgctgtgctgttagagaggtaattacatagacataggccccacgtcccttccccacccccccattttttttttttaattttggaatagttttggatttgctgaaaagttgaagcccctttctttttgaaagctaaacatgtggtcaacacagaggaaatgcagaaataatgctacagacatgcaaatatagcacgatatatgatataaatgcaccatcaacgttagtactggccagggttaagggaaatgtcaagggaatgggggttttatgcttaatggaaacatcttttatttgaatctgtgttgaaagttttgggaggctccattgctttttaattgaaggatgtgtattctagttctggttggtgggtagtggatttcatttaacaattagaatctagctaagataaacaaaggacctttttcccccgtagggtagtttcctcattgttcttatggcttccagtctcttcccacttcatttaataaataaatcttttaagattactatacctaaaacattacttttacaaaataacttacctattatagtaacataaatatgtctattatttatagtattggcttctagagctcttgttaaaaatattatttcttgggctctatcggcaagattctaattccctacttctagactggggcacagatttctatttttaatcaaaagctccccatattcttctgattatagccaggtttgggaataacttttctgcaagatataagtccggaggccttaataataactatcatctgtagggcaaccactgtaacaactgtcatttattgtacttactgtatgtgaagtgccaaaccctttatgttaattgttttgtatataccttacaaatatcctcatcaaga

SEQ ID NO: 124988 - DNA, 2098 bp, Homo sapiens
atttcatttcatgaataagaagacaaatttcaagaatctcatgcctgtggtataattagtcagtgtgatcaaaggagataattaaaaaggattcttaatatgatatgaaggggatttgaatttttttattgtgaagaatcctttgttattttgcttttttagttggttggtcaatcatcttgttactaactactgtcaattgaaatctttgctctgaggcaggttttctaaatttttatttcattcccttggatttttataattaaccattatattgtcagtcaactcatgctcaaataattttgtccatttaagaattgatagttttattgataatgccatgaaagtagtttgatttgctgtgaataatagtataattttctaaaataggttaatgaagggaatttgaaagtgtgattgaatagtactgttgatacatgaataacttggccctttttgcttttgtcagcaacagaagaaccttgaaggctatgtgggatttgccaatctcccaaatcaagtatacagaaaatcggtgaagagaggttttgaattcacgcttatggtagtgggtaagatatgatttcttactaaaatggaactttggtttaagttttaaacgttagtcaactctgaatagatttaagaaaacactggcacagatatctacagtgatcatatctttgttgtattttctcttatgtgcatacattttaaaatttaactcagtggcataatgggatttatgtcttgcctcttattttaaggtagaaactacaagttgagaaatggtgggtgatagtgttggagtggaactctagagaagttatcttcaattcatagtgctacaaaagaaaatagcatctggtggttacttactactccaggatagttttgttttctggcttatatgctatagtggagtatcatataagcatttaacttaatgtgctctgaattttgaaaagaaaggtaggatagaggatcataataatgtagttgattacccttggaattcattaattgaatgtaagcactggaatgagtaaaatatgactctcctggttctctaattcagtctgagttttcttttgtgtgttattccatgaacacattaccctgcctatagtccatttgaaaatactgttaaggataattttgactgtaggttggtagcatcattattaaatatgaagaaacacactgtgtctttcccatctataagattagttatcttcaataacagtcttactcttaaatgactatacagtattttcacctcatataggctgactttagaacctaagttacgaatattgtatagtgtaactttgttgtatttctgttatttaagaaggtgaattgcagggtagtggattagctatccttaacaaagaaagttgagttgatgcttgactttttaggtagtatacatttttgttaactatgtttcaacatctagtatttttattttggtgctgaattaggttaattgaactagctgtgaaatactcctttattgggaggtagaatattttatctactgactgcaatattttacctgttggtcagtttttggctctttggaagttgtatacatcgtcagagttcacagttaaaacaggtacagaatatgcaaatttgatactttatagcattggttaccttgtctatgtatctcttgttgagtagaagtatggtatatctagcttgcaaactgctgctgtggagtagagatgggtctagatagagggataaaataatgcagagcataccttttcttcggtaggttggtaacatcatcattatatgaagaaacactgtatcttacctttacatatgtaatattaataatctcaagtgacaaactgtagacaaatacaattttttcacttacgggaaaacctcctaggtccattaggagaactgtaacaattaaaaaaatttcctttgactttagaatttttgtttaaagaattactttttaaactatacttagtaggataatgtctggtgatcaaggccagagagttgatttaaaatctctgtggcatttttccaaatgaaaaaaatcaaataatcatctgattttgatttt

SEQ ID NO: 124989 - DNA, 2095 bp, Homo sapiens
gctgatgggtggctgaattagaaagtatgttttgtgatttagaattttatacggagatgttcattgtgattaattctttgtattagcagatttttgctttttatagttgcatgatttcttgttttgatcattcattattgtctattagtaaagaaaaactttatttcactcaagcagcgacatataatccaacttggattttttaataatgacatttttctttgggaataacattactgttaaaaatgtagattattagatacattacttttaatgaatataagtggtataattagaagactgaaaagaatccctggaaacatgagtctgatttgatagctaagcaactgaggacaagatacttattctctgtagcatattttctaatgtcatttcattgtctcaccaagaagtacttgcataaggcaagtttgattatagcatctgttgaatatttaagattgcgtaaagtgggtgagtttaacagatattttcccttatttcttttaggtgaatctggattgggaaagtcgacattaatcaactcattattcctcacagatttgtattctccagagtatccaggtccttctcatagaattaaaaagactgtacaggtatggatattagtattgttaattgataagctggaataatattaatacacacaaagcacatgttgtaacttttattaggcttccttagaggtaagatgcaaatttgtccttagccagtgtatgatggtaaatatgacttcataaaatttaaaaaaaaaagtacagttcatcagaagaattatcttggctagaacttcccaaatttgtctagaggactctcctagagatgacactgtgacatagtaaccaattcccctggagttgtgctatctagtatggtagtcatttgccacatgtttaaataaattaaaattagttaaattaaaaatgcaatttctcatttgctccagatacatttcaagtgctcaacagcccatgtggcaagtggctgccattttttgcagcacgtatatgaagattttcatcattgcagaaaattgcattagatggtgtagagaaaacgtgatttatagaaaagctattgtgatttaaatatagtgttctatattagtcagtgggataataccatatcatagttgaatggcaatagcgattctgtaagactcccaaggtatatgtgatctgatttactagttctcagtctttgctatgcattccaatcctcggtatcctgttaaatttagttcttctagtaggtctgagatgggctgcaatttctacatttctaacaagatcacaggtgatgctgatgctgctggatggtagatcacactttatagagcaaggggctagattctagatatgtactttttattaaatagtacagcagcctgtagccacatgtggctattaatctttgaaatgtaggtggtctgaattgtgatgttctgcaaatataaaatataccacagatgtctaagactgagcatggaaaaaaaaatctcaataattttttatattgattgtatactgcagtgataatattttggatgtatcaggttaaataaaattgattgatttcacctttttcctattttaaaagtggctaagaaaattataaattatatgattgatatggtatttttgtttgtcagcactgctctaaactgttgattaaaaatattgttggtgagctctgcttatgtgatatataggacatgagcagagaggaggcaagtgaacagttctggctggagttggcttcattcaggcagtgatgcttttagctggatttgaagaagtggtagtgatcatcccagtgcacaggatggagggacagtctgtatattctgggcagtaactcatatatcaaactataagatgcagtttagtaactagatcccaaaggagtaattttgtgaagtgaatttcttatttctccttctcaatgtttctattttaggattttttttttttttggtaacctttatagggcttgagatttaaaattacctgcaaaattatgctctaaaaacttgttcctacatgcttatttattttgtgataaatattggaaa

SEQ ID NO: 124990 - DNA, 2583 bp, Homo sapiens
attaataaagaccatgatctcatattctcatccctgggcattatctatttataagagacttgtatcttaaaggagatattcattcacattcacagtcttggaaggaatgggaagctgtgtacactgaacagagagctgatttttagcctcctgtgtgtaaaatagcagttctgattcaagtgaagttttcagtattgatagaagctcattaagattaattcttaacctcttatcttggacctcaggaccctgagttatatctgtgcatttccagatgcgagctgacaccagtcctggaattctttataccagtgcttctcaaacttgagcgcacatcacaatcacctggaaggcttgtcgaaacacagattgctgagtccctttcttcatggtttgctatatagcaggtttgaggcagggcccaactaatttgtatttctatttagttctcagaatgtattactgccagtctgggtactacattttgagaacaactgctctgctgcaaactggttttatcctgtgtctgtcagggtgaaaggaggagagggaagtgttttaccttagttctttcagaatgtttcaagtggaatgaaatggtaccatgttacctccattttttacttatatatatatttttccaaaagattgatgaaaatgaagtgaaaaaaattgaacatttgagctctacttcatgtttcagtatcaaatatagatacccagattaacaaaattttttggaaaaatattgcttacaatgttgtatgtatgttaacagttaaccgttattttataattttgtaccatttgaaaatttttatatttatttatttatttttgagatggagccctgctctttcacccagctggagtatagtggcgcgatctcggttcactacaacctccacctccaaagttcaagtgtttctcctgcctcagcctcctgagtacctgggattataggcgtgtgccaccacgcctggctaatttttgtatttttagtagagatggggttttgccttgttggccaggctggtctcgaactcctgacctcacgtgatccgcccgcctcggcctcccaaagtgccgggattacaggcgtgagccaccacgcctggcctgcatttgaaaatttttaaatcatacttcatgtcactgaaagggtatcatctgtcttttcttgggaagaaattatcctttcttctgagattgaagtccattttaattttctcttaatgtattaagataattcttttgtgcaatgacactgttagattttttaaagttcttagttggaaactacgctgctcccctttgaaacattttattggtccatgaagtgttttttttttttctttccgagatggagtcttgctctgttgcccaggctggagtgcagtggtgtgatctcaagcttactgcaacctctgcttcctgggctcaagcaattctcctgccttagcctcccgggtagctgggattacaggcgcgtactacacctggctaatttttgtatttttagtagagatggggtttcaccatgttggccaggctggtctcgaactcccgacctcaactgatccttccacctcagcctccgaaagcgctgggattacaggtgtgagccaccgcacccagctggtccctgaagttttgtaaatcaaactctgtagatgaagtgggtgcaaaattttgaaagtgagaaaaggtgaaagcagtatgtacttctctggggtaacatacttgatagactccttgaaaaattttcacagagccctatcaggagagtctcctgttgacagctggtccagttttgatagtttttgagccattcacataacatatttgaatgcttgtcttaaactaagttttggggctacaatgatgatagacaaaaagttctcaaagatctcacaattgtgggaaaaatatggacaaacaattatgacttagtgagaaagatgcttttgtaaggtgctgtagaggtgaccttggcaaggtaaattttaatgaagtggtagcaagatggcagtgggttgagaagtgagtggtgagtcagtgaagatgggtgatggctattaaggaagggatgaaaagggatacctaggagtgagtatagaggactcagagagtggtttgatgatttccaaaagagacctgagaatggttatatcctgtggcaagtcattctctaagaaatgagagattgacgatagaggggaaatagtgtaaacggttgtcaagatgaatctaaaatggaaattaatcagttccctagaacatattgagaaattagctttaggaaaaagatatatttcacacacactgtaccatggaaggtacagtgctgattcagacagactgggaatggtctcatttttaagtggagatatgaggtacttcactgagcattgtgacagacatgggcttgggaagagcctactgggaaatgggagaggcatgagactaaggagcacataagaggaatattagcagggaaattcttgttgaggttgaaagtcatgaattttatggtataggaatagaaagatgggttaatccagagtgggatttgagttggaa

SEQ ID NO: 124991 - DNA, 1100 bp, Homo sapiens
ttttagtctgaagtaattatcttagtattttataaataatacttttatttttgtttgaattcacattgtttttgaggtaattttctgtcaactcttaaaactcccaagttcaccatgaagtttttttattatttaaagtaatctctcatttgaaattttaaactgcatataattgttttcatattatgaagtgtgttattaatacacttattagtgcaaataatatgctaatatttagctgtgtttcgacagtaaatagtttattttctttcatttggaaagttttgaataatgaatatttattcaacataatttatatttttgaatatatagaataacttgacatatcttctactggtaaattcattttgcccatttgaaaatactgattattgtcctttaacagtcatcagttaattcatatgtagaattgcagcttgttttgtttatttgcgttctatagctggcagcctgttatcgactacattgatagtaaatttgaggactacctaaatgcagaatcacgagtgaacagacgtcagatgcctgataacagggtgcagtgttgtttatacttcattgctccttcaggacatgggtcagtaccttgatacttctgattccttttttgttgttgttgcttactgttacctttatgtgcatactttagtaatctttaagtttgtgaagtacacacaactatagccattatgaagtactaaatttcatgtagaaatgtcttagttgaaaagccattttaagtcctatataagctaacagtgattttactccttagttcttcattcataaggattttccctgcttcatgaaataaacagtgttgccaccatggtttgaggtctcaatgtggcaaatttagctttcatgttgaccactctgctactaatagaaataccaaataaagagaagcagccataccagttagacatattcaaaataaatccaaagatgctatttattataagtttcatagaaatgattatcaaaaacacttgcatgccaatgttttcttgtgccatttctttctacaataaatctatttggcttctgtttcaccttagctgtcatagacgtgttgt

SEQ ID NO: 124992 - DNA, 2576 bp, Homo sapiens
aaggccctcgctgtagagggtatttcagtgagaagatgggagaaacaaatacagatgctcctcaacttgggacagggttacctgttgaagttgaagatacgtttaatagcgtagcctacatttgggcaaaatcatctaacataaaacctattttgtaataatgtgttgaatatctcatgtaatttattgaatactgtactgaaagtaaaaagcagaatggttgtatggtttctattctatgcgtattgcttgcacactatcagaaagttgaaaaattgttaagtggaaccatagttagtgaggacccatctgtatgcaggcaggcagttatggtacagcacactaagtgttgtcagcacatagaaatatgcctagtctcaaggttagagaaggattcccagtggaaattggatcataagccagtgtcctaaaggatgaataggaattagccaggccaaggagaaggaggatgagaatggaggagggtgttccagctaaggtagtagcctgtggccagatgtcaaagtatgatgctttcaaggaattgtaagaaattcagaaaggctggcacattggaagtaggaggcgaaagaaaggccaggaatgctaagagatgaggttagcttgagaatctatgtcttcacaagctttgtgggccattctagttaaggcatctggcctttagtaagatttttggtcaggtcataactccataagatttggatttagaaagaccactctgacttcagtatggatgattcatgttatagttattcattccaaaggacttggtggcctagactaaagtaatggaaatggagatatacatacatcatgcatacacacatctatacacatactatatataggaataggattagaggaggggaggaatcctaggtttcacacttgagtaatggggaagattgtaatgccattcactgagataggaagcgtagaagagggaaaatgggggttcagatgagcttttgattttaaggagcccatggaacacccaggtagcatatccactgggtaaacacaaacctggaacttaacagtgagatatgagctgtctatgaagatttggaagtcagttgaccaattgaagataattgaaatctattgtagtcataataattgtactgaatgtagagtaagaagagaaagcctggtagggaattctaaagaatgtacttcttaagggactagcttactaagaggatcctgaaaagtatcctaaggaagaagagcttgtgagagaataagtaatggtaagcaccatgatagaagtatttagtcaccttcttgaaagtacagaggcaaactggaggcagcagccagattgtaatgaataaaagggatgttgaagattatcttgtgagcatcttgtcagagaaagatagttggtagcaagaactgaatgtggagttggaagaggactaccatttttcatttttaaaaaatcctccagcctgggcaacctggcgagacattgtgtctacaaaaaatacaaaaattaggcaggcatggtggtgtgcacctgtagtcccagctactcaggaggctgagatgggaggatctgagcctgggaggtgggttgcagtgagctgagattacaccactgcactccacccagggcaacagagtgagaccctgtcttaaaaaattaaataaaaaaaaaaaaattaaaaaccttgtaaattttgagtaataaatatagagataattctaggaaattctattaggagcctttctggtttttccaattcctctttagggccaaaaccctgtgaccagggttcaagggcaggagtcaaagccttagccactccaatgcttcttgaagtcctgttctacctaacttttgctggcctaatacatcttcagagtgtttctgataagtaagtaaagtagttacattgtatttaactagcattggggatgtgaagaatcttgttctcccaaactgatcaattcagtcaaattaaatactgtgtatttcagacttaaaccattggatattgagtttatgaagcgtttgcatgaaaaagtgaatatcatcccacttattgccaaagcagacacactcacaccagaggaatgccaacagtttaaaaaacaggtgagcaggatgtgttaacccaggtttcttataccgttctcataatttgcagtttttactatttttagtataatgtgttgcaatccattcctcttactgctttactatattgtcatttatactgtattagaaataactcttcaatcttctgcctttgtcagtttttaaatatggctgttttaagtgttctgtaataacacccccacacagacaatttctccccatactctttagaattattttcttttttcttttctcttttcttttctttttttttcttttcttttttttttttttttttttgaattattttcttagaatgaattcccaggaagtggattattctttcaaaggctatgattgtttttatgggtctttatctccccactccccattttgtcatggtgctttcccaataaaacaaatttgtacatctgtttcactgtgactt

SEQ ID NO: 124993 - DNA, 2084 bp, Homo sapiens
ccagcattgttatttttattttgaaaacttttttggaatgaagtggtaaccaatcatttctttgtcttttccttttattttcccgaaaggctgaacattttaaaaacaaagtcatttttttccccctttttgtaaacatctgctcaaatcctttgtctttttgaccagtagtacttggtattacccgtatttattgatatgggttctttttattctggatatttagttctctctcattttcacaatattttttctgttttctcttttgctgcttatttttgttttcagtgcactaattttgttttcagtgcactttacgggatatttatagtttaagttattgttcaaacctatgaccctaagattaagagtctcatgctgtatgactgagctagctggaaggccactaaactgtttttctagactcacgtctagttgtctcaataatattgagttacacagtcacacatatttctaatttaattgtgtttggttcgttatatattacattttatgaaatgtaaggtcaattctggaacctttctctattccagtagtccaaaggccagtagtatattgtttaaaccacagcagctttatataatatttaaaagtagattgtaattatctctattgtccatatagtcctattgtaacaaaatactttgtttttcacctttttcaatatgaatttcagaataccttgaaacctgttataaaaagcctgttaaaatttgctttgaagttgtgctaaattcatactaattttcagaaagttttagtacattgtttttactgtatctagtatttttgtgttttacacttacccattcccatttttgttttgtaatgtgctatttctaagtttcaaacactatcatataatacatttctttttgtttattatgtgtttcgatttggatttttactgataaaggtaaaaaagatgaatatgaagtgacctcttctttcaaattggtcacatcctggtggttgtactcaggtcattttaatatacaacctctgactaaaaccattgcttttagagctagctactattactcatttttctcgtcatcatgtatttgtcaattccttgtttattctttttttttttttaaatataggtacgtaccctaattgtaaaagaagtgtggtcctattttttttcagtgacaattttacttctgtttacttctgtctactatagtaaccatgtaacacaatttgttcagggtccttttatagctgctgggaacctttgccaagaaagttgcaccaaaatataagtatagacagggaagctaggtttaggtatattagccattggtttgttatgggttcaaataaggataggtagttgaaaattatttggatgtctgtattctgtttagaattggagtgattttgaacatgataatttaatttgaactaggtcatttctgatgttaataataagttgtcttctctaggtttctgcattctccttattaattcttgagcttcttaatttctaggatgtgttttctccctgtgtccttccctaatcttacacctgttgctcctcaatttgtgtgtatgcacatgtacatgtaaggatttttctgatgaatgttcagggagcagtgctgtacttagttttaccttacttttgccagattctactaaaaattttacgtgagtttagccctgtttattcaactaaataagatacttgggaatttatatctaaaggaagaatctcagtcattgtaaataaatgacctaaagtcattattgtggaaatcaatcagagaaatccctttctggagttttacatcctttttggaactcttttggtatgacagctatatgactttaacacttcggaagtaattggatttggtgtttatatatcaacttcatagttaaaaaaaaaaaaaagactagcgtagtactttaattttagattacaactttgcatcattaaaaaacagtaaaggatctggaaccaaggacccatataggaatcgaagaggcatgtaatgaacataagactaatatactaattatgtatggtgctcttttgctgactacttcttcca

SEQ ID NO: 124994 - DNA, 1050 bp, Homo sapiens
agccacagaattgtgaagggctgaacatggatgaacacaaatccagtcaccaggatttgaatttccaaagttagagcttaacaaatatactattacctggtttaggtactgttatagttggtttgtgatcaagtaggcaagctagtcattagccccccgctttttttcccccaaatgccaatatagtttttaccttttatccccccccaggtatgggacaactttctgtagtgatttttagtaaataatttgaccagtatatgcttgaatattcttaacattaaagagaaaatttaattttatttattgtttaccttggtggcaataccatgtgatggcagtttactaaatatttgttaaatggcctataaaaactaatgcagaaactatcgaaagtaaattttttttttttttggctaacctgttgagtaatgtaactttttttatttttgaatttgtgaggactacagagatgtatttgaacaagaatactttgttttataggaccgtttacctcttgctgtggtaggtagtaatactatcattgaagttaatggcaaaagggtcagaggaaggcagtatccttggggtgttgctgaaggtaagattttcttcagtgaatgactttctaaaatatctcaaaactgattaaaaatttgtatttatagtaagtagtacagtatgcacactgtattgatatagtctagattttcaaggataatactgatttcaggttcttgtagtctcaattttctctttaagtacattggtatttttcaaacctgtatcctaccaagtcaggcaagtgtgtgttaagtcctaaagttgtagtataggttgaacattcttaaagagaaaattcaaaatgtgaattgctccaaaataaaacgttttgagcactgacatgctgctcaaaggaagcgctcactggagcattctgaattttggatttttggattaaggatgctcgaccagtaagtatagcacagatattccaaaattccaaaaaaattcaaaacacttctggtcccaagcatttcaaataagaga

SEQ ID NO: 124995 - DNA, 1043 bp, Homo sapiens
catctctcttttgtagtttacccctctactcccaagtaatattcctatttgtgatacattctttaaaaataaaagtaaagaacctgaaagttcttggctccctttttcattttggttaccttaagattttttctaaagtgattctcccttcactcacaccactgaattttttaaatgtattatagaataaatatattttttaccaataataagatttcccctttcagaatttcaaagttgtttctggagagttcatttgttaggtttacatatctatttctgaggattaaactacaataaggcaataatagagtacacttctctgtcatgccctcacattgagtgtactatgttagtgttaaatctcaaaaaaattgatctgttttgcatttcctcttcttgtttttacaccccaagttcctgtgaaatattttttgaaaagactaggtttagtggaaatataacatatgcggtctgcttttttcttacagttgaaaatggtgaacattgtgattttacaatcctaagaaatatgttgataaggtaagtgcaagcaatgatggaaatagcataagattttctttccctaagtaagagttggacagatttactttttgccttctataaatgtagctaatttaaatttatatcttcagtctagccatgaagtaaacactacatatagatgattctttctccaaggttttgaagtcatgagcaaaagttgcaaagtaatttgtctagggatacataggaaaattagtctctttatcattatactttgtgtcgagatttaatactgaaataactatggaaagtgaagtagaagaggctcttttttcttaatgtgaaaaccttgtgaaaactatataagagaaggctagtttttgagtccaaagctagaatttgaatgttaaaaggtgcacagcctggtagctggtgagtagggcacattttatgtactggaacatagtgaataaaaccagtattcctaccaggtgagaaatccctaaattgtgtcttacacacctgctgaaagagaa

SEQ ID NO: 124996 - DNA, 1114 bp, Homo sapiens
agacagtttgaagaaacagaaaattactctaaaatttccttgtttgaaaacaacttgatatgtgatctgaaatttattattatgtattaataaaaactcatatattaccttagtaatattgctaaaaggcagtgtcttttagattttatgagcttcagtagtggccaatctgcactctgttgtctagtatttaaatagataatataaagatgaatactctttcatagaaaggtcatccttcagtaactgtttttggggatttataggtcttaaaatgtcactggaatctaaatttggtgtcaagttagcttattttttgttggtttactttgagtgtaaatgaaaacagatgaatgccaccttccttaacaatagtcttttgttcattttaaatctgaaatttttgttttggtaaaattttgaattcatattaaaactttttaagcttttttccccctagctattaatagaagcaaactcttgctgtttgtttatgacagaacacacatgcaggacttgaaagatgttactaataatgtccactatgagaactacagaagcagaaaacttgcagctgtgacttataatggagttgataacaacaagaataaagggcagctgactaagtaagtatatatttttttctccaaaaaggtattatttctgtagtcaataatcatattgtttcattttcattaaatttcttctggctactcagtagaaaatttggataatgttctttatgcacagcagcataaatttatattgttatgctttgttaatagtagaagcttttttgaatgaaccattttgatagttttcacttacaaattatgtggaaacaaaggacaggctttaacaaaaggaatatttagatgaatttgttcttggttaccttctctattcctattccagggagtaaattagctggagtttcgttttcttcttttggttgttagagtggtgtaagtgactaccaagtgtgtagctttgccctgttgagcttatatctcaagctgtggtggtttcatgttgggttcgaaaaaagagatgtgtgaggaagctggtaaccatgtctgtgccctactttttaaaaatctgtcattattgaaaa

SEQ ID NO: 124997 - DNA, 1001 bp, Homo sapiens
ggaagagattgtaacacttgaaattctggtaaaactaaaaatattctacatatgttaacttcattactcattttctatttttcatggtaaaatgttgtttgaagaacaaaattaaattattttcttctaatgtttcattctgtgaatgtattttgggaatttttttcccattttccttctacagtttatttggtatgtcatccttaggtttgatatgcagtaggtttagagaacatctttgttttttagatttttttcataaataatcaagttttatatatgaaatatggaaagaagttctaggttataaatatattaatagtgacatatagcatctgatttgttttcatcagctgtttcatagttctgtattataatttttattcacagacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttctagaagcaagcaccgtgtttataataaaataatacatacttcaatatgcaagtgcttggacgtagtatattaggtaggacagtgtaatagaatacttataatgaattattagttataatgaacaagtttgagttgtgaaaaataaaattacaaaccattccatacaggtggcataagaacactaaagatgagagtttgggggtggatttatgcacacaaactgtgttaggataataataattgaccatatttatttgtgtatgagtgaaaaagagggaaataacctttattgaactaaa

SEQ ID NO: 124998 - DNA, 2255 bp, Homo sapiens
atctattacatatttaggggtatgttttaactgttgaattatgtttttacgataaaattcttaagacaaaatgttagatatttgatttccaatacaactaatcaattactttctcttaatttatacaaaattcaataatatttgtaccttggttttcttttccttaatagtttcacttaaaactgaaaagtggcattcctataaggattatatagtttatcctcattactaaacattttcagatttgacatttgttctactacactaccctactgttaacattttccccaaagaagaggaaaatagatttgtgaaagcaattgcacttcaaaatgcaaatgacagtgggggaaaaagaataccctgtttgctgccagttgatactttttagtttgtgctgtttcatttgggaagaattgttcttgtatattaaaatggagttttgccttatttttttactgcttatcctggagttttgtcaaatatttgattgtctaagaaaatgctattatagattaacattgtcttagctgtttacttctaaatcttttaatttttttcagtgaaaaagtagtatctgaaaatcccaacattgttgtaattgggttagctgttgttatcatgttgtctatcatgtttataaaatggttactcatcttgcttattttccttttatcctttagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgt

SEQ ID NO: 124999 - DNA, 1044 bp, Homo sapiens
agtgtcagagttgagagaggcctggaggagaggcatgaggctgatggggataggtctcttcccaagagaagcggctcgtagcctttttggactccagtgtgataaaacccggacgtccctagaggagaatccacatgggcctagcctcattgtgcctgcgtttttaggggttcacgggcagccaccagtccccgactcctggttactaactctagcactaggtagggggtgctaatgcaaatttcttaattcaatgggtttctatgtttattgatttattttctaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctgga

SEQ ID NO: 125000 - DNA, 1047 bp, Homo sapiens
gtcattccctaaacaatccagtatggtaactatttacataacatttacattgtattaggcattctaagtaatctaaagatgaattaaaatatactggaggatgtgcataggttatatgtaaataatatgccattttatatcagggacttgagcatcatggattttggtatcacaggggctcctggaatcaatctctgcagataccaaggtacaactgtcatttttattttcccctttgattgttttgatcatccttataattattcaaccttgtgatattctttctgaccaagcgttgaggagcttattcatcttctaggacctatgaatgtgaagggtagagaataggagagtgagcaaagacggctggcctcagcgctggctccaccctgcagcccactgagcaggagacctcacgactcttgtccagtgtgaaggttgtcctgtttttttcttctttgggtttcctagagagatgatgatttgctgaagacattgaactactgtcgtcaggcaagagtacaggaaaagtttacccaaacccaccagggtgtagaagggatcacctgtaagtgactgggaaggtgacccgcaccgtcacattctcactcttggccaaatgtgttggaggttgatggttctctttgcctggtcacaatggattcagtattccagacactcctagcacattgttaatgtttagtaaacatgaactaatggactcagggcctgatccccttcagagtagggtgagtgctttgtctgtatgactgtcctagggtatcaaaagctgtcacagagtagatctcgtgtcctcaatgatagcagcacccattctccaagagctgtgtgttcgtcctgattcacagaaatctctccccttccaattgttcccgtattagtaagaggaaatacatttagtatgagcaagaatgggtgcaggtgatttctgggtggctcttatttacatccatgtgtacctgtaataaaagagtttcctaacttttgggtatgccttcgtgctttctaacagctttcccatttact

SEQ ID NO: 125001 - DNA, 1048 bp, Homo sapiens
tcaacacacacatcaatcattacagatagtggtgcatgctgagggtgatggaggtgaggtgaagagaagcctatttagatgggggtcaaagaatgcctcagctgaaagctgatggatgagaagaagccaggcacggaagaagccagggaaaagaatgctccatggaggaattggcaagtgcagaggccctgagagtgctggctccagacagaaggccagagttctagagtggcgggtgggtggggccgcagagcaaggccaggccagatcaggtggggccttcaagacttcttgtaacagcaggaggaggccacagaaggttagaagcagaggctgaagaaatgacctcttaccagatagtctgactgctgggaggtggtggggggcggggcgtgcatggagagggtcctgggagttgagtgaagaagctgttgcaggattcaagctaaaggcaatgatctctggggagatggggaagtgggcagagatgagaagccttttagaggtaaaaactggcaagacttgcctatattgtggatagtgtgagattcagcaggtagcttgtttgaaatgctctgaggtttctatgagataggtgcagaggcatatataataagaaatcctggggctgacacacatgcctctgtattattttaacatgatgcaaggtgttcaccttacccttcccctcagccacagctgtgtcctgggtgtggggtcttacttaggtccatagcagatggagtatgaggccatggtctgccctcagcagatggggcatctgacaaggccacatattctcttcagcatcaatgacaaatggacccagggcttgctctggggactttaggtgactatttctatcaggagaggttcgcatacattcagttcaacattgagcagctactttgtgcttactacctgatgaggtcagaggcatgggcgcaggaagaccccactttgtggtcgggggctcaccgtctcaaggacatacacattcagcaggtatttccaggatgatgtgtgggatgagggaggatgtgaagct

SEQ ID NO: 125002 - DNA, 1035 bp, Homo sapiens
gcaagtagttgttagatattgttagaatttcagcttagaaaaggagttgcttctatcttttaaactttgagataaattttattaaaagcatttgaaattacaaaatggatgtttaagatattaccatttgcaaccacttaattgtgaaaatcaggaggccaggagaagtggctcatgcctgtaatcccagcactttgggaggtctaggtggaaggatcacttgagcttgggagtttgagactagccctggcgacatagcgagaccccttctctacaaacaaacaaacaaacaaaaaaacaggctttcttgtcattggtcaacctaggcaagataaactggatgaagtatgagaaatgagactgtgagatcacccataacccctaatttcaaatacaatatttgcattcattcaaactgctgtggtattttgattgattaattctgttagttaagattatatatttaaatatataaatttctttcaaatcacaaaagtcccttccaatcctgaggctttttccgcagagagggaaaatgatcactgttactaccaaatacccttgaatactgagaaggaagagtggctgttcctatagataagatgtgtttggtttttagggctgccataatgaagtcccacagactggggggcttcaaccacagaaatgattgtctcacagttctggaggctgggagtttgagatcaagacattggccagcttggttttttctcagtcccctttccctggtttgcagatgactgtcctttccctgcgtcttcacatggtctttcctctgtacccaaaatctcttcttatgaggtcaccagtcatatcagattagagcttaccctgatggccttcttttaccttaatcaactctttaaaggccctatctccaaatacagtcacattctgaagtactggggattagggcttcaacacaggaatttggggggacacaatttagcccctgacaagatcatttaagaaaaattacccaggggtttccttctgggcagtttgtgagcaact

SEQ ID NO: 125003 - DNA, 1119 bp, Homo sapiens
ctgtgctgtcagtgtgcacagatgctgttgggtagccctcctggctgtgactcccttctggtgtcctgtgctcacctctgtgtttggtagctgtggaactcaatgcccatcccagagtcaatcattttgacttaagacaagcgattatatctttgcactcctaacatctgtctagcacagcctgacacctaggaggcagaaaaaacagttttgaatgtgcgagttgagtgtggccaaagtgagaagcacctggagttggcctgtattctgtggctccctcatgtgcctagcccccaaacactgccctcatgttacagggaaatgtggcaagtgaggatataaaggtgtaggagataaagaaatatggcaacattattgaagttaggaaccgtctggattttgtcttggtgcttccaagacctcagcatcacggagcagtgggttgtatgaagttcaaggctccctttttcatggaaaattacaagcacatttatttttaggtcccatgtccctatttgttctttcttcaactctttgtgtggcaatgttaacaaagaggaggaggagagagggcagcatgacaggacagacttgccccatctgttactccttctccaatatcaccagtgaaaaccaggattccccagacttttgccatcccggttcccatctgttgcgtttcttaccattgatgaaagccattgacaagaataaaagtgactgataaaataatagcatgggggaaagtaaaatctacaatatgcttctgggaatttgtcttaccagcgtggataaggttgtgcatcgcagcgttggttgtggaaacagtctgtgtgtccacttagactgtagtccagccacaaagggggacattctgcagctggaacagaaggaagagaaggcccacatggaaaaatttctgttctatagtgttcagagcaaaaagtaaggtacagaacaatatatatcttctttgcatttttgtgtaagagaaaagtaagaatatatatttgtgtttatttgtaaataattgagagatcctgcgtagacaccaaagagccaacacaatggcagtccatggtgggggcacggggagggctgggacagtgtgggaaccgg

SEQ ID NO: 125004 - DNA, 1118 bp, Homo sapiens
gccttctcatcgtgtgcctccacagtggaggctgaataggagtcagtgtgagaactgagaaatgtgaagatgggttagaaaaatctgcaggacatgcatcattccctgtcaggcccttgtgtggagttctctccccagacatttcaggggcctgagatcctgctgacagcctagaatttcagccaggacctctgtatggggtttcctggccaggatcttgcctgggggtgctgcttattttctgcagggacttgggtttctcatcctgttcgctagccggggtgaagcatgcctggggcctccacacggtaaacttttgctgccagagcaactcacaaccaggactgtagcctggttctgagggtgttggagctggcatccaggctctgcgagggtgtccacaggaaatgaactgtacagattgcttttaaatgataagaggcttgtggcaagactgaataattctcagcttgattcaggtactgaataggctgtattttaatctaagctaacgtttcttgaatgactcggtgtccgtgagaaccaagccatgtgctttatgtttctcgttgtttaatcttcaccatgaccctgcaaggtgaaaccgccactagccccattttatggccctgaacactggaccttacaaaggctaatgtggcccaaggtcatgtagcttatacgtggagctgggatttgaacccagaattctcttgagtttggagcccagcttttgaaccgtgtgctgtactgatcccagctcctgcctggcatctgaagcaggacagtcaaaccaacggcttcttacaggcagggcggaggtcatggccctgcaggctccttccagcatctgtgtccttgccctggattaatcaggtgaggcgggatgtgctggtggccactcttgacatgtcagggataagtgttgggttctgggtttgggtctctggctcccaaagagggaagaattttgtgcctggagatgcagggtcagaatgccccctttttgcatggtaagtggtgctcatgacagtgctgctcctcgtggcagggccatgccagtgtgcaggaggcacacagtaactttgaagtgtgggatttcgcctgggttcagggca

SEQ ID NO: 125005 - DNA, 1118 bp, Homo sapiens
attatatctcagtatagctgttttttaaaaagtcaaagacagagaaagcaaaaaaagcaaaaaaagaaatgttaacaataagtgaatccagatgaagggtagatgggtgttcattctaagattctttccatattctataggtctgagatttttcaaaattgagctgggtaaaaataatgctaagaaaatgtggtttgggaaaaccagttctgacctcaggtaacaaagatttcatttttttaagtaagtgaattttgtgattcagggattaggatataaacaaaatcactagacaactagtcagtaagtcagaaaacctagagttaagggacacccacctggttgggaagtatcagtccatcccctcttggcccgtacacaataatcccatcttgtattggggtccttgacaaacctgccaatatctttaaagagttcacaaaaagacatttggctggcttgataaacagtgtagtagaggagggcagccctccataaaaaagggtcttttctaaacagaacactgtgaatgcttgctagtccttcctctgtgggattatttggctttagctcatgttttttacgtccagtccaactgttccatggctgctggaggttgttaatacctcgaaaataatgtgtacctatggagaagaaaagttacatgaagaaaaagaaatgccattcttgttttaattcttcccccaaagttagattccatcaacaatcctaaaaccagccaggcgcggtggctcatgcctgtaatcccagcactttggaaggccgaggcatgcggatcacttgagttcaggagttggagaccagcctgggcaacatggtgaaacatgtctaccagaaatacaaaaaattagctgggtgtggtggtgtgcacctggggtcccagctactcaggaggctgaggtgaagaggatcacttaagcctgggaggcagaggttgcagtgagctgagatcctgccactgtgcccaagaatgggcgacagaccgagatcccatctcaaaaaaaaaaaaaaaaaaaaaaaaaaaaaattctaaagccaaattgatgtgtgcctacaaatcaaaacaaagtagaaaatgacctgatcctaacatctct

SEQ ID NO: 125006 - DNA, 1027 bp, Homo sapiens
atctgaatgatgcctggaatccaggaatctttgttccacttttgctctctctctctatgtgtctacatgtaaacctttcacaacttttctgtaagtctgaaataatggcaaaataaagtggtgcaaattgagtactgaggtggatgatgacctcactttggactaggcaagaaatcttgtaagatataatattcagctggatttgtatttagaaattcaaaggtgatgagcagggcattttggtagtgggagtaggatgagcatgccatagaggtggcaaatagcagggtttattcaggaatgaacagcaggtgattgggttctcatctctgagtgctttccttggcactgaacactaagcaaagtgggtggtaaggtcatttgcagagagtaaacgggtgggatgggaaatgtgatcgagactgtgatagggattcaaatggattctgattcaaattattcaaatggattctgagcaacattaatggtccagtggaataaatttgaaatggaattggctcaatttcttgtctttttctggcaatgttgagcaagccaggaaaacagaacagttagagattagcaagttaagtgcagcaagaaggacaagagaccaaggagaatggtattaaaatagtttctcttgagtctggctgggaaggagcaagtgaggcttaaaggaggatgggcagtgtttgggaagagacccaagaaaggacgatggcaggatctggaaatcttagactattcacagtcttgtttcctcatctactattttaagaagctggattaggtgatctataaattctctgactgctctaaggttttgttttgagacaaagtctcgctctgtagcccaggctggagtgcagtggcacggtctcggctcactgcaacctccacctcccaggttcaagcgagtctcctgccttagcctcccaagtagctgggattacaggtatgcttcactgcacccagctaattttttgtatttttagtagagatggggtttcaccatgttggccag

SEQ ID NO: 125007 - DNA, 2108 bp, Homo sapiens
acgcctggggcgatggatccgtttacggaggtgagtgagtttgcgggtgcagccagccatgacccaccgctctaggcccccacccaccttcctctgtcaacctctgggcgaacccccaccgggcggagggcgcgtgtgtgcgcgcgtgcgcagtgtgtgcgggccggggtcgccgcggctgcggcctgctgtggttggtgggttcctctgagattttgttgtttcggtcctacagataaaactcagggaggaaggctttgagtctgtcctaaaaggctgttgcgagaggtctttcagcccccgtttttaccatgtccctctgcagtcctggcgcagcaagagtgaggcgcaggcctgcggaacgggtcctgctggaagcagctggaatgccctgcagggcggggtccggggccggtgactcagtgcggctgccgccgggaaaggcagtaggatgtgtgatttgcggagttcacgcagcccgcaggggagatgctaatgaaatgacagcaaaacgttaaaataagcaggtgctagaaaccactgcattcgttcataaaaagccagtagttccttgagatcccattgttcagctaactaacgaagaagttcatacccgggactgaccattttaattgaaacaatgcaagtgtaccgagcaaaactatcagctcacgattttagagcaaagaaataaacttttcggtgtttctggggcatatcattacagtacttatttcatcttttgttcctttgagattgcatatgggttacatggttattgtgtcgatttctctagttttagcttttgtggagaatgtgcgttgtcacattcaggagtgttttgttgccagttgtccactctcttttattccaggacagttcctctttctttaggctgttgtgcaaatttcaaactgttagtttttgagtgttgcaaagtggacctaaaactgtttacactgattcaaaaacttaaatgctgtgaagagtggtaattctttcggggagatgtaattataattctataagttatgtatgagatattaattacagatttcagcaattagagtttacttatattcaagcatgacataatctatttttctgtttcaaattcttaatcatcttgggacaaatacatcaatttttttcaccttccttaaaggttctaatagaaaaatctagagcctatttttgtattagccttaaaatagggctggtcatgcaccaagtatctttcacttacactgaggtcgaaaagcgtgtatttattttatctaaactagaatacgattccttaaaacattagccctatgtgtcttcctaagtaacagacaggaacaaagcatttttaagttggctgaaaattgcacttcattttacttaaaaatgtcattctgaaggtagtacaaatctcaactgaaagaaactttacctgtttagatcgttttaggatgtgctcagaaatatgtatggtttatattatgaaaagttagatcacttgcagttggaaaaacagcttagacgtcttttccttaataggtaatgaatgaactacttgaattgattccaactcttgggtgcttaattatagcattcataacatttgcacagtgaaatgagctactggtacagttgtctatcaactgaaagtcagtataaaatgactctctcaaccagggtttcctctcagaaccatggtacacaggaaaattgagagactattttctcaattctcccaaggataattcaatgccaccctacaaacataggaaataagtctatcatattaacgccagcgtattagggcttaattattttggtaactccagttgagaaaggttacaatcatggtaaactctcttttcctcaaacaagactgttctgcattggtcttcctccctgtggtcgctgatactgttctggcactctttttttttttaagacggagtctcgcagtgtcgcccaggtgacaaaaccataaactcactactcataacgtcaagagtttgaagctctactcacaggtgatagtcatcccagtacaagaatactacaaagaaacccagagtgaagtgtaccaatccagaactttctttataaaaacc

SEQ ID NO: 125008 - DNA, 1054 bp, Homo sapiens
aaaagagtcaaatggaatttaatttttcagcctgcactaactactgtatctgagtatgcaaggcagtaataataatctgcatacctcctttagttgtgtgcatttgaaagaaaatgaattgttttacagggtcttgtgtttgagctttactaaaattgacttaaaaataggaacatcagttgatttggagtagaaaggagtattcatgactttatggaatggctaagatttcaatttaaaaccattttattatatgttaatatttagttaaataaaacataagattattttgtttttctttcctcttaggaagtgttttatgttttcaaaggactaatatgttatttatctcttgctgcttaccaccaccccagattttagtggctctattagttttgctgctgtaacaagttatcacaaatttagtggcctaaaataacatattcattattttacagttctttagagacagggtctcactctgaaatctgaaatggattttactgtgttaaaatcaacatgtcagtggaattgtgtttcttctggaggctgtaggggagaatctgtttcctaacttttcttgtttctaaaggccatctgtatttcttggcttgtcctgttcccccatcttcaaagccaaaaatcacattactctgacctctgcttccatggtcatattttccctgactctgatcttcctgcctctgtgttttccatcataaggacctttgtgattatgttgggcctgaccagataattcaggattatctccatctaaagattcttaatcacatcagtaaagtctcttttgctctgtaaggcaacatattcagaggtttagggtattaggacaaaaaatctttgagggaccattattttgcctaccatagtggcttaaaacaatactcttatttctcatgattcagtgggtcaacaatttgtattgtgctcagccgggctgttcttctgcttgtctctgcagtggtcatgcaggaatcttcagtgatctggcagattatctggagctggatggtctaaggtggccttattcata

SEQ ID NO: 125009 - DNA, 1025 bp, Homo sapiens
gggtagaggtggtatttggttacatgagtaagttcttcagtggtgatttgtgagattttggtgcacacatcacccgagcagtatacactgcaccatatttgtagtcttttatccctcgccccccttccgctcttccccccaagtccccagagtccattgcatccttcttatgcctttccatccccacagcttagctctaaatatcttttcattaaggtttttataatataaattgtgtctgcttgaaaagatctttcatatcagatttctaagttgctgaaagagaatggggttttacatacttctggttgtaactaaaatcatttaaaagaatagggaggggtgatgttttattaatttgttgagtatctaccctcaagtttttcatgtgagaaattacaaatttgaatgtcttttttcatcgtttttaatgtagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacaggtatgaattgtatagatggtatggcccatacatctgttccaataagattcagtttggtatgttgaacattttatcagttaactcatgaaaaataaatgcttttgttttatctatatgttgagtatcctttgcttgcatatggtttgtctaccagtagtataagttggttatgtttagactgaagtagatcacgatgtggttcttggactagttcatagaaacctgatcttataactgtattaccttaatatctgcaatgaaaaacacttgagaa

SEQ ID NO: 125010 - DNA, 1654 bp, Homo sapiens
gcattgaatcccagctgtactacataattagaagtttggctttggacaaggtgcttaatattgcagggctttatttttctatgtgtaaaataggaaaaaaaggttatttggagggctaaataagagtcataaagcacttagcatagtacctggctatgtataagtagttaatctattaactatgaagtacatgatactattttgttaaatttttattgacttaattaaaatgtaatttggtctaatatagttaaaaatttgataaaggtactagtgcaataatatgaataaaactttttttttaaataaagagtgatcatactgctaatacttcattacccatgagtatattatgcagactaacccacatattatgatttaaatcatagcattttttaagttggttttttttcccaaatctttcaaatttgtttgatctattagagagcaaaatcatttcattttcataaatcttacataaaggctatcaagtaaataggacttgaattgttttgttataggactatttttagatattgtgaatgttgtttaccctaagtgttttcatgtttcagaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggttacgtatttataaaaaatttagttattgctgattatattcaggatatctattctcagcattttaaatattcaattgtgaatggtacagcaatgatttgccagggccaatgcctgaatgttccaaatgagacctcagctttagttgattcaatgaatatttattaacgtagactagcctacttactggttaaaggacttaatatgttacattttaacagtttaaacatgctttttccaggatgatcatgctagattttttttctatattttttgattcagacaaagcatgtttaactggaaatcacattttaggggcataatggagaaacattcttgtagccaagtgtgcagagcagtgcttctcaatcttgagtatgaaggcacctctaatagcagagggaagtgaatgtgcatgcaaatgactccacttctaattttatttatttactaaattgataaatgatagaaatttttgaaaaaattgctgtttattgataaataatagatgtatatatttcgggagtacatttgataacttaatacatttatataattcgtaaagatcaaatcagtgtaacgaggatatccatcaccttaaatacttgtctttatgctagaaacatttgaattcttctcttgtagctattttgaagtatacaatagattattgtaaactatagtcaccctactgatctatcaaacactgggtcttttttcttctgccaaactgtatatttgtactcattaatcaacctctcttcatcccccagttatatttatctgtgtgtatattgtgtgtgagcatttacatataaaacaaaatttcttaccatcgtaaactgatactccaggaa

SEQ ID NO: 125011 - DNA, 2103 bp, Homo sapiens
cctttataggaaaatatatgctaatctttgatatagataagcctatttttttataatacaaccttagaatcctcttaatgggagtgatataggcccaatttgccctactttaaatttacttcatactatttcaatgagtgctgtggggttttttgttttgttttgtttgctgttttttgtttttgagacagggtctcactttgtcacccaggatggagtgcagtgagtggcatgatctcagcttactgcagcctcgacctcccagattcaagagatcctcctgcctcagcccaccaagtagctgggactataggcatgccactacaagtggttaattttagtattttttatagagatgggattcctccatgttgcccgggctggtctcgaactcctgagctcaagagatccacccgcctcggccacccagagtactagggttacaggtgtgagccactgcaccccgctgaatactattttaagacactgtaaagtcaaggtgtccttttgataaaatgaataattcctaattttccttctgaaggaaaaaaaggcaaaattcctttattttcacgttaggcttcctaaaagcagggtaaaataaattgactatagatatatgtaagttgttggaagttaccatggccagcacacttcgtgatgaaggtagatttattaatatacatacagtcaatttctaattatttaaattctggttgttcagtttgagagttttctaagccctactgccctctcctcattctaccttttcaaaatttttttttttttttaaataactaaattctatgagtaggttttagggcatgtacttaaatagaatagtaaactttttaaaattttgaagtatttttatagtctactttgtgaatgaatattcctgatagaatcaaagcattttgaagctgtaatgtagtttagaactttttccatagaaatcgtaataattttttattttgaatagcctccaaaaatgtgtgtgttttctgtaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggtatggtgtactgcatttaacattattcatcacatggtctctgcatagaacctagaaatcaaaatgggttctgatgccagtctttttgactgagataagtagcatcttggttttctgtatcactaatttcagacaagattgggcacattcagggtggtatggccgtagacagtatcactcatctcaaattagaaatattgtcctgaattccatgtgtattatgaactttttaaactgaaaactgtttaaactttttaaacagtttaaaactgcaaacaaggaaaattttagtagtgtttggatgttaaacatgctaccggctcttgtgtaaaatacagcttttgatgggtttaggaacgtcaaaaagaactagcatgtcttcgtggccgatttgacaagggcaatatatggagtgcagaaaaaggcggaaactcaaaaagcaaacaactagaaaccaaacaggtaatgtaaacaagaaatataaaaacgaacttggtccccaaatagttgggatctaatttgtagttctgtattggcaaataattctttacacatttttcttttccaattaactctgtcacttttcgtttataaatcccttaaatgtgtgtaccaactcttgcttttcttgtgatatttttctatttcagtggaactcttcaccatattcattgatgaccttaaaatcaaattttacaaaaattattttcatcattcatttgatttcagagtctacttaatattccacttagatggtggttctaaaatatttcgagagtctacttttctcaatgatgactgtatacctttccccagataccatgtctttagactatctgggatcctttcagtcaccacatacctcccacattgctctttattccggtcaaagttcattaatc

SEQ ID NO: 125012 - DNA, 1054 bp, Homo sapiens
ctcttaccctccgggtaactgataattaaatggaatcctgatgtgtaggagctgtcaccagatgttataggtgtgggttgagataagtgacataggggtgggtgtttttccctttgtgtggctttcactttgtttttttattgttattttattttattttattttattttattctaccaaatacccagacttcaaggagaggctttcactttgattggcttatctaaaactgagccctgatatgaattttcattctttcttgccacctcctctccaaaaaaatttttacatactgagaattaccaagaatgtgaactagcactgagggtttgtcgtgttctgaacaaggctgggcctattcacatacactatctctttggttctaaggaaacttatacagaataatatttaataataatcttgtttcatttaataacatagaaagataaaatatatagttttgagaaataaaatttacttttcattcgctttttgcaggaaactcactgtcagagcactcccctcaaaaaacaccaaggtgtttcaaaaactcagtcacttccagtaacagaaaaggtgaccgaaaaccagataccagccaaaaattctagtacagaacctaaaggtcagtgtttccagattgttcatggttagtatgtagaaactcaaatgatgtttgtgtgttgattttgtattctgtaactttgctggatttgtttgttctaacgttttttggggggaatctttagggttttctttcttttttcacttttctttgagatggattcttgccctgttgcccatgctggagtgcaatggtgtgatctcttggctcactgcaaccctcacctcccgggttcaaacgattttcctgcctcagcctcccgagtagctgggattacaggcgcctgccaccatgcccagctaatttttgtatttttagtagagatggggtttcaccatgttggccaagctgttctcaaactcctgacctcgtgatctgcttgccttggcctcccaaagtactgggattacaggggtcagccactgcgcc

SEQ ID NO: 125013 - DNA, 1039 bp, Homo sapiens
tctggctaggactttcaatgctgtgttgaatagaagtcattaaaacaggcatctttgtcttgttcctcatcttaaaggaaaagcttttaatccttcactgttgagtgtaatgttagctgagggcttttcatatatggcctttgttacgttgtgtaccttccttctattcctagtttttgagtaattttattggcactttgtttttaaagtaaaaaacaaattgcagagtagtggtatgtatggtatgatcacaaaacaaaacaaaatgatatgtaaatatgcacaccttgggggaaactggaaaaacaaacaataacctggtaatattgctgtcccatttctctctcggtgggggaaaagttaatgcatttatgcctagtgttccattattggaacgctaagcttatgggagttacttatgtcctcctgctcaaggttgtcaccaagaactgatttttcacaaaataaatttgcaacctccagcataaatgggttaagagaggacaggtgttcagggaggggtgtttctatacatttctgggtttggatattttaaaacgaatacatagttttataatcagaaaaaaaaaacacacacaagattccataattagaaaattataggttcttatatatattaatatggtctttcttaaacatttttaggtttcactgaatgcgaaatgacgaaatctagccctttgaaaataacattgtttttagaagaggacaaatccttaaaagtaacatcagacccaaaggttgagcagaaaattggttggtttttattctttatttattattaactttgcacatactataggaaataatatattgatagaagcacatattcaaattgagagtatctctgctttttaaattaaatcagaatacactgtagcttctaccaagatgtggtactgttaacagttactgctagctcacaggcacctgtgaaagtgtggttaagaccctcactgactttgacagggataggaaagttgctgccctcccacgctctgtactggtagaggggtgt

SEQ ID NO: 125014 - DNA, 1491 bp, Homo sapiens
gggttcaagtgattctcctgcctcagcctcctgagtagctgggattacaggcacctatcaccacgcctggctaattttttttgtatttttagtagagactgggctttgccatgttggccagacttgtcttgaactcctgacctcagttgatctgcccaccttggcctcccaaagtgctgggattaccaatattcatttcttagaaagtgttattgaagctgaagattttcttggtttcatttattagtagtattttcttatttttctttttaggaggtgcttttttttaaggcattttttcctatttagtaagaatatgaatattaaattttctttgttatgcctttaattcttaaatatctgagtcacagtgtccacctattgaaatatttttcagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagaggtaagaaaaggctaactaaacaggcccaggacataagtaaactaagtagtattcgtatctcccctttcttttgttgacagatggacatttggctcagtagccaagggaattttgcagacctgttgtctgttctcttaaaagaaaccttaaaactcttgagtggtttccttttgaccttagatgaaatccaaagagtaacatggcttaaaaggccaggcatttgggctcagcttttgactctgccatttgctgactgtttattggtcaggttatttaagctctctatgccaccatttcctcttatgttaaacgaggttattaataatacctatatagtggagttgatgtgaacattgttgtattagtatatcggtagttagctccaaacacatgtaactaacatttagttacagctaactgctgttattagctttcaccctcaattgaataactgcagctctggggattgattcaactagaattttttttttgaagtataagtttcagctgtctttgtagttttatttattcttttatgtgttaggaacttagtttgctttgtttttatgatgaatcaatcagcttactggatttttttcttaatattaatggagaattcattgattttcacagaataaaatgaattatcatttaggatcaatgttaatatctgatgcgttttcccacagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacaggtaagaacatttctggaaggcat

SEQ ID NO: 125015 - DNA, 1901 bp, Homo sapiens
atgcctggcttttaaaaaaaatattttaattataaaaaaaaatagagatggagtctcactatgttttctaggctgatctcacactcctgggctcaaatgattcttgtgccttggactcccaaagtgctgggattacgggtgtgagccaccatgcctggccctaaggaagcatattaaaaaaaaacagtgtaattgtaatttaaataaaatgaatcagatactttctaaatttctacgttgttggatgtaaccccaattttaactttaataagtatgaattggaagttttttcataaggaataatatttatagcttaattattgtaacatgctaaatgtttttggtgcatagtcgagaaacttgagcagtgaaactaacattttgactttcatctggaaattctagaaactatccaatcaagttagttagaattaaaatttaaagtgaaaatgatgatttaaaatgtgtatattttttctcctctcattggttttcctaggaactcaataacgaaataaatatgcaacagacagtgatctatcaagctagccaggctcttaactgctgtgttgatgaagaacatggaaaagggtccctagaagaagctgaagcagaaagacttcttctaattgcaagtaagtgtgatgcacctgaaagagttccaacaaatttctaaccagggaaaactcattttgatatttagaaatctttaagtttagagaaagggcttttcctagtcatctgttccagtggatctattttttgttcttgtttttataaggtttaagaactctatgtaaaacaaattgtagtttgcatgaaaggtagaagcaaccgaaaggcatttgaagaaatgcagttgtgcagattgaatgaatgaatggatgaatgaatgaatctctatatatacacatgtacacatacattctctctctctctctctctctctcccttccttcccttatcaataaatagctaaaacaacttctgtgaattttgctgtgtgcgtatatgtggtgatgatggggcattttggggtggacagatgataccacacatgaaaactagccgaaagttgatgtattaaattataaggacttggtaaatgagcaaccaaggttttccccaaccacctaccatgttttataaagatagtgttactgatttcgtcttcgctgttacgtacagtttccatatcagtacacttttttgaatttgctctcattagaaacagttacgattttaatatttggaatattgcgttgttttacatagctgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccaggtatggtggtgatttttctagattgtgtgttaaattatgaacctcacctagattgaattgtacagaatagaaacaagtaaatcatgcataacaatgcaaagtttgtatctttggcctttaggtccttttattgagatataataaaaataagaaaacttcagatatatatagggataccaatctacacaataatggacattgctcttactgaaagtttgaatataaagttttattaaatgttggatatggtttttaaagttccttttaaaattttatttgtgtggaacacaaatttttttgtgtgtgttctggaataccaaagaaataaaggaatactgaactgatttatacacaatttattttaaaaaatttctttttgaggggaaggagggctagacataggtgagaagcaaatttcaggcatagggaaagtaaatggaggttgtgaa

SEQ ID NO: 125016 - DNA, 1050 bp, Homo sapiens
ataactggcgttgtatcatgtcagaaatgcatctttctagttcactgggaactggaatgctgttaagccaggaaaggccttctttagaatgactttaggcctatctttttccaaaaggaattaggatggagctggtttcactcacttcctttaggctattggtctctttcttctctgtggtgcaagagagttactaagagacctgtacagagatagtttctgctgctgattttgtcaccctgcattataactagcactgaagtcttttccatgttttttatcgggaagttgctttttatgcatacatttttaggtctatatctttaaaaacacatccatcccaattattaaggagtgcttgtacctctttcattaggaaataagttgatttttccccccacatttaaagatgaaggaaaatgaggcagtttttttttctctgtggcagcttaattttcttctactgggatggggtgaggaattgttacttatacttaacaaaagtcattctgaactaaacttaatttcctcgttcttcacagtcatggccagtccaggaggtcttagtgctgtgcgaaccagcaacttcgcccttgttggatcttacacattatcattgtcttcagtaggaaatactaagtttgttctggacaaggtaatccaactttatttctaagggtgtggtgttttttttttaatcttagaaaaattagctcaatggaaatgccacaatgcttttaggtatttgaaatcttcgactgaaaacatatgttcttagaattgcacatttttgctaggtatgagtgtacctaaatgtttttttttttttttgtcttggaagtatgtctcccttttaatagttagaacttcagtggatgcttgcttattctaagtatcacttctgactaaagaagtattacttcctgcatttagatgttaagtttataattttaaaacataatatcttgcctatttccatttctttgtggttttttttgtttttttgtttttttgtttttgagacagggtctcactctgtcacctaggttg

SEQ ID NO: 125017 - DNA, 1556 bp, Homo sapiens
tcactcttggtgggtgtggatatctaattttctctgcaccattttttgaaaaggctgctcttccgctttaaatggtcttggcatccttggcaaaaatcagttggccataagatgtatggctttatgtctggtctctcaattccatttcttttgtccatatgtctgttcttatgccagcaccacactggtgtttttgattttgtttctttgagacaaggttttggtcttttgcccaggccagagtgcagtggcatgatcatagctcactgcaaccttaaacttttggactcaagtgatcctcctgcctcagccttccaagtagctggtactacagacatctgccaccacacctggctaattttttcatgtttaatagagacgaggtctcgctatgttacccaggctggtcatgagctcctgggttcgagtgatcctcactccttggccttccaaagttctgggattacaggcgtgaactaccatgtccagccagcccacactgctttgattaccaaagttttgcgttacgttttgaaattgggaaatatgattccttcaactttgttcttaattttcaagattgatttggttgtttggggtctcttgcaattacatatgaattcaaggactggcttttccatatctgcagtttattgttctttattgctgggtggtattgtgtggtgtgaatttacaggttggtttatcagtctcttattgagtatattctcctgttgatggagaatagataaacccaaatattgtcgtctgttttctttctcacattaacttgagacttagggcttttggttttgtcaagctttaccttaaatgaatttattcttcaaaagtatttgttggtaaggaaccaatggctttttggccatgtcttttatactccaactttagaaaatgctctgttttcaagttgtaatagtctctgttcatgatttatacatgatttatcaagaaaaatcacactttgaacctgttttgcaaataatttacctgttttctttgcaggtcccctttttatcttctttggaaggtcatatttatttaaaaataaaatgtcaagtgaattccagtgttgaagaaagaggttttctagtaagtaacatcacttagtctttaacttccttttttccattttgtgaaatacagacttgtttcccataggaatgaaatcctttgtgattaagtaataagttggttcagtaaagatttgttttatgtcctttatatgccaatcactgtgctgccattggaatgtaaaagaccacaaaaaataattcctctgctcatgagtttttagtttagaagagagaaatacaaacgaacagacaagcacaatataatactctaataggagaaaacagggtgcatcggtgtcaattggtgggacaccaggtcttgactgtgtgtggggtgggataaagggaactgctgagagaagtaatttctaaactgagtaagttaatctgagagaaagatgagaagtgctccagatagggggagaatgtacagtggcttgaagggcccttctttgtcactcc

SEQ ID NO: 125018 - DNA, 1208 bp, Homo sapiens
gatcataagttaactcttttctaatcctgttagaaaacttgatctcctgaataaagattaaatgccagtcttgcatattaagataggtttaacttaatatgttatcattaattttttaaaatatataaggtatggtaattttgtattattaattctccaacacttgaggcatttctgttgtttaaggagcatttgattagggacactatactttttaaaagtcttaaagtaggtagaggtatttaatttagggttgatatctgaatgtttttaaatgcttgtagatgatgttgaagtaaatttctgatatgaataatcagtgatttttattattaagataaaagacatgataaaaaaacatacaaataggttttgagatatgaaatatgtcaacatactacagttagtgtacagaatcagcatttcattgttaggacattttcctcaactttctaaagccagcatttcaactgacttttccagaccatatttgaagatgttagtggttttggtgcctggcatcgaagatggtgtgttctttctggaaactgtatatcttattggacttatccagatgatgagaaacgcaaggtaatttatatagtactgtttagtggtgaaagccctgattgactttcgtgtagtgttcatgcaaatgttccctctggcccccatcactcacccaaattaataaccctttttgtgtactcactaagccattaaaaatgttcttgttggccaggcgcagtggcttacgcctataatcccagcactttgggaggccaaggcgggcagatcacctgaggtcaggagttcgagaccagcctggccaacatggcgaaatcctgtctctgctaaaaatacaaaaattagctgggtgtggtggcaggtgcctgtaatcccagctactcaggaggctgaggcaggagaatctcttggatccaggagaccaaggttgcagtgagccgagatcacgccacggcactccagcctgagcgacagagcaagactccatctcaaaaaaaaaaaaaaaatgtttttgttgtaggtgtgtgtgtgtgtgtgtgataatcctttaaaatttttatatcctatccattccctatgatttgaccactcttaaaataccttaacatgtatatttttccttcttttctactggatgtttaattatattttttgttgacatttgaagttggaaatgtttt

SEQ ID NO: 125019 - DNA, 1035 bp, Homo sapiens
ttgtattttgtttctaaaatttaataataggattttgtgtaatatatcatgtttttaaagaagttaatatcattgcccaagtaacattatttattatccccaaactggaaaatagaaataagcagaattaaaaaggaaaatcatccataatagacatagctattgttcatattttggttagatatgttttcaaacttttaaaatgtataatatataataattattcatttatgaatctttttaaaaggaaaagcatgctttttataatctgattttttacttgataaaatattctaacatctttcagcatcagtaaagataagtctaatgctgtgttggatagctatgtgtgttacactgtagtcattacaattattaatattttaaaaatttgtgaaatgtttgagacatccaaaagggcgtaaaataatttcatcaacctctgtgttattattccagttgaagctccccatgtaattctctctcccgcagagataacttctaccctaaaattgtttattgttcccatgcacttatttaaatttttattatacagattgaatatcccttattcataatccttgggatttagaggcgtttcagatttgggattctttttttttttttttttttttttttttcagattttggaatatttgcattatacgtgccaattaattatctcctaatccaaaaattcaaaatctgagatgctccaatgagcatttcctttgagcatcatgttgactctcaaaaagttttggattttggagcatttcagatttcaagattttcagattttggatgtttaacctgtacatgtatataaacaatatatgttgctgcaattgcatgtttttaaacattatacagataataacatattgtatgtattattctgcaacttgccttttttgggtcagtatggtttgtgaaatttgtctggggtggtatgtgtagctttagattgtcccctcttctctgtatagtatacttttgtaagagcacattacaatttatccattctcctgttta

SEQ ID NO: 125020 - DNA, 1137 bp, Homo sapiens
atggctgccaacaatccagggcagttgtctgcccttatctttcatagatatataaagaaatatttacacatgaaatccaatgtctaggtttccttttatagaaaggggagaagtgggtaagttgtagataaaaggcacttgagtgtgtttctcattgttatagctggttttggtacctggggctcattatactgttgtttgtattttttatttgaagttcaccataataaagagctttataggatagttggcaagagctaccagttgatatttttgggttttatttttatgtctagctaggaacaataataaatgttaaatatgtttctctaagcccagtgtaactaaattttaacttttaaataatagctttttaatatttaatttgtaccaacttaaatgctgcttaatgcttactgacttaaatagtcttattttctactaatttctcttaatttgtttttaaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagtatgtattggcctataaatatttctatcaactaagcaattgattgcccactatgtacttaccactatgagaaatatcacagatggtccttgacgttgaaaagggcacagccttagtgagaaaacaaaacacacacaaagcagtaagtgaaccatctataataactaaattaatgtagttaaggaaagtataatactcaggttgtatcttagctaatgttttccagtatgctcacagtggaggcattttcatggcagttagataataatctttgggttaagtttaaagatttcatgcgtagttgaggagtcaagcattattcaaagagactttacacatcccttccttccattcccagaataccctcgtgtaatcagatgactcacagaaacaatctcattctattctgcaaatttctggatggagattaacagaataaaacttttgggagtgccccttttttaattaaccctgatctcaagtgtaagatacgaag

SEQ ID NO: 125021 - DNA, 1195 bp, Homo sapiens
tagcaagagtacatgggggtatggaatggagggagaagaattctgacctctttggttgtttgttcctgtaggaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaa

SEQ ID NO: 125022 - DNA, 1102 bp, Homo sapiens
cctctgtaacttgcactaaaaaataagggtgtctactaattagggtcaaataagatatccactggacagcccataatccagtgccacagagacatgaggtactgcctccccatcccatgggccaaccaagtatttcgtatggctttcagttcaccaactgcagggaactacgtggtcagagcttcagatactcagaatgtcctgccaggccctcagtgtgggataattcggtcagacctgagcgtttcataaacctagaaaaggggattaggtcaaccgccacctcgaatgttccctgtgccccatgcagggagcatttcataccagggccaggagaaagtactgctcttaaagggctttatccaaggcatcctggttcacattgagctgtaggatacttgcatttctttttcctgagtccagatgaggccacttcccccagccccatccaggcccatgcccacagctctatatggcagtgagttcctcagggctcctcctcaactctgggtctgaatttctagaggctcagaaaggaggaaagcacaggcattcttcaagagcaatgctgcatgaaaaatcaggggaacaccctggaaatagtgactttctgcaagggaggcagggaagcccccaggtgcctctaaatgctgctattgccgagtggatgcaatctaccagacctctctgttttccaggccagctaaataaagacatgacctatgcgcagttgtactccttcctgaactgcctccaggtgagcactcactggcttgcttcaaggcccgcttacctaccctgatcctctgtaatcaaaagtgttttcccgctctcaggtcagcccctgccacggctggatgtcttccaacaagacgttgcggactctcacttcagaggtatgactgtcacaggccttttgataccatctttgatcattctttccctgtgtttgctgcagagttttcactggggatgggatcctggcaggcagatggtctccaagctggtgaataacaaaatcaaaccttccaggtgcttgaggagccgagagaacctggtgcaccctgtctccctctgtcttgctctgggtctgtcctctgct

SEQ ID NO: 125023 - DNA, 1044 bp, Homo sapiens
tcctcaccaactccactccattatagcagcctgctgttcagctgaatttctctatcttagaagcacggccgggcacaggggctcacacctataatcccagcactttgggaggccgaggtgggcagatcacctgaggtcaggagttggagaccagcctggccaacatggtgaaaccccgtctctactaaaaatacaacaattagctgggcatggtggcgtgtgcctgtaatctcagctacatgagaggctgaggcagcagaatcacttgaacccaggagacagaggttgccatgagctgagatcgtgccactgcactccagcctgagcgacggagcaagactctatctcaaaaaaaagcaagtcctagacacgtgtgaaatcaacagtaccaatctgtcacgctgaaagcctcttttgaaaatatctgctccattaatgatcaactctgatgtaacaacaaatgggtgtgtcctgatcagttatatcacaagaaatgtgctactattcactgagaacccaagattgggaattgtgattttttttaataaaataaggcagaagcacagttaccccataagaacatcgatctcactcatattctgatctactttacttcctcatgtggaagagacagcttagacgcacagacctacagcatttgcaaagaaactgcggataactcatgggcaatcctatctatgcccatggcccatagcaagaaggtgattttgctaaactgctggtattggtagtaacttcaaaatggtgaattccttagttcctatataacatttggggaggtttctcaaaatctgtgtacacccctaagaatatgatgcatgtatgaatgccatctgtcctgtgattgtggccaaaaaaaaaatggtgagacaggatttagagcaactccccagtagcaatagccacccactcactattttaggaaacaggaaagtaaggccaaacgaggttcacgatttgcccgaggcaacagggttgattaatggcagagctggactccaccccaactgtgctagaagtggg

SEQ ID NO: 125024 - DNA, 1026 bp, Homo sapiens
ataaatattctatacagaataaatgctctcctcttctaagaacaatatagattttttttactaataaaataattgctgccattaactgagctcttaccaagtgctaagaacactttatgtttatttctgttaatcctttcaacaacagacattgtaaggcaagtattattaaatttcttcagtactaatactattgattgtaatagctctagggagtgttgagggagggaaaaggaaggaaaaattacaatgttcccattgattgcagcattcaactcaataccaaatgcgttaaaatatacttctcagaattgggcattaaaataatattcacaccgtagcagctggggaaatggaggcatggagaaaccaagactctcttcctcagccacacagatagtaagttacagaggagacacttctacccacgttgtctcactccactcagataccaacaaagataatacagtcattgggctatgatcccagatgatctgcagaaagagatcggcctcatccctctgcaagttgaacactatcaatagttaatggacagttacagtcaaatctggccatgtgactcatcacagatacaaagtgaacatcaggtgtgtggctgcactttctttttcctttagtgacatactgaaacagccccccaacactgtcaaataccctctgtcaatgaagattataaaaaacaaagcacaaaaaaaaaatcatctgtgaggaatatcatgcagccctagaaaatgatggctaaaagtcaaatatatttttatttggaaagacaaaacactgccgaaagaaaaatcaggatataaaattcaatcatacagtttagtttctaccacatttttcaaagaaagggaaaaaaaaggtatacgtaggaaagattggtagaaaatatagaaaatcattatgtttgataaattacgagtgatcgctttcatttttttccgcttttctgtttcctgatgattttatttgtatacagaaataacctttaaaaaactcgacagaaac

SEQ ID NO: 125025 - DNA, 1039 bp, Homo sapiens
tccttgggcaagacggaccatctgtagacaccatggatcctggtggagggactctccctgccatatattgacaaagcccttcacctgcaatgacttccccttgtccctatttatttttaatttttcatttttaattactcaaaatatgaatatattttcattgtacaaaaaaattaatgtgtataaagtaaaaagctgaagtcctcactttttgtccccagttttactccctttcttagaagaaagccctgtgatcagtttagtgtgattccatccaggccctttctgtgtattttcatttgtacatgaagaaatgaacactttgttgggattttcccataaaggctatcatattgtgtttaacctactgtaaatcagtgcttcaccttagccatacttcttggagctcttttccttcttgtccaatactgcatagtgtttcatagcatagttatttttttctcctacaggtggacatccaacttatatccagagtatcattattcttcgtaatgctgcaatgagcattttgtactgactctttggaatatgtgtgaggatttcttaagaaaaaattattggacccaaatgtttacatttttaattttaataaggcctccaaatgggctataccaatttatattcccacaattagtatatgagaatatttgttttcccacacccttgccaatactggatattgttcatcttcttaattttttccactataacaacaacattgtattgttgttctcacttgtaacctcctgactactagtgagtttgagcatcttttcacaggcatcgcccgttgtctttgtcctatctagtcgccctctgcccatgctgcagcacctacccctcagggatcatcccccagcctctctgtcttcagctacatttcttttttatacccctccagacagccccttcatactgaccccccatctaactggatgattattttctgagatcctatcatgtccttcaataccaatgtcacctcacttataatacctgtttactacttgtctcatgc

SEQ ID NO: 125026 - DNA, 1023 bp, Homo sapiens
tcaacaagggaaggtgctcatcataagaggggccctcccagagcctctcactgggttaagggttggtcatttaatttgctgctgtttgtctgaggtgtgaatacttgttctttattagagggaatatccaatctgatacatggtagttgctctaaagtgtttgtagaagggagagagggaggagaggagggaggaaggctgcctcacagagttgtgtaattgaattgaacaatttgtgcaagtttttcctgtctcagtgcctggcacataaggggaaccccgcattagttctcttccccactctcgcttaatgcaagttatctgggaaacagcacatccaagcatcatgagtaggttagacatttatttgtaggacagattcatgcagcagaggctacagaaatgggagtctggcaggaaagtgtgtgtgaaagccaaggaaggctctgaaagttgcataatgtggtgctcccacaagaaaggcactaaggtaatgggagcggtggggacctgagcagatgggaggcagtgtggtggcacggtgggactgagaggcagaaagcaggaggaaccctgcttaccttctgcaagcgccactgcaggacagacggaggaggagccaactagcggaactgggagacccatggttccaacgctaagcaggtagcccttgtctttgattcccgggccttgaaactctccagcgttattaaaaataccaacccaagagctattttctttttttggtaaagtaacaatcccccatctgctttgagactttaattctggggaatggataaaacaatgcttatttaactggtgatgacattttttatctttttccaacagcagttacttagattcctccaagtgactttgtactgtttgaaaataatccattcaggtctaatgcaggtacatgtaatagaaaagggaatatactgtgtagattgtccacagcagtgcaggatggagagagcccaaatgtaaacagtgaaggaaaggcactgaggatactccctg

SEQ ID NO: 125027 - DNA, 1045 bp, Homo sapiens
cgtgaaccttgaagagcatggttcctccttccatcagcctcattgcagctccgcttggctagacaagctggccctatgccatggtcaatgtgcagccatttgcaactgcaaaatgaaatgtgccgattttccttaaggtgctgttttctctcatctcttgtaggaggtgcttgaactcgctttctccatcttgtatgactcaaactgccaactgaacttcatcgctcctgacaagcatgaggtaagggtctcgggggtgataatttatgagataatgttatcttttctcaagaaaaatatagaaagaaattttacttaagaaaaatagacctgcctgaaaaaatgatgaaccaaggggcatcttgctgacttggaggagaatagaaacctcttgacaaactgcccgttgcaacagattcaacttcttagtagcttgattgatagttcatggtaaagaaaaaggatgtaaaaggcctcaaatgcagcaaaggtatacttgttaatccagagaaagaagcggccctggttacagctttggttttcattgaatttttcgtttttggtctggattttcccaagataaactggtctctcttctttaaaacatctgaggaagtaggttttctaccaaatttctttaagctattttaagaggtttagggctgtctctgctgttgggattttattttcgagatgcttttattcctttctgacatcttgttatatgtataatttgtttctcttcttgtagcacgctgtcagctatatttaaaatatttagcataaatctaggaaaatgcatttgtaagataaagtagcagttatggctgatttaactttcttttataaactggaacccaacatcatgcttgaaacttttatttttagatgataccattcaaatttttgttttgcgtgtggttgcataaacagctttagaaaggaagagaacattttaatagaatctgacttttgttccccatttcccctaggacatttagctcatttagaagttattcagtatctagttttcactggtttgaag

SEQ ID NO: 125028 - DNA, 1144 bp, Homo sapiens
aaaaaatattagcatctagattataaatttatgagttgagctccctagggagcatgaccatctgtgtttaatacaaaatcatccttccgagtgcagaaaggaaggctttttggtatttggtaaatggatttgaaatctggtgactggctctgtgcttaaaaatagggattcaaagcagactgtgctgaaattggtttcctatcaccccatcaaaacattccatttagatttacacagattaataagaacatgacatttttaatcccttcgagaaagacgcacttctacatgagatctcagactgggatggacaaccgcctgcctggtgccaccacaggttaaagagcagacactcccagtgcaggagccagcaccatactccctctaaacttgtctgacaatgagtaggacacagatgagtgaatttcagtagttaactttataagggaaaatatgaaagaacttacagctccacagaactggaaagtgaaggaacaaatagagagtgctcgactgtgccacgtttggctagcaggtccccgagttgatacttgctgatccttctgcctgtctcatgtgcagctctgctactggaatagtcacatgcagacatttacagatctgggtttctgggaattctaaccacattaggactgggaggtaatatatctcaaaagacacaataagctgggttgaagtccctgttcctactcactagctgggtagcctcgggcaatctgctcaatgtctttgtgctcctctttcttcgtctttcaaatggggataatgttagttcctctatcaaatagccataaggggtaagtaaaattatacatctatagcactttgatgcttggcagattatcaaacattcattaatgatgtttgctattaattttagctcgtagcgcctcagaatatagattttttttttttttttgagacagtctcgctctgtcacccaggctggagtgcaatggcatgatctcggctcagtgcaacctctgcctcctgggttcaagcagttctcctgcgtcagcctccactgggattacaggcacccgccaccatgcccgggtaatttttttgtatttttagcagagatgggatttcaccatgttggccaggctggtctcgaactcct

SEQ ID NO: 125029 - DNA, 1046 bp, Homo sapiens
tcaaagccccagcaactttccaaaggtagaaaaacgtgcatgtgcatgttcacaaaatatggcacaatttcagtttgtttgtagaactttcaggtaataatccttgctttaaatgggacatggagttttaaaactccaaacaaatctctgaactaccaagtcctatattgagagactgtcaaagatcctaccccactgctgtatgattggaggattctagctaggaccacatgctttgttatcagcacaagtcagtagatcagcaaacaactgcagtacccagaaactatagcatagggactcattttaactcttgtatacatcactcaaaaccttttcctcatgaccttctggtttgcctgtttcacaaactcctctccaaactgtcctccaaggtggggctagtagaacacatgttcaggctttgttattatttgttgactcgtatgtggcgtttcttgtcccaattcattacataaggcaaagattctactgtaaggacagtaagaatgttgaacacacacttgatcttccactgtatcctcggcttcagttggtcaaactctgtgtgcagaactcaactcacttttgctatcacagaaatataaacattctgcaattttcacctccaaattttgcctctttttacaagctctatgtaatttcctgtgaaacaaacttattaaatacattctattcccccatctaaccttgttgacattcctctcctctaatacaatagcctttcagatcaacagggtccccaaacagatacagagatgtattaaagttttctgttatttagtatttgctgggtacttgccacatactaggtttcccttgaggaacccagtctaatgaatgtggccaatgtgaatttataaattacacacagtgtaattaacatagcagcagacccagaatttcatgttgtgcatgctccaccgttccttgtctgatggggtgagtcgttcacttagagcagtacccctcccgagcagtgtgctaataagtgctttggagatggatcctcagataaatcttga

SEQ ID NO: 125030 - DNA, 1047 bp, Homo sapiens
agtcagttcagttgcattttatataggcaatgagctcatgactcctcagtgactggatgtgtttcccaactctctttgatttgcgttgaccagtgctcctcacagtaggggtgctacctaatgaccaacataatctctcaacataatttagggccttgtggagatgcactatttcattaggccacttggatctcatggagcagcagactattcattttctcaattgctcccgaagggatatgcagagctgatgaacctctttacttatactttgggagtaactcatggaccggacaagctctggcttgtttccaggggactcacttgggagtaatggttttcaagtgcatttgaaagccagtacaatagatttgaccatcatagacttgaatatataatatttcagtatacatcgccagctattttcacattgtggtgttacagtgagtctaagacatactctctataaaagtcatcagctgcttgacccattcattgtttattttttcaacaagtattatatgagtgctgaccattctgggctgggccacactaaacactgagctggaagaccataaagcatgcttaataaaggtttggagggtggcatgttgccccattaagaaatatttatgtgatcattttaatctcagcttagagaaattttcaatctgatgccttgatgtgtatttacctgtgtcttgatgtgcattccatcatatctaatgccttgatgtgtatttaccaatgctttggtgtgcactccatcagaaaactcagatttgagaggcaggagacttaacgggggagtgaccctagggaactaagaggaggtggcagcacttgcactttcatgtggagcttgaccccacttctatgtggatgaaagagtcagtgcagtgctggtggtgcggccagcccctggacatcaggaagtaagcctggcaggaatccataccccaatctgtagctgcctagaccaagcttaccccattagaggcagtactagagagtatggggctttggttctagcagagtctgctactt

SEQ ID NO: 125031 - DNA, 1052 bp, Homo sapiens
ccaggggcattccagcatcttgactgtgagcttggagtgtcagcctgggcagcagtcagtatattttagaaaaaggatggaggatgtttcataaactggcaagtctgttatggtggccgtcttttaagaggactcctactgtactcctggatgcgaccataagcagacattatttgcagcttctagaatagtgtttctcagcctgagttctgtggcacctggcagttccatgagtggcctcaggggccactagagagtgttagcagcaagtctgaatccctccagcttccttcagctgtaggagctccacttttgttttatacctctcactgttgcatttaattttattcaaataaaaagactgagcaaaccattattatttttaaacaacgggtattgtggtgcttttagggaggaaatcttagactattagcagtagcatacactattgtcaatagaggacatctgataacagtctgaaatcctttaaagagacaagggattttaaatgtctggtttacacttgattttcttccattacatgtttctgaataagcactgtgttcattgcttagggctgctgtaacaaagtactaccaatgaggagccttcagacaacaggaaattatggtctcatagttttggaggctatgagaaagttatggtctcctagttttggagcatggctcacagggccttgctctgtctgaaatctgcaggggaatctctccttgcctttcacaggtttctgttgaattgctggccatccttggcatttcctcgcttgcagctgcatcacttcagtctctgcctttgttgtcacgtggcgttctccctgtgtgactgtcttcatattgccatcttcttataaggacgccagttatactggactaggggccaactctgctccagtatgactgcatcgtaactaattacatctgcaatggcactgtttccaaatagtgtcacattctgaggtactggtgtgaggacttcagcatatcttttggggggagcaaaattaaaaccataaccggtgctaaagatttgtt

SEQ ID NO: 125032 - DNA, 1041 bp, Homo sapiens
tgttatgagatctttgaagagtgagtgagcaggccaggcatggtggctcacgcttgtaatgccagcagtttgggaggccaaggcgggtggatcacctgaggtcaggagttcaagaccagcctgaccaacatggtgaaaccccttctctactaaaaatacaaaaattagctgggcgtagtggcaggcacctataatcccagctactcgggaagctgaggcaggagaatcgcttgaacctgggagacagaggttgcagtgagccaagatcgtaccattgcactccagcctgagtgacagagcgagactccatttcaaaaacaaacaaacaaaaagagtgagtgagcagtaccttctatagggagcatatcctagaggctctgccgtatggtgggaaaatgttcaaatcccttttgcgtcttgatgtatataggaaggtggttaagagcatggatttaggaacagtgagaactgggtttgtatcctagccctcagtttccttcttcataggaaggagatagttgtagggttatagtgaagaaaaaaatgagataatctaaaatggttcaaatagcacctggcacacagtcaagaggtcaataaatggtagagactgttgtggtatggaggaagttactgctctgtggaggggtagtagctgtgtgattttatacagttgatttaatttttctgaacctcagtttcctaatctgtaaaagagagatgaaatgatgtgctctgtagaacctttgtaaggataaaaggacaatgtatgccaagtgcctggtgcatagatgacattctaactcaatgtgaaatcttctccttactccggactttggttgaaggagtctggtgtcttttgcacatgatgatgtcaacttgggtccctcacattgccttagcgtccttcacccaacccaccagtgcaggacatagtggtcctccccaccccgcccattgtctacccctctaaatgattttaagaaccaagtgtttgtcctcttaagtacttataaacttctctaagataaatattttata

SEQ ID NO: 125033 - DNA, 1052 bp, Homo sapiens
agcagacacgccctctcggccttcctctcagacactccgtaacatggtgggtctgaaatcccactgtaaacagcttcatggagtgcatcctcagcttgtcttcatgggccagtcctcagttcagcccagacccctgagccctcatggagatgaaggagccattgcttcgatctccataagggctctgtccctctagcgcaatgtcttgtgtgcagtgaacatttgagaaatacctaaatgactcggtctgctggaagagcagtattcctgtcagaaaaatattgagtcagtccccagccttgattaaagatgtataattgttaccttcaccttaggaaggacaaaagagataaattgcctggcgccatgaaacacagacagcccaaggggttgaaccaaagacagaagcagaagataggagtggccaggggcccaggagaaaataggagaaacctgtggcttggtggtgagtgaccctttgcccagtcacccactgtgaagagtgaactgcaggaggaaatgggaaggaaaacagatcttttgactctgctcatctcctgcagagaaggtgggctggttacataaaaagctactgtgggctgctcagttcctgagtcttgctcacagggctgaaggaaacattccctctgtctctcacagatgttaataatgagcatgccagtcaatccacccagtcaggagtcgctcatctccagctgtcccgggcaccttgttgatggtgggtcttgcatagtacattgtttcttgttttctgtgtctgtttaggatatacagggagctgtatcttctagatttaaatgctgaaaaaaagtggtgagtgagaaggggagaatggaaatgagatgtataggagcatgggggcgaacacagcacgagggaactccaaccgaaagagccataacctaaatctgagaagctaattttgcagaaccagcttagccacgggactttggggatttgctttggaaagatgtttgcattgtctgtgtcattggcatgaggccacacagtagttctcaaatgggaggagg

SEQ ID NO: 125034 - DNA, 1018 bp, Homo sapiens
tctccagtgggtcacctaagaaatgctttgggaataacaaagaggtctgtctcctccaggagatgatactgctctcttcctcctctgctctctgtgtatttttttttccttcccagctattcacacaccagtagaatttctcttatgtaagtggacctctcttgagactctgtgatggaaaagaatgtattcagttttttcccccttttttgaaaaagcatcattacaattcccgcttcccatccattcattttcataactgagtctagagtgatttcttttttctttgaactttacttgaatgtatcccgtccctttcataagagccacttttacctgggagcctcagaaggttagagtgatgatatggaggtgctgccttattaatcaaacgtttgctctgtgctgggcattaatcacttaaagctgcacagctggataagattcattagtgtcttctttcactgtgctcgtctccccgccccgcttgctcttggaggcatttactaaaatgccaccagtgcttccatcaccagctccatctctctcccacctcccgtggccacgtgctgtgtttggcccctgggtacagagaaagatcactaagaggttaccaaacagaacattaaagggcctctgatggcttctttgactgattcctttcaaatctgcctggatcctctggaagcctcttctcaggatgcatgttccacactgagcccagtggctgccctcaggagtagatgcaggcctcagagatgctgaacacctccctggcatgggtttgcgtgggatgcacctgttcatcagtcatgccccctccgtctggggacatcctgctggtgcccagaccatcctccctgcttcctgcttccttgccagatccttctctaatccacttcctgacttccacatagaggtctttgacttcagagtcccttgctttggcctttaaaccccccttcatttaatcattcttcagtaaacatctattgagtgcctgctgtatgccaggctc

SEQ ID NO: 125035 - DNA, 1043 bp, Homo sapiens
gaattttagatttcctttgttgtgcttttcttcccacccccaccccacccccgttaattcccttagatgcataactcaagccagagcttggaaggagctttcacctccttctgtttactcaacacctaccacatccaattagtcaccaaactctacattcttcctcctgaaaaatgccctgactctcatgcttaccttcttcccacatcattcatctttccctggtatttttctgtagtgacccagggtcactacaggaacttcttcagtgctctccgcttcttgggtttggctcccacgctaacccatcttccatacttcattttcatgtcaatctcatgatgcattcccctgcctcaaagtttttaatcggtccaaattgttttctagatacacttcaaactcctcagctggacatactggcctttgtttctggatcaagtcacctaggctgaggcctgagaatcagtattctttaaacttcccctgtgatttcagttcaagcagcttggctcttcaggggcccccaaaatgggcactgtggaaatactggtctgcttggaaccaacactaggtcaccaggccagttagagctggaaacttccctaagctacagccaaaaattttctagtacagtgtggttattttaggaataatttaaagagcatttcaccaaagagcagcatttttgcaagtatagattaaaagatcatttccatttaggaagcctaatttaattaagtcacacaatttttgaggtatgaaggcttttcttgctgagtcaggattttttgcttctctgctaatgcaaagcaggtagttgaaactgaagatttgctctgggacaatactatttacatgcctggccacattaaaggtcagggtagaaagtactgttctgtgggacagaggggcaagagggtattttgtttcaatcttattagagcactatgttaaactgtttttttcaagtagaatgtttaaattttaggttctttatgaaaaaatgcttaaaagctatttaatgatttgtgtttcttata

SEQ ID NO: 125036 - DNA, 1040 bp, Homo sapiens
tccattgtggtgtgacttctgcaataatgaatggctgaaagtaggcaagataatgtaagacttgaatggggttgcattctgaaaggaaggcagccagaggtcctcagaattaaatggaggacctgcagtaaaaatatggctctattacaccaagcattttcctcttttcctttccattgcctgtctgagatgatttggcagagtttaaaaataaatgaagtatattcatttttccttcagagtttttctttgaaggcatttggtaaggggacaaaatgaaatatgaacacaggcaggatgggggatcaagacatcaaaatgttagcattatatccaacatatatatccttatgtgaggaggtatgcttgcttccaattaagatgacatcatacaggcggatgtgatgcttccaagcagtgttaatgatctgctaggtaatgcagaggaaatgatgtgtttggaatgggtttttttttcccatttgtacctttccacttctttatggactgcaacatgtaatgattgggattaggttttttatagaaacttgatttcaattttcagtactgattagagacaggattcttttgcaggcatatcagttatgttgatcattgcttttcacattttattgtagctgccaaatccttattataaacagagtagaaccctacatataaaacccacaaaagggcaactctgagggaaaccaggttgagcatctcggcaattccccttactgagccattttctccagtgcctccctctcttctcccatagctgagtccgaaaacaatcttctgggagaaaggataaggtttcttctgtataacctaggggaaaagtgcctttaattattcattcattctctgctggaacaaatatttattcggtgcctatgataagccaggccctccctcttctagacactgggctgcagtagtgaggaggaaagacaaggggactgtcctcagggaggcagcgggggaggcagccaggccaccccagccatgatgccatgaatacattaagaatgggg

SEQ ID NO: 125037 - DNA, 1127 bp, Homo sapiens
tagaaaataaaagaaataatagaatcaataaatgaatctaagaactatttctgttaaggcaattatttaatagaaataattgacaattgacattgacaatctatcaaataaaatgtagagaaaatgtaagaattaacaaaatttaattgaaaatgacatagagacatagagctgattaaaatattattaatgaatttaatgggtggcaatatgccagtgtgctttacaaagctcaattagtacacccagacacgcatgcctgcacaaacaaaataactatgggctatctgtgaataatatatttgggataaaatatatacattgctcataaagcaaagtgtcatactttgccagttgaagtatagattagtacagtctttctgaaaatggcaatatatattaagaacttaaaattttctgtgatatttatccttctattccaagtcaaagactttatcctaagaaaatcagaagtgcagaataaatattctttgatattttaagagagactttaggaagactcatgtcattggagtgagctgatgatattaatggttgtggggagaaataaaaccaatagaatgatttcatctagaaaaaaaagcatggaattataaacttaaaaataattctggaagactctgcaccacaatgttaacactcattattgcagtgtaaggattacaagtgatttttaacttcttccttttatttttatatttctttctaatattactcaattggaaggtaatatttctataattagataataaacttactaaaacaaaaatttaatataaacataatggaagggttataataacaggcaaagcacatacaaaaatcatgcctgcataatatattgagactgaggatgccaccaaatcctgatgttccctggttagtttgtttactttccatttccctgaaaggggcatgaatgagaggtggagggagaagatattagctaggttgcattctctttccaaagcctgaattcttttttatttcgtgtttccatcactgggtcttttatcattaatctctaagatgtcagctgttcatcaccaggtgcctgaatccctaccagaaactcctattggtgttacctatccagggacacggat

SEQ ID NO: 125038 - DNA, 1073 bp, Homo sapiens
ttctgaactatctatccgtctgtcttctggcgcccatgttccattgaaaataacggtctttccaggtgtatccagatcgagcttcagaatccttcttaacacagcactaagtcaaccgctagtgagatatcagaattgtcttacagctgaaactgatttttcatccctctcttatgtccttgcctcagctcagtgccttgtgcaagactttgaaaagaagcatacagggaattatcatcagtatgcagggttttggtgataaggcagacagctctttactcatcctcttgctcagctgttccgtggaggtgttgccatctgacaaggagggctgcagccttgcgctttgggagctaacttctcttttcctttgagctgtaagtgatgagagacctgtcaaggagagctgttcactggcatcattcccagacctggaagtataatgaaataaagtttctttccaacttggttggaattcttgcagctgaatatttaagatagcatctggggcagttctgacgtccacttgcctggttggaaagaaacacccatgagctaatggaactcaggccttcacactggtagcccaagtcagggctgctctgggcaactcagttctaactagagtcatctaggccacaggtcccagcaggtgagatggagccccctccttgcctaatgagccagcaatttgaagtccgcatttcagaaactttgtcatatacaaagagggatatcaaagcaggagctggtttgaaaaccaccaacattggcactgtccctagacctagactacttaatgctaaaggttccagggcactctttctagtaccatgagggtagtagcagagccacaccttttagctttagagattgatgggggacaagggatgacagccgcgtcctagattccctgagccagcgtcaaatatctgggcaaagtaggcgtaagaagctttgcaaagaccaccttatgagccatgcttctgtcccctctaaaattttctgagaactgggtagagggactccttaatctctgtgaaccttagcttcctcatctgtagaaagggaag

SEQ ID NO: 125039 - DNA, 1064 bp, Homo sapiens
agattgcaatgctaagtggaaaggaatctgtaggggtcatggtaacaggtttttaaacatgggttcttggctatgcttgcctagtattatgcactttctagtattatacgaggtatgtaaatgtgtagaagacattttaacaagactacaaaaaatgtactacagggacaatatagcagatctcattttacattgatgctgtccaatggaaatatgatgcaagttaagtatgtgattttaatttttctagtagttcacctgaaaaaagtaaaaagaaacaggccagttaattttaatgatatgtattattttacctgctatgtctaagttattatttcaacatgtatctacaaaactattaacaaaatatttacattgaatttttcatgttaagtctttgaaatatgacatgtgttttacatttacaacacaactcaatttggatactggattttcacaggaaatctgtatttagatctcataaaattcatagttaaaaaagtagattcatgtgcacaagttgttccaaacatacatcaaagttttccaataaataactgaattgagtattggtttttaaatttaaatgagctaaaattaaataaaatttacaattcagctgcacagtcacactcaccacactcactcaccaaggcttccctagccaccgtgtttagtggctactctactggatggtgtggcactaggatctcagaacattccttgcacactaggccagtaacttctctcactccatcatcataccacagcacctttatctcttttacctccacaaggtacctggaccacctgctctggtaacagagaaacagaatgttagtattcacaaacatgttaacttttactttcaccgttgctcatggtgaactcaagatggacagctaaatcttagtttctccattacactgtttggcaagggggaattaaaacagtatgctgtttcctcttgcagaaagtcggcactcatccatctgtggcatttctttcttcatccttacttatcttggccctgctatttactgtgctctctggcccctctctca

SEQ ID NO: 125040 - DNA, 1321 bp, Homo sapiens
gcatgcttcaaaatgactctattttgcatcctttcaaacccctgaaaaaccagagagggtttgcaaagttatattcaaggattggctctctgccaggaaagggatgctctgagctattgctctgctccctggggtttaattttctgacactggtgatgaaattttcaatttcgttgggtagaaacaggaagaacaagaaagcagtactataaacaggcaatggaggggcagcgtggggaacgagaaactctttgcctgtagggacccttctagctgcaaacttaaaaatgtatgtggcaagatgcaacccaagcaccgagcaggattccagacgagttataatcattctgaacggggagaggaaaggtaatgccattggcttgggttgcagagagtgggggctgaagttggggcttctatctctgcctaagatcttttcccctgattgtctcctgattttgaggattcatcatgttactttttttaaaatgtgatttcctgtcttatgtgcctgaaagtgtcatagcacacttgatgtcttctatttacagtccacttgacttcaaataatggagagaggaaaagagaatgaagcatctggtttatgaagaaatgcacatgaaatagtcaaacaagagaaatcttattggttgtcctttttaaaaaatgtccttttgcacaggagaatgctgtgggtcttcacgtggctctagaatagaatttactttatcctaaatgggacctgtgatgaatggttacagaaacagaagagctagaaagctttcgcctatagaagactcaaggcagggtgagggcgactgggtgtctgggagagaccttctactctgtctattaaagaagtagggctgacgttgcaggagagggagaatttcctaactgcgggtgacaatgcatcagggacacctggtcacttgacaaggtcagtgacctgtttgttagctgaatgcctttctggagatgtaggctgctctctgatcccatgaggctccagatggctggatacattgagaattctgcctgactggaagagcttgtgtgcatgttaactctgcctgctgcaccacactcctcagtacacctcgatgctcgattttgaggaagtctggtttctagaggatgtgcattaagtgacagtcagctcgttagagtcaatgtccatttcgccttggcctcttctctcccccactagtgtcactttacatgagcgaagtgctggcacctgttggtaagaatgagagaagaaaccagctttttatggaagcagtaaaaaatgtttacaaaaaaaaaaaaaaaatctaaa

SEQ ID NO: 125041 - DNA, 1620 bp, Homo sapiens
tcagcatcctgggatcaaaagataaagtgacagtgtgacagggtttgcacattctgctcaggatcatctctccatgaaaatgaggaaaagagatgcaggtgcctacgtatgggaatgtttccatggaatattattgatatctccctttgaggataaaaagagctgtaaaaaggtcttctgactatgttcagttcaggttttgcatatgttttggtcttaaaaatgcaccatgtaaaatgattagagataactgtatactggtcagcccaaatactagagaaatatctctccaaagtctcttgaatgaaataaagtagtttcactgagccagtagtggctacacctctgacccattggggaagagtccccacttctgatctcacatccttgggagatatggtctgattcagtctgcactgggcctgttgctgttatggaaacgatatcagtgtgttttatgtgtgtgggctcatgcatgtgcacgtgtgtgtatgagggcattccataagagggctgagatgtaggtggagaagagcctactgcatatacaccctaactgtttggaattttcatgaggctaagtaccctgatgacctccctcataagaatgaattaatcaaacaaaactggttgcagcgtagccatgtcgtaaactgtagagaccattaccatcaccttcattgccagcaaagaacatgaatcctaatgaaatggatactcagtggaagcatccagtttgggaccaggagctggaaaatgaaaggaatgggtataagtgccacctctcttagtgcccggtaaatggaatcccttcatctgccttttaaaggctcaatataaatggtgctcatttcagttaagacctataggtgaactaaggagaatttggacagccagtttagaaattattctataatagtcaccatattttttattcaaaaatacatgtataccgcctaacattcttttttgatttgtggatttatttaaaaagtattacaaaggtataagaattacatcagatttagtaataatacatttaataaatcatgcttatggaaaggaataaaatttcatgagattgaatctgccccaagacaatatgggataaatggtactgacagtgcctgctccaagcagaacaaagagtacaggttgaacgtgtgagcgaaatagaaagggatttcttatgacctttattcagatgcccagcagtgattcccaccccaccccctgaattttctgagtatttgatactgtgattcccttctccttttgtggacagcacatagtaaatctgaatgtgttcagaagctggatgataggctacctatcatccatgtggagcctgtggagtacaagtccattaggtgtatgcagaacaacttcatgccagttcttgggaacttgacaagcagtcatccaaatatgatgctaacaaaatctaggtttccctctttttgaggctcaccagcagctctgtaagctttatgtacttttttcatcacagtctagaaggcgaaaaaatcgccagaaagtccaggttaactaaatagagcacccagtctgggatctccataacaaaaccgctggacaagatcccatgcaaaaattctttgg

SEQ ID NO: 125042 - DNA, 1078 bp, Homo sapiens
tcagctgagcagatgctggtcggtcagggaatcagatgaataaaaatttgcttgtgcatgtaccagaaaaaaaaggctgtgagtaaaagataatcaatgttttttggatgcagtttaccagaattttttattcattaaattttcaagttataaaagcttttaggctgataatggagacctgaagctgccacagatgcagcctcagcctttgctcccctgcatggctgagaaatcaagagagagatttgcagattcaaacacacacacacacacaaagatgacatggagccatatgcaactgccagtattggactgtttttgtctgacaaatacagcaatttcaaatggctcaaccaaaaattattgtacattcgtggaatcagttgtatttacccataagcatttactgttggtttctgacacagtcttcttctattattcacagtacctatttctctttctttattctgtgatcatttaactcaccataataagttgtagtaaagtctaagtcaggagcattggccctggacccaaggagtgggattcacaccctagctccttcgtttccttgctgggtgagcttgagcaggttaattgccctgccctgtatcccggtctcttcgtctagagactgatcgtcatggagttgttttgaggatgaaatgaaccaagattaggtggaaccacatgaaatggccaatattggaccacgtctgaatggcaaaatttgtagttctgttctgctcatcttaatcaatgaaaagcatttggggccattcccatgagggaaatgacacgaagatcacacagcacacatggcgctccagatgaggcatggagaggcatggattctagtccagctctgcctgtgacctcctgcgtgacccggggcttttctcctatcctgcactcaccaccctccctcctagacaatgctgtggccccggggatggcctccttctgtgctttgaatttcatcccctctcacctgctctggggctctgtccgttatcatttctaatctttgcatcattagtctcttcctctcacatgctgtcttctcaccagaatataa

SEQ ID NO: 125043 - DNA, 1189 bp, Homo sapiens
cagcccgccttccttgggacaccagtttatagatatctagtgcttggtagttaatgccactgctggaagagggtgtttggaaaagcagctgtcgtctgctcttccgggcttgggaagcagcagatggaatgttttttatttatataagagaagtagaattgaagagtgattaaaatatttatgctttgaaaagtactttctttcagtttctcaatatagcactctgcagaataatccattgattcaggccattgagtgtgtgttctatcattaccaatattttagagcatgcattattcatttttatgggcattagagaagagctaaactgcagctggatacctcagcacacaagtagccccataatcatttcattgaaatcctcatttttgagcgggataagaaaggggacacaagtaacttggatattttaggtatgggaatctcatttaaagcatgtgtggctaactactccactgtaaaaaaaaaatgtaatgagagtatacactttagagtatatgtctgtgtgtagcagtgtttctcagctttagctgtacgtcagaatcacctgggggcttttgaaaaccctgttatcccaccggccaaccgcaccacagattaattaaatcatcgggggtggcgggggaagctatgaatgagtattttcattaaggtagatttgatcattaaaggtgatttatgttaatagaatcgccatcattaacacatgtgatacttatcacaagctactgtaaatttcgtgcattgatggagtaggatgcttgttgacctgtgtgacccaggttttcatcctggatctgctattccagagctctatgtctgagaatctaaaaataataatagtttttaaaaggatacatcaccctgtcttttggtggggtgataataaattgaagtaattactgtaaaaatgctctgaggaagtaaaaatggtatatgtagttgtggagtgttcttttgtactgaataagataaagcctgtctatgaaaaatgagtaaattgcccttttcacaaacagacattttttggctatgttaaaaaaaaaaagtgaagctatgaatttcacagtaaattctgaactgaattagtaacccatgtaactttgacaaaaataggctttaagctgaaattttcatggattttggaagtgtcttcctccaaacaact

SEQ ID NO: 125044 - DNA, 1673 bp, Homo sapiens
ttaagcatttttgttgacaaccctgtcaatctaagccatggtaaatgactgctaagtaaaaccagtgcagtatccggctacactcacaaaaatatagtttccagatccaaggagggagttaatagtcccgtgataaatatacttgcctcagataatatctggaatattaggaatcattctggggcacaagaacacatccagaagaaggtaatgatgtctggaagcaacagtcgatgaaatggggtatgattagccttgagtagggaagtttaagaggaaacacatgaactctcttcaagtatttcaataatcatcaagtgaaaagatatttgacttactgcatataactctagaagataaatcaggaccaatgtttggaattgttaggaaaccagacaatagtcttttgttgttgttgttttctgtgtgtgtgtgtgtgtgtgtgtgtgtgtgtgtgtgtgtgtgtgtgttttaacaaatgaaaatgccctgcaaagttgtggggcacttctcttgtgtaaccaaaattacatggcagtctttcatggacattgctatgattcaagttagagtttcctttttgtcttttgatttttggccatgtgcatatgtactaacttctcacaaaataaataacctaaagacttttttaaatgtgttttgtccatgtctggaaatgaatgcaggttcttagaggaataatctgacaaaagtactttcagggatataaaagcagagaactggattctttctgcctgacacccacccaaccccaagacatctgctgaacattctgtaaatcacagacactgctatcaggctttctttatggaagagacagattgcatcattagggagcctcagacaaacacgacctggggggttggtgctctccttggtgctgaacggaggctgggcctttgggcttcctcccaggctaaggttggccctaaccttatccctaccctgcagcaattcaggttgcacctcttgcctgtttatctgataattctgctgcctttgctaattccagctggtaccgtgactactttgattccccattcagtgacctctctctcaagaaagatgagttatgcaagaggtttgagatttggataaggagctgtgtggcaggtgaaacatcacattcataggtctatattgacttattaaacagttgcgtcttctataacttccagagtcgtcccatggtatacattcattgaatcttagtagacttagatatgaaggcaaatattggatatggtgggttgcagcctgagaaagagggccttaagggttcgatgagagctctgatagaataaatacaaaaattggaatttttaaatgttttttatttctctaatacatacaaagcactgttcttgatggctggagatagcagttctttaaactaacatggctttgcatgaaatgaaatagctttgagtaaatgtcaccaaatgacaacaggaataacttgacaacaaaagcagagatcggatgaacttggcctgtctggagtaggcagtcatattctcctgataagaggagaacactgctgggctagcagggaaaggtgcttctgcccttctgtggggtttcaacagacagaaattcactggtgtgagcattgcttcccaagagcccaggcaactgggattgagcgaagt

SEQ ID NO: 125045 - DNA, 1130 bp, Homo sapiens
ctgaagtttgcataattatggacccaggagtctttgtttgtctcctgctgtagtcttaattgccaaaagatgaagcatttgaggttcacaaagggaaatcagcctgcccaaatccacaggactcctaagttgttagagatggcattcacccaaatctttaaagcgtatgttcttcactgtatattctgttgcttctagtctggacagtgtcttttctatagatgcctcagctctttgtttcttgttgtcatttctgtatctgcatccactggtcacagaagccatgtgcacacattcattttaatgtccagtgtttatgttgcaggatgagtcacaaccgctttttgacatggctgaagggagacgtggatgtagtgggaaagctaaatgataagctttttagaaatgtgttccctgggtgatggaatatgctcagtgctattgtttttaagcagtagcattcctgctaggacaagaaatgcaatacatatgctaatatgttcatgaatggttggaaagatgtttgaatcaaagaagcttgtctgtttcacatttacagccaatggaaaatgaaatttttataacaggttttcaatgaagttgggagaggtgccagaaactggagattgctacatagtagtgccttcctctgaattactgtaggcatgcatgctatctacaaggggttggataaaatggctgccagcttttttgaaacccaaagattctctaaaatactacatgaaatagacagatctctcatatacattgagtgtagtatgaataaacagaagtttttaaatttaccttgaattgtgattatacaaaatgataaaaattttcacatttttctcaagatttccttaaaatatttaatgaaacattagtacatttcacctattattactaaccccaaagcaaaatggccccttgaaactgtatttctttatgatagataacacacactaccttcttccttgcagtgccgttcttatgctcataaccaatctcccattcttccaagatctttgaaaatacaggccatgtcttatgcatcttcttggtaggctgttagttagtgtatgctaaggggctgagggtgaatgtcatcattatcacagtctttaaaa

SEQ ID NO: 125046 - DNA, 1051 bp, Homo sapiens
ctgccaagttctttagggttaataacatcttgctctttattaaatggtggtaatggtataagaattttcaaatggtgttagctgacacaataggaagttggtaatattatggcaatacacaaatgtaacagaaaatgttttctggtctgaaaatagagatcattaactcagtgaactgccagtactcccctcctctaaacccaatttttagatgaagcttggaaatgtgaagagaagtgttctcactaatcaacccagaggtcaattcatggtgggcatgtgcgtgtgtgtgtgtgcacatgcacacatctgcgttgaaaaggacaaactagcttctcctctactaatgatgctctgaatttgctgggctaaggtggtgttactgaagtggataaagcttctgtatcttggggacatctgaatgaaggagtaatgaaggccttgtaaagaacaaagctcatgaaagcatgaaagaagctcttgtgtagattatttcatgagaacctgatggcttaaggagaacttgatgtcacttcaaaatcattttcccattttctacctggagtgagaggtggtaggacacatctaccccacaaagggcaggctgtgccttctggtgatcactaagggagtcagtcttctaacacttcattctctttaatcctataaagttagacatattcctaaatggttcttagttttttttttcaaaacacatgacaactgtgtaccacaatatcattgattttaacatcttatatcagagtcagggtgtaaagcccgccacaaatgtattaaaggaaaaaataatgtaaaacctgcgattggtaatataatttcccacaaaatgattagaatttatttctgtctggttacatgtttgttttcatttatttaacaattatgtgttaagccccctcttcctcatcttttctatattatacctaacctactaaaaatataatacagatatttttgagtacttatcttgtgttggacatttttgataagaatttttacattaattatttaatactgaagccatcctatg

SEQ ID NO: 125047 - DNA, 1049 bp, Homo sapiens
tgatcacagatatgaaagtccctaacaaagggcctaatccatagtaggtgcccaatccacatatttccttgtaggtatcttgtttccatcctcttcctgaggtggtatcacagaaaactctaaaagtgatattgtcagaaataaacgccaacaggtggcccatgtgtagttctgtgcctgcccctgggcaagtcatttatttatcatccctttcgcttttcacatttccagctctgagtggtaatttggagccattgggatctaatgagaaaatgaaaggcattgttaccattattgctctggtgccatgaggtctctggtgggaacatttgagagaggaagacaataataaagaaaaaagaaacctccctagaattcagctgtactgtctggggcctcctgcacatgacttcaaagccacatttccttaagtggccattaaagtctgaatctccttcccagctaaaaataatttcaaatgattaacataacagtgaatgatttttggctctgtgagatattattgatggcagttcatactgaaaagcagtgaaacacagaaatggcttctgtcacacaatgaaagaggaaaaatataacaatagtccataaaatagtttctactatgctatactagaagattgacgcacataatattagttttcagcaaggataagttatctgatttttatgatgttcccataaaaagctgacacattggccctaagcttgcattcctgccttgaaataattttaatcttccactcttgacaagcactgcaaagggctgtgacttgctggaaccctgttccacagagcatctgtctgtaaaagcccccactggagtgatattttccctggtggatcagaattggctcccttgggtttatttaaaatactcatcaatatgggaaatatattggagtgaatataaaggagccatctcagggtagttcactgagctttggaaaatattccagcatgaaactctcatctgagactctaaccacagggagacctttccttgcctcaggtggcccgagtgggac

SEQ ID NO: 125048 - DNA, 1006 bp, Homo sapiens
acatagaaatatattttaatattataaaatcaatacattaaaaattttagtggtcaggtgcagagtggctctttcctgtaatcccaatactttgggaggccaaagccggagggtctcttgaggccagaagacaagtctgggcaacacagcaaaaccctgtctctacaaaaaataaaataaaattacctggacatggtggtatgtgtctgtagtcctagcacagacccaggagttcaagcatcacagtgaactatgatatgttcgtgaaggatacagtgccaccgtactctagcctggacgacagagcaagaccctgtctctaaggaaaaaaaaaaacatgcacacacacacacacacacacatacaaaaacaacaataaaaaccagatgcttgtccgctgttgaaaatgtagaagttttagaaaatgggaatgatatttaaaggagaaaattaaagccccttactattctgccaccatgagataacagtgtaggcatagtgatgtgttcccttttagcctctactgtatctatatttgtatcctcacattatctgcataaatacatgtgtttgcatatacatgtatatataaaaaatgtgggatcatactgcctctgaagttcagaatcctggtttcttttttccttccctcaaaattatcatcagtaacttctttctatatcttaaaatatccttcaagggcatattctttaatgactagatagcattatgttcaaaagatgtctatttctatatattgagattgtttccaaatttttactgtaaaaaacacctctggctatatctaccaccagaattaacgcaaaggattcatttttaatgttttacttagaagaaattcctagaagtgaaattgctagtcagtgggcatgtatgtatagttacttagatagatgttgcctaactgccctctgaaaagtttcctttgatgtttctggccccttagcagggatatgataaaattatagcaacaataaaagaaaac

SEQ ID NO: 125049 - DNA, 1029 bp, Homo sapiens
aatggaaattgaggtttgattataatgcatttcttctttcatcactaagatgctagggctccactgcattactgtccttttagcaaatggatatttccacttcttcaattatgcttttgtgtgggggttattctcaggtgtattttgaagagcagaatggacatacatttgtgattgaagccttgaaacagttttgccaaattcacctgtttgaccgtttataattagattacaatttaatactactgctctgggtttttttttaaaaaaaagcaagaaagaaacctacattacacattatgaaaatgttcaccatttccttactttgtctttccatggcaatatttattataatacaccagtggtgccgagtggagcaccttgtataattcatcacccagacacctctgctttagcaagtaaaaataacacagatgagcaacctgaaggactgtttggagtgcagcagcaattagaatagacacttaactctgggacattggtgtttttgtaccttgagaagtaccatccgtcactttcattcttggggaatacattctggctaaagaaaactcaagaaaattagcttttaacagttaaatctcttaaggacctttttttttctccaaatacgagcttgtactcttgcttatgcaaagtggaatgctctcagatcttgattctgccctgaattttcacgttctactcttacattctatttcaaccttaagtttaaagtaaaacaaaaacaaatgttctaaagcctaactttgacattaggaagttgcagacacttttggtctaaattaaaatcatcataggagagagcataaaagtcatttgaaggtgattgttttaaataattaaaaaactaatagtgggatttataatggtattctccaaggcaggagagaacttcatgtaaaattcttgcattcaggatcagaagcccttgtgataggcatagttgatacgaggacttttgccatgatggttaaccttcatcttgccccttactgtccccatctg

SEQ ID NO: 125050 - DNA, 1083 bp, Homo sapiens
gctgtttatgctcatcttgatggcagcagaaggcccactctccatgtgtaccttcactcatgttctatgacatgccgtgcccagctatctgctcttctcctttgcccaagggacatatgtctgtcctgctaaaagtaaacacataagagtgatctggtgtaggaggtagagattgctgggaatagaggggaactgagttcagctctgctacttagggccttgtgtccctgagtgaattactcacaaaccgcactgtgctcctacacctccaggttctctccagagcagaatgtctagaaatggattggaagtattttgggtggtgatttgagtagttgtgttcattttctggctgaaattgcagtgatctcagtgagaggagctctatgggaacagtcttattcaacctggggggaatagtttggaagagatggttgaattccagagcaggtgcaggcagggtaaacatgaccctgatgtgggctggcctctgggtcagtggatccccatccagtgggtggaggggacctcagctggcaagaatctgggcaggtagtcctcctcaggtgaatgttcattttgtgcttggggatggggtggggacagaataggggatagagcttgacctctggcaggtgtagagtagccctcctggcctttccaggacctggtggtcaatccaggaatcagggcagaactccatttgtgggctgaagtaacagagtggagatgaaggcaaacacctcgcaggtccctggagatgccacagatgctcttcatgcactgaagactgttccatctcccaccttctgatggagagaagactcccaacattctgccacaactcactcaggcctggtttctgcattgagactgggcttggacagctgaggcctggcattgtcaaagcagtctctcttcacctaagacgacaaacacatttattaatttgttcaatgaaaatctatccagtacttacaacatgccacagactatgagggacactgcaggtacaaaggaaccagatatggtccttgtccccgaaggagttcagaaaatttcctatacacttcagaaagtgga

SEQ ID NO: 125051 - DNA, 1015 bp, Homo sapiens
tctttctaagcaatttttctctataaagaaaaattgaataccttaatgaaattctcttgctctcagtgtttctgttgtttggaatactttctctaagaaagaagaaattattaaagaaaatgggtagctgaaaatgaaaaatgtggtcagcaatatttttattgctctttttcttatatcacaaaatttatgagagtacatacagaaaaagaaaggatgataattttcttgccttttgttcattggcataatttagctttaatctaccaaggtggatatgatttaacctgtccctattatcattgtcgatgttgaaccttcttaaagtggtttacttccattccatccaacatctagaagccagcacacatataaatctttccgcacaggcttaataacatgagcaccagaaaagactgtttataccagaaaaatgttggggtgtttggtattactgtgaaaacataaatattcagttgcctgctcgagagcttaaaataatggcctgaaatgattaatgggaggaatctgatgattacattggaaagagagttatgttttatttacagtgtagaactgactacaggtactgctgaaataaactagaaaatttaatacttagtaaggaaaaatactaagaaattgagcctggttggccaagtggaaaactttatcatcttccagtgtgggctcatgggaggaagcagccaatgatgacatggaacatgagcatttttgcattagaacagtagcagtgtaacctgagagatctctgcattcacctactctggtttacagctcaccaaatgtgaagatttctgtttacatggatccttgacttgagttatccttcttactccctaattacactaactcgctgagatttcagtgtgcagtattgcttactgtttactcagcttaaggatgtaagtcctaaatcaaacaaatcctgctgaattcctctgtctgataactgtgactgtttcatgtttatctcaatttcatgggggaaatt

SEQ ID NO: 125052 - DNA, 3120 bp, Homo sapiens
ctggcctttgaatagtcagcagagcttggcttccctcagtaatgttgtgattactgtgtaggcacaaacagaagtcatcctgctgttatttaatcctttgccctctttgtgctacctgaggtgatgctcaaagggagggcctttcggcaaaacgtggctttgattgctctgtgtgttttgcgcgtcctgcttttgttgcactatatcaaagtgcagggagcatttctttttggttgattaatgttcaatttgaggtctattatgaagctccaggctttaattactataccattacccagtcaattccttgccattttatatttatggcctttattatgcctctgtatgtgcaattgcctaattttattctggaagcatttcacctcattagctgggttttataccattcctctcatttgtccagattgttatttatcttggttccctgtgtgcgttttcttttctttttttttttccaccagtctgactcattatattaatacattctttttctccttttcctgggatgcattgttatttggctcttggaaatatcgctttaagttttttgtccttttccctggtcgtcagttatactcacattcttaacttggtcatttccaaccttctgaaagcccatctcagctgcctggcagcactggccctgtccaaaggcctgaggcctccgcagcctggacataccatggatggccgcctctctctaggtgaccaattaaagctcagggaaggtgaagggatggagtttttacttaagggcatgctggtgaaagtaacttttaaatattctcttaaatccttttctaactctctctccctcaatcccctcattgtctcagaaaacttcaggacttggtttactgacttatttttgtgggttccacctcagaccttctcaatcaaaccctaggggagcctcccagcagcctgcgttcagtatgttctccaggtgattctgacacacattaaagttagaaccacttttcttttttttttttcattctgagaatgctttattttgcagtaccatataattttaacacaccaaatatattttacagtaacaattatattcttcactcaggcataagatcacctgagtttgtggatgtttctcaacaggttgttgtcgtagcatttggacaatgtgattagacaacacccggggaggtggtcatttccaaactggaagttgtccagcattattaggaacgtcttgactggaagaaaattatcgaacattagtttggtcctttctctgttctttttttttttttttttttttttttttttttttgagatggagtctcactctctcacccaggctggagtgcagtggcgcaatctcggttcactgcaagctccgcctcgcgggttcatgccatatgccattctcctgcctcagcctcccaagtagctgggactacaggtgcccgccaccatgcccggctaatatatatatattttgtattcttagtagagatgggatttcactgtgttagccaggatggttttgatctcctgacctcatgatccgcctgcctcggcctcccaaagtgctgggattacaggcatgaaccactgctcccagccttctctgctcttttattttttttatttaatattttttattatactttaagtcttagggtacatgtgcacaacgtgcaggttagttacatatgtatacatgtgccacgttgtgctgcacccattaactcgtcatttaacattagataacctaatgttaggtatcataatgctatccctcccccctccccccaccccacaacaggcctgggtgtgtgctgttccccttcttatgtccatatgttcttattgttcaatttccacctatgagtgagaacatgcagtgtttggttttttgtccttgcgatagtttgctgagaatgatgtagaaccacttttctaaagagatgctaaaagaacttgaggaaacccatgtaagtcagaaatatgatttcatccaagtccttactttaccaaaaaaagcaagattaataactgctacagcaaccatgttttgttttctgtcgtgctttttcaacagcttttcccaagagcgataagaatatttcagaaatgcaaatagtaataccttggaacaagcgtttatgtaattattatggtgatagtagtatcagttgtctccatcaagtgtttgaggtgtttcaggcactaaggaaatctttacttccattttgctttcccatttaatctttacgaccctttatggataagtattccttcactcattttcatggagaaaactgaggttaagggatatgtacaaagtcaccaagaagtagactttgtctgttagaaatagatccaggaagtttgtttctgtccagagccacagtgctgatcactcctttgtgaccatgtgaaggcctttcctgctcaaagctttattactgtaatatttcaccctttctgttttcaataggaattggtaaccaagaatatgtgctttggggttaggccatctaagcttccatgctgggtctgtttatttctgtgctgtgtgaccttggaccagtgacacatctctttgtctctgtttcttcatctgtacagtgagatggcttagtattttggcatgtgctggtacacgtgtgtggaatgagacaatctgtacaaagcccttcaaagaaggcctgggagagaaatgctttctataaatgttagctgttagctgtttgttgccttttgctgccatcttgatggcatccctaaagcttttttcttttgggtttatttacttccaggtctcacttcctttctaggtagatctggtgaactagcagcctgtggttctgatctgttccattttgtttgtgtgcttggcacactttctataattttaatgttcttctttctctgctcatttaaaaccatcctattagggcttggacatgtttgtttaattctctggacttgattgaaattcatgatcacaattaacttcttgtgcagcccccttgaggcagctcagggttctttctcatgatggtcttcagttttcttgggaccaatcatcattagcattggcaccaagggagaatgaaggagaagtga

SEQ ID NO: 125053 - DNA, 1052 bp, Homo sapiens
ttcttttattgagactatttgctaattagtcacgtagttctttaaaggaaccctaaaactcaattactttgttttttaactgtaaggattttttgaaaatagcaaatgaatgcctgtggaggggtgtgattgataaaaggaggcttgaaggacatattgggtgcaaaattcaaagaagattgataactcttgagccatgggatcttctcctccatcagcttcactaacatatagctttggggaattgttagaattaggttcagagatactaattttttcccactagatttcctttcttacgtatttatttttgaaactcatatagcaacactagaaataggtctgaactaagtatcatgtgtttctcttttacatttggctcccctcctgtgtcagctggcctatgatgcacagtggctaatattgattagcctacatttttcttaaatacagttttctcagtctatgtaaagtctaaatgctagcagtaccaaaataaacgcattcaacttctaaactggtggtaaggaaaaaagtaggaacaaaacatagttgagacatattgtccaatgaaatcattgcctgtgatgccacagccaggtgtgaggtctggggcaagcttccaaactcatctgagcggcagtttcctcatcagtagaaccgggataagaatagcacctaccaggtgtgagatttaatacatgtaaagtacaaaatagtgctaacacccagaatgtacttagcaaatgttaacttcttaaatgttacttgtgttcatgagaatccaatgtatcaaagtgaaaataatcaatttgtgtgtaatggggaggaagttttactattctttactaaataactaaaaacattacaaaatatttaatggcaagttactttttagacttaatctctggtcatttatttccaattaagactggaccccactgtatttgacatgcggaatggtttttatttttgttacgatcatatttattttgagatgtatccttcttatcattagtagcagttctctagtattttaaaaactttccaac

SEQ ID NO: 125054 - DNA, 1061 bp, Homo sapiens
gatgcatttgaaaaaagttaatttgaaattttaatttcaacactgatttttaaaccagaactatgtccatctctcttgtctttttatcctcagctctggctgattcccgctggaattatttccaatatgttctccagaaaaccatctcctgtcagaaactttcaggatcacaggggccgaatgcgtctgtttagctattaggttgaatcatatgataacattacatttttgtacgtcaaaaatggccagatagtgtcacttaagtggttcaacccaatatgtttaccctgaatatttacaggtcggaaggcttgggagctagaaggccccattaggattttgttacccagttctcaatatttacaggggaccaccgggagccggcctaattgcccagttggtgatgaattgattcacctgtgctgaagccgtcctcatacagtccccctgacgaactgtgaagtgtagtgtgaacggtcaggctccaggaggtgtaggcttcaaggattacaataaaggatgggggttttttaaagcccagagggctattccctggcaggaaaggaaagttgggcaaacaccctggaggggcccaaacccaagagacctcaggacctgagattgcccctgactctgaggattcaaatcagacagatcctcttcctggcctcttctatccacaccctagtctccccacactgtttgaaatgatgtgggcagaatgcaggccactcacactgactgcagagggctgacttgggcaggtgggcatgagcctttctgcccagcgtgagtccctctggcacagctggatgctgacctgcagggaggcgcttcagcgagtacttgagcagggtcgaggatgagaagccaaactgtttctcatgttctcctgcaaaatgaatttatttccttgttagagaacagtgggcatacccctagtcaaatataagtgaaaatcgatgcatctttatttacaaaaagttagaaagatatggacagatagaaaaaaattacctgtcttcccaccactacaaatcattattactactactttggca

SEQ ID NO: 125055 - DNA, 1024 bp, Homo sapiens
gggagctgtagaccggagctgtttctatttggccatcttggaagtgacccgtaagtctattcttaaagtcatttttctgtgagatataattcccgaagtgcctacttgttggaggaggttgaggttagtataattactatcaaaaaatacactttcagaaattggttccagcttttcctgcccctcactccttctctgagcagcttgatggatccttccccacgtgtgtcccttataggtgtccgctccggcagataccccttggagacatatgcagagataactaccatttgtttggattttgctccaacacaaccagcttatacacattatacaaaaacttgcttttttcatttctcagttcatcatgaacatgctcacatctaagtagattgataatctggtgctttctaatatatttacatagaagtttatatcgcaaattctgttcctttcattttcttcttttttaaaccagagccttttctccttaacttcactaaatgaagctacccctctctttttcagcctcccttctttccggtgctgagtgttagccatctgagtgtatgcttcccaccatttctaaatgcttttacgatcgtgtgtatacatgtgcacatgcacgtacacactcatccacacacatgcacacataggtatatttgatcattgctgtacaaaaacgggatcacacttgctacattctataaactaagtggctgttactgttgaggtttgaaaaacataaaaaaaaaaaaaaaagccccaacattgctcaaggtgccagaacatacctgggagatccagacctctcacccaggttttctcaggcagtcactttctctgcacccagcttcaaatgaagaccagtcccacacagccctggcagctcagggcagcgttcgtgggccaggccttcccaacctctgctttgggtttgcaggagaacagccacctcctatcatccagatttcaggcaccgcttcctctgatatccaaggtcatgttagactgtacctgg

SEQ ID NO: 125056 - DNA, 1029 bp, Homo sapiens
atcaactgatattgaagcttgcattggaacccaggttggtctctctccacctctgtgctgccagtcgtgaccctgtgctgccccctatgtctgctcctcccacctgttgcaagtagccagcctcttacctgatgaagaccatcaggcctgaaggtccaggctctttggctcctgcagaaagcccaattggggtgggacatctggtcatgcagaagccacgtgactggtgggcacaggactcccaggcacctgttctctcaagggtgggctcttctggggacatttgggggctacttatgattcttttgagctgtcctttgacttattccttccaacctccaacataaagggccactcagagaagcagtacctatggcagctttaaaccgccctgctcctctgctgttctgtctgacagcatgagaagccagcaaaagcttcttcacatcagggtgccagtggggaaacaggaaggaaaagggggaataagaaggaaaagcatgctattttctacacaggggaggatttcataccaatgtgttcagaatggttttacaaagactgtgcatatatgctccaggtctgttcaggaaagattcatttgtggaggattgaaatgttcctattaatatttcttagagaaacagaggcatctactgaatttcacaaaatgtaatatgaaaactgatctccaagggtcagctttaatattttacttccttcttcattgttgaaaatatatttcagctctcttttacataccagcatacagcacagggagaagatagcataatcactgtgaaagtattatcaaatgcaagcacgcatttgcatttttggcaaacaaccacttttgattttacattgtattgttccataatatttaaagcacaaagtcctgaaattatcaaacctacttgagtttgcgatagtcagatactagtttcattgtgcttttaattaataaaatgtggattgtctaaattaaaattttcattatgaaatattttggccataagggaaaaaaca

SEQ ID NO: 125057 - DNA, 1087 bp, Homo sapiens
gttagtgtttagatttttggcagtagatgtctagtggaaaaaagaaccctatgtgttacacattttaggacattaaccagctttgcatgtaacctagcaattttatactaaaattttcaaaggctagaaacaccttctccatcagctctctttggatcagccttatttttttgccggtttcttcattattgagttgagtaaatcttgacatatatttattctgtatttttacaagtcctgttttcaactttaaaaaattttttcactttgtcaagattcaaacgtctcaagtgaaatagttactacttgtcattatggtatatatttgtaggttgacaagtgctcctggtggtagttcatagtgatctgcagagatgaaaatgcatgtttacgacgtttaaaagtagattgctgagcctgtgcatgacttagacttcatcaagtgactcggatgtgattagcaaatgattctacttgtgtggatggaagagtttcaggggccagagctggccttgtgcaaggaatctagccagaacatttcagaagagcctagggatgcagtggtgccccacgaggcagctgttcatctttgcccctccagcacctggtgtggggttttttaagctctcaaccatgtgtgtggtagtttcctggagttaccatccttgtccttcaggggatttgaggatttgagcctctttttgcagaggctccagaaacgcaaggttgggtcttcagaatgatctctaggaaggaattgagtgtatcagacattaaatttacttagttccagtttacccccaccgtgcactttttcttatctctctccctcttccattaatcccatttttctccctcctttccttccctcctcccctttttttttgtgttgacctatttacaaactcacctcacttgagatgatgtggaagattacatcacgcttaacatatatatatatatatatatatatatatatttgattacctgaaggctttctataatgccttagtggaagcctttatggtaaatgccaatcaatgaaacacagggagtagaagtttcctgtgtatttgaatgttgcatt

SEQ ID NO: 125058 - DNA, 1034 bp, Homo sapiens
tggaggcagaggttgcagtgagccaagatcacgctatggcactctagcctgggtgacagagtgagactttgtctctaaataaataaataaaaaagataacatttccatgtgaaaacctagaataggatagtttatgatgtcatcttagtatatgcttagcttcatctgatagaccgtaatgaaagattttctttcttcatgttttaggtacaaaacttagattaaaaaacatatccctgtagaaagcatgttgagacttctctccacattagtctgggattattaaataattattactattaataccatggagatgaacatacatgcaacctgcagaacaaatgaaacgtgttgctctgaagcaaagtaattttttaataattagtagcctatcagcataatgttcattttatgtcttcctaaactttttatcacttgcattgtggtttataaatattgacctactgataaagagcctttgctgctgttctttcgttcagtataagaatttctgctaaatatcatttcttcttcctttttttttttttttggtagggacaaaacgataaaatgtctctagaaatctgatttggcatggtttgtagagagattcatagtccaggattgtttaaccacacagagtcttcagggttttctagaggtttacattctgatgcatccataaaaaccaactgataatgtcattttttagataaaaatgtagtatgatagtattttattcagcattgtggcttgggactgacataggctttataaattatcgtatgatgtggtgaataggtacttgatttgttccacaaaaatctgctgccatttattttgtttttttgtttttcaagttttggcaacaacttattatgcaagattccctgaattcttccctggaaatgtgtctctcattcttttgggagatcattgcttaagctaggtaacaatctgatttcacggagagagttagaactcatgtctttgaataaccacggttacatacccatgtagccgcaagagagtgg

SEQ ID NO: 125059 - DNA, 1009 bp, Homo sapiens
ggcttctccatgttgcccaggctggctcgaactcctgaccttaagtgagctgcctgccttggcctcccaaattgctggattataggtgtgaaccactgcgcccggcccagtttttttttttttttttgagatggagtcttgctctgttgccaggctggatggagttcagtggcacggtcttggctcactgcaacctcctcctcccgggttcaagcgattctactgcctcagcctcccgagtagctgggactacaggcatgcaccaccacatccagcgaatttttgtatttttagcagagacgggatttcaccatgttgaccaagatggtctcgatctcttgacttcatgatccacctgccttggcctcccaaagtgctgggattacagccatgagcaaccacacctggccctggctctggcccactttttaccagtatttatttctgctaatcaatgtgacacatccctatggtgaaaacttgggagaggaaattgtggaaaacacacacacgagaaatcactcatagtcccaccttccacaggcaaacactgctactgttagcatctttcttcttcttctgtgaactctgtcctttacacagtggagactgacctctatgtttgatttcctaacatttccatgtgtcctcagtacacctggataaacatcacgtgcagaagccagataacattttgtgtgtgtgtgtgtgatggagtcttcctctttcgcccaggcggtagtcactggtgcgatcttggctcactgcaacctccttctcccgggttcatggaattctcctggctcagcctcctgagtagctgggattacaggttcgtgccaccatgcccagctaatttttgtatttttagcagagacgggttttgaccatgttggccaggatggtcttgatctcctgacctcatgatccacttgccctggcctcccaaagtgctgggattacaggcttgagccaccgtgcccggccgatgccagataacattttatta

SEQ ID NO: 125060 - DNA, 1047 bp, Homo sapiens
tctgcagataggagatgcagctttgggaaggggctggtttgttccatttaggataaaggacatttgaattactgtcaggacttttcagctggagatagccagaaggccaatggaaatacaaatacctagcacaagttaacatttgcttgagatttacagtaacctggcaagtgttttgttagcctattttaatgaaaggggagctgggaaactatagagcagagaataaactggccaggacatacatcgagtgtgtgacacatgggactccagtcttcatgtgtcaagttctgtgcttgttctggagaatttctccaggagagccagggctttccagagcattctggatgagaagtgccagtgagatgtatttagagggacaagttgctgaggcagcaccgggtgagatcatttgctgaagcctagagtgggttcttctctaagtgtgtactagagtcacatgtttatgtgtatgtacatgtattacatgtgtgtgcacaagtgtgtgtgcatgtgtgtgctcatctgccagcaggagagaaaatggtgataagagaaaactggaaagaggatggcccgccacgcagggactctgatttgtttgtaagagctgggaaacacaattgatactcttcccgtagcaggccattggtgcagtcctattttcgccgtttcctagtgactcacactgtatagatagtgctgccttatttttagtgctgagtatgagtgtgctgcggaaggctgccggttaccaaggaggctgtgcctctaagctcctgcagggagccccccgagtggtgactccagcctccgtgtcactctctgataacccctggcagagcacctccttaacccgaggggtgaccgctctgggctgccttccctccatccctgcttatataacggctttttgttcttattcagtttacgtgttagaaaaaattacctccatcttaaaggagagttctgggaaaatgttaggcagatcatagagagccagggggccttggttggatacaatcactgtgcgggttgggctgcgta

SEQ ID NO: 125061 - DNA, 1092 bp, Homo sapiens
gggaggaaaactagtgtttctgctgctgcatcagtgagtgcaactattctgatcagcagggtccagggaccgttgtgggttcttggggaggggttgtttctgctactgcattagtgagcacaactattccgatcagcagggtccagggacagttgtgggttcttggggagggggagaaacaaaccaaaaccatgggcggttttgtctttcagatggaaaacactgagacatcaacaggctcacccttgaaatacatcctaagccattgggaccaatttgacccacaaaccctgaaaaagaggtggctcatttttttcctgcactatggcctggccccatattctctctctgatggggaaaaatggccacctgagggaagtataaattacagtaagaaggaaaagctaaataatttctacagatcattcagtactgctcagtagtaccatgttggaattcacaggggaagtattataacttactgtgtttcaattcatttattttaaagccagaaactgccttgaaatggctgctataccaaaataccgcatccccaaaacctggtgaattctcagaaaaatcattctaggtgaagagaagccagtctatggtggacttgccttatatttcagcaccgatcccagtgtgattttatcataggctttcatcactaagaatgtggtgcagtctcttggagtacaaggacagcattagtaagaatctagaatacatttatgggaattggagaaattaaattttgacattcacttaatttttgtggtattctctttttgccacagagcatctctggaaagcacaagataatgcaggtttttgtcaatcgaatcacttttccctatatcccttattaataactgggatagtattctgaaacaagtactttgctttcaaatacattttagatttaacccataaacctaaaagtaaaataacagtatatttaaaaacacacatttactgaaatcttatacagttatagctatatagaatgcaggaggtcccggggtgctctgcagggaagctctgccagtcctagccagtccaccagacccagtcagcccctttcacctg

SEQ ID NO: 125062 - DNA, 1049 bp, Homo sapiens
attttgaagtgggctcacctgtcagagacagtcccagggtaagataatggcaaaattgcttcctatgggtatgcatcattggtttttctgctgcgtgtgacagatgcttccattgtagaaatccacagttgtcttggagacacccccatttcaagcacatcttctcttgacttatatggctgccatcatcagtccctttccagcgcttttccccttccactccctcctgcccacagtaggttttttcatggcctgtgacctgaagatcaggaaccttactgggctctgaaattcaaaggaaagctctgaaattccctgtgccctcaccttccttctccattccttatacctcccagtgaagactgtgagagccttcttgagtgttaattctagttgtttccttttctttcttttttaaaaaatttcatttgtgaaccatctccctagcatgtcatccgagcccagcgggccatcaacaatgagatggcgcaccagctgtatgttctacaagtgctcacctttaacctcctggaagacaggatgatgaccaaaatggacccccaggaccaggtgagtgctcattggacagcagtcaaagcacaggaaggacagaaagtgtcattaaaagtcttttcttgaggtaccctgaaactagggagtttcagagtttgatatgatgtcattttattatcatctcagaacttaggggcatggcttcaaaattaggtgaatctaggatcagaaaatataccaaatgcattcttccattaggctccaaacatgcatgttctttctgcatttattgaataagaaagtttgatgtcacatgaccacagactttagctcctggccccaagtaacatttaatagtagtagctttggagtcaagttcccagacaactagggcctcttggtgactctatgtggcattgattctgtggggttgagttagcaattttcgttctccagggatcagtgccaagagcagggtcccagattaaacctgatttctgggccagcatttctgtcggttggctgttggctgtaac

SEQ ID NO: 125063 - DNA, 1018 bp, Homo sapiens
actgcgaggaataagtcaagggcttgccaaggatagtaaacatgtcggagaaggttattagccatgagaagagctgaagcagtcttttgagaacctgaaaatttccatactcttcctgaagtttgtattttaaaataatagcttttcggaatgtaaaatcataatgtcactgcacttcttcacattatttcccacccctgagatccagatgtagctggggtaggcagagtgttggtatctgcgtctcccacccctcctttcacctggaaatcagcggactagggacaattccgatggtacctgggaactgccatggtgtgctgtgcatttatcatgtgcaaagatggagaggagatgaggcaagtggtctctggggcagcaaaaaagggagaaattagtgttgacaggggggaagcagcaagagtttacttgtcgtggaaccaagttatttagcttttaagaacagtcattatgctgatataataatggctttttattgtgagctgtcaacagacagtaataacttttaatgaggcctctaaaataaaacctttatggtacccatgtgtttggattactgcgatccattattctaacctctattttattttccgctcacattgtgatttattatgtttggggatttagtgattaattccttagagaatctattttggagcttaaagtagtattttaacttttagtactgctcacttaaatgatttcctgtttgctaaatttgggagagatgaaaagaacttgttttaaccatcagaaattggaagaaaggggtaacgagtttttcgtttaagagagtggccggtgactgagaagttgccagttgaattgtgttgacaagtgagatttgtgcgagtcccttaagaatgcaacaagaacataataagcatataaaagccatggattgtgtggatgaaggagtagcctgggaatgcaagaggaatggcaattaacatatgttgacattaccatcccagagaaacacaggtatccttacaat

SEQ ID NO: 125064 - DNA, 1059 bp, Homo sapiens
gcatagtgagaatgtagtaacactcacacgctacttacaattcactgcacagcatttggagggctttaagcatgtttgcttgttttcatttctccaaaaatctctgagctagttgtgactaccactaccatcatcatcatcatcatcatccccatttttaataaatgaggaaagagaagcataggatggtgcataacttgcccacttagggctgaagggagaacccctgctgtctgactccacaaactacctacttagccgttttcgtttagctggttgcatcccctctgttgcccctggtctccggcagctttggatcattgtctttccctgagaaccacttccccttctataggttccatttagcattacatcttctgtggtgatgcagaatttcaaaggtcatttttgaggctgggctgagtagaacagtaggaagaagggaaattgagaagctgttttaaaagaaatgttacctgttttctattctactagttggaaataaaactagttggaaggttcaatctaaatatgttaggagactttgtaggatatcaataatggtatgcatgagcctacaaatgaaaaatctatataaccaactttatttttttaaaaattgaacctaggaatcagtgctgttacataatacagtgtacagatcctgactggcataattcaatgtactcaaagaaagagtatttatcataaaggtgttaatacttataatgatgataatttacaataaaggtgaatatctatgaaagattctgtgtatctaagtctctgctaaagtgttgttttgaaagctgtagacaccaggatattgtctaataagggtcctaggtggaactgcatttgcccaagcctaatctctgtttggattttcaaaccacatattagacccaccttatagcctactgaatctcagcaagtcttttggtcagcaaacccattatgtggagtgattatctccatcgatatgccagaaaagttactaactaaagacgaaatgctggccaaaatcaaaatgagtatgtttacttgcatacatgtttg

SEQ ID NO: 125065 - DNA, 1100 bp, Homo sapiens
ggcaggagaatcgcttcaacctgggaggtggaggttgcaatgagctgagatcgcgctactgcactccagcctgggcaaaagagtgagactctgtctaaaaaaataaataaataaataaaattctgtattaacgggcttgccactccatggaaacatttggaagcactattcttttataaaattagtagcataaatttacatgcttgttttgagattggctgaattttgttggaatgaagatggtgtctactaagttgatgagaaacatttatttgaatcattccagcacacatggtgtgttggctgtgacagtggctttccaccagcatgtaaagtttgcagttggcttaatttgtggctgtcagtactgcacaatctttagcctaacagtttacaaaatacaaataatccaaacaaataaaaatgttcctggatgtgccatgtggttgctttatatttgtaattcttttagccttgactctctatacccagcattgatttcagaggtagaacttgccttctgctttcccggtttggagcctgaattactcctctaggagtggaaataaacacctatgtcaaggttcagtaagagcttttatagccatctcacttgaaagaggtgattgaatcccttgatttggaatgtaataaaattttagcatggccatcctttctttgcaactgagagtttgaagttgaatttggaaaaagttcttccatatgggaacttactatgtcacccagcaaccggtcctaatgaatatgttatatacagaatatgtgtgtaatacagaatattatgtaatatgtatatattatatacctatgtgtattttacataaatattatatgctagtaatatataaaataggtcctattatatattcctatctgtctctgcctatctgtcatgtcattagatagatcaagagagctatccttcctctgagtaccttgactggtgtatgctgtgaaaaagctttactctcacttaccaatcattcccactaatggatacttgagaagcacatatagctctatttgcagtctcagaaatggtgctgcacctccttaacagccatagagattgaaatctt

SEQ ID NO: 125066 - DNA, 1032 bp, Homo sapiens
tctgcctgctttatcttccacaggcattgcccaaactcgtactcaatctctgttctcataacttagtctcagcatctgcttcacagaggactaaaactgacacatcaaaactgactcatgatgaaatagaaaatttggacgcccatagttattaaaaaaattgaaattggctgggcgcggtggctcacgcctgtaatcccagcactttgggaggccaaggcaggtggatcacgaggtcaggaattcaagaccagcctggccaagatggtgaaaccctgtctctactaaaaatacaaaaaaattatccatgcatggtgacaggcacccgtaatcccagctacttgagagactgaggcagagaattgcttgaacccaggaggtggaggtttcagtgagccgacgtcgtgccactgcattccagcctgggcgacagagcgagactccatctcagaaaaaaaaaaattgaaatcatttctcgaaaaccttcatacaacaataacaggttacactggtgaattctatattatatattatagaagaaataccaaatctaaacacatgcttttggaaaatagaggagagggaccagttctcattattttatgataccagtatcactctgataccaaaacctggcaaagacaatacaggaaataaaaattatagaccagatgcaaaaatccacagaggcatgttaataaatacaatcaagcaatatgttaaagggataataccttgtgatcaataagagcttatctcagaaatagtttaacatttgaaaatcaatcaagcagctcagtgttttatgaaataaaggagaaaacctaaagagaaaaatcatcttaatggagagaaagcatttcataaaatctaatgtatattaataataaaaattctcagcaagctaggaatagagggaacttcctcatcttgataaagtaatctacaaaaactccatcatacttaatgttgaaagactgaatgttttctaccctacagactgagaataaggcaaatatgtttgctttctgc

SEQ ID NO: 125067 - DNA, 1113 bp, Homo sapiens
aaaggagaggaaaaagaatggggaaggcaaatatttgaggaaataattacagaagaaaataatgatggagatatatgaagcaagttcttcacactggagagacatgatagtagatagatactcagatctgtaggaaaatatgaagaacaacagaaactaaatatgtgggtaatataaaaagacaaaatgtagttttactttcctttaaatttctttaaaaggctgtaactatataaagcaaaaattataatactgtttggtagggtttatgacatatgttgatgcaatatgtatgacaatgagagcacaaaggatggaggtataagagcaactacactacagcaagcttcctagtgtataatcttccgtttaagtagacattaatatactaatggtgcacattgtaatacacagagtcacaactaaaaacagtgcaaggaagcataggccaaaacacaaaggagggattaaatcagactactaaaaaaatttgattaattcaaaagaaggtaaggaaagagaagtagaataaaatatagttaagacaaacagaaaacaagttggttgacttcaatctaatcatatcaatacattaaatgtaaatagactaagcagctcaatgaaaaggtttagattgtcagatgaaattttttaaaaagcatggcccagctctatgctgtttataagagatgtactataaagacaagggcacatgtacgttgaaaataaaaggatggaaaaacatataccatgcaaatgctaataataataaaactgaatggttttattatcaggaaagataagacttgaaagcaatatgttatcagagttaaagagggataattagtaataaaaatggtcgcctcattaagaagatttaatcctcctttttattttaaatgtgtatgcacctaaaaattttaaatgtgtatgcacatttaaaattattatacatgtgtataataaagttttaaaatacgtgaagcaaacactgactactaaggagaaaaagaggcaaacccatcagcatagttgatgattttaagaccagtctttcctaactggtatgaaaactaggcaaaatgttaaggatatagatgatttgatcaacac

SEQ ID NO: 125068 - DNA, 1354 bp, Homo sapiens
ttgacctccagggcttaagcagtcctcctgcctcagcctcctgagtaggtagggactacaggtgccaccacacctggctaatttttaaatattttttatagagacgaaggtctctctgtgtttcccaggctggtgttgaactcctggtctcaagtaatcctcctgccttggcctcccaaagtgctgggattataggtgtgagctaccgggcctggctttctgaatatttttaaatcagcttttcttttagcaaaatttttgtggatatttaatttattttgttggaataaaattcctgactcagagtatgtatacattttaaagctgttttaaaataagaatagcccaatagcttgcagaaatgttctaatttatactttaccattcttgtaggagtatgtctatttccaataccttggtcaatactcggctggttttctggttttcctcagaaagatagcagtggtatttgtggagttctcactaatctggggaatttataagtgctgttttatttgtttcattgaggtcatttctccaaaatctggctgtattaggaacattggaaggagtcccatagttattttagtgatatgtaaagttcttaggtaattgtcttaaaaagaaacattaagtgtataaattattagttcctccccactctgtcatacatatgacacagatggaaaagtctagtgctgtgtgtatgtatattacatgtatataaaaattgtcatcatttttgcattaatacaagaacagtcttgaaacaggttccctccatctcatattaacctttcgttattcaaattcttttcatcttgcctgaaccagaggtgttttcattttctgaatgttgtgaaaactgaggtatagcttgaattatacactttgttttgatgttccctagcacccacacttgagatggatttgtatgttttattgattcagcgaaatgtacgttactgagggctgaaccatactcctcacactgggttaggcatgtgagacgtaagaggaggtgcatggaggataacacaaagatgtatatgacagttttccattatgtgtgaccttttccggaattttgccttcacacaaaagatgaatttctgttttgaaactttgttaacctccaaggacacagatgatcagctctaacttatgctattgcctctgagaacttggtgtctcttagaagtcttggctgttctgggaggtccagtgcaggccaaagcgattcatctacttgctgccttgcagccaaggccagctgacaccatgcacgttttgcactttacctcctcagaggccacagacccagacagaaagaagctgctcctgtggtctctgc

SEQ ID NO: 125069 - DNA, 1025 bp, Homo sapiens
atgttgtcagaatccagtgtggttactgtaagctggagctggagcttgaatcagcgagagggaagttgaaaaagtttagggatccaaggagcttgacaaaggaatggatacagagggtcctgtctgtgaggggagctccaggctggaagctggtctggaatgtgtcaggatcctattgcctgtttctggggagcagaggaggaggacgagttgttataaacaccttcactcatcactggattacttcatgtacctgccagacatggtagcctatactacataccccccacggcttctggtgagagagtggggcctgggggaggctgcctcggcaacactaacatgttaaataaaaatgtaaaaatgtttacccctgtttattgattaagctaagtcaaggacaatgcatcagagccagttgtaatgtcacctgctgatatgagttggttctgccacaagtacctaggtatccagggcttgagctctggcacattcagaatgatatttgcaaatacttctgaaattattagaattgcaattgtaattacggttactttaccgtggtaaagacagcaaagcaggggcgcatgtgatctgcattctgaacaggggcctgtggtggagcccctcacctccagaggccggcagttacagacttcgacaatgaaactgcctgctaggagcttttgttttcagtttctcattgctttactttgctagggctgccataacaaaataccacagactgagtggcataaacaacagaaactttatttttcctcagagttctggaagctgcaagtccatgatcaaggtgttggcagggttggtttctgctgaggttgctctggatagtggatggctgccttctctctctgtcctcatgtgcacatccctgttttttctttttgtcttcaaatctccttttcttataaggacaagagtcagattggattagggacacctaatggcttcattttaaattaatcatctcttgagagggcttatctccaaatactgtccca

SEQ ID NO: 125070 - DNA, 1103 bp, Homo sapiens
gtgacactttgggaggccaaggctggcagatcacctgaggtcaggagtttgagacccacctggccaacatggtgaaaccctgtctctaccaaaaatacaaaaattagctgggtgtggtggtgcacacctgtaatccaaactacttgggagactgaggcagaagaattgcttgacctgggaggcagaggtttcagtgagctgagatcgcaccactgcactccagcctgggcaacagagtgagactctgtctcaaacaaacaaacaaataaacaaaaaaaaggtgacatttgagccaagactggaggataacagggagccagaccctagcattgtaggaaaagaaacagccagcagaaaagtcctgcagcatgaaagagcttggtgtgttagagaacaaaagggaacaggatagtgagctggaagtgagaggaggtaccagagaaattgtcgatgttgactagggctgcatcacagtgtcttctaaactatagtgggaatttggatctccttccaagtacaatgaaaagctactattttatcctggggttcatgaacttatgtaggaggaacactacagccatataaaaacgtaaacttttcattgcttgaatcacaaatgtcagcaacaagccatgataggataagcagtatctgtgcctttattatgaacagaaattaaagtacatccatttattactgtttatcacagttatctctaaatatcatttatcatcttatgcctaattagaaattatggtagttattagaccttacaacagatcttgttatttaatgctttaatacaggggtcagcaactatagcctgtggactatgtccaagctgccacctgtttttgtacataaaacttactggaacacagccaaacccatttatttacatatcacagttgcaacagaggtattctagcctgcagtgcttaaaatgcttactgtctggctggaaaaagattgctgacacgtgcattgataaagcagcatatatattactatgatacaatttttttttttttttttgagaaggagtctcttgctctgttgcccagactggagtgcagtggcgtgatctcggctcattgcaacct

SEQ ID NO: 125071 - DNA, 1011 bp, Homo sapiens
cacgcccagctaattgttttatttatttatttattttttttgtattttagtagagacagggtttcaccatttctggccagaatggtctcaatctcctgacctcatgatccgcccacctccgcctcccaaagtgctgggattacaggcgtgagccaccatgctcagctgggacttacacttttattggagcaaacgagtaatatgagcaaagtttgtggggaaagtctaattttgtgtatttatagttgacatggggattggagaaaaaaaaattggagatgtggagacttatctgcagggacctggtgatgggatctttagaacaaaggtggtaggaaaggtctggaaagataaaaagggagagaggttgtggaagaagtagtgatgagacttagtgtcttgtaaatgtgtatgtcacagaatgtattaaggaagaaagagaagacaaggacaagttcgctagaaatgtgcctcaaagatctgctgaaagtaggcaagttgagtgtaggaactgatggaaggtacgattttgggttgattcgctagggaagcagttgattggaaattcatggcaaatagttattaatgatgggctggtactcaggaaagggtgctgggtcagaggaagcagaattaagggtgatgagattggggtgtacgctcaaagatctatttgatggcaggagttggaatgaggagagtcaggagttcagaagaagagttaggcggtgagaagcaatgctgtggacatcacagaggaaacagctacataacctgttagcaccttatatctgaagagtgaagacataaaggttaacgagactcctgggcagtagtggtgccataatgagggcagagaagtcgtggcagaatcaggtgtgggatctgagggatgtgtgctaccgttgggtagattgaggggtagggaatgtgaaagtgatgatttttgtttccacttttaataagatacctgcaggagagttaaaatgttctgtctaacagactgttaga

SEQ ID NO: 125072 - DNA, 1059 bp, Homo sapiens
tgacagtcatttctgtttatcctattgaatctgtctgaatttttatttttaagctatgcacataaatacagttaattttacaaaggtgaacttgacacacataaatgaattatttcacatgggtgaaggtaagcagaccataaggcctgaattgattctccctgtgaatcattcatttccacatgaaaggaaacacttgattacaaaggcatggtggagtgcagtggccttctgtgcgtctagagtcatctggaagtacttggaaaagactgatatcaaggaagtttgaagacaatatgggaattaggaaagtggttgttgttgctgtcagatataaggaaattggggaaaaacgttgttcttgatatccatagcaacattgatatgtaacaatattcactaaaataatcaggaactaggagaatcacaaaagattataattgatctaagtagtcctttatttttgcattgttcatctctatagttctgtcattatctaaagttgcagtttcccttccaattgaagggaaatacaatgtctgctgagcagaagcatgttagaatatctaaaggagaaggtaggtctgcttgtctttaacccgttaatacattcaacataattatttctatctttgcttatcttcatagtttagtgatttttatgacagaaagactgtactttatcctggtaaaatctaatacctaatttgtttcatgaagcttgaaacaagacacttttggtaaaccatttaactgtttttttgaaatgaatcatcatttgtcaagaaaaaggtggcagagtatcatctttcatttttttttttttttttttgagatggagtcttgctctgttgcccaggctggaatgcagtggtgcgatctcggctcactgcagcctctgcctcccaggttccagtgattctcctgcctcagccctctgggtagctgggattacaggcgcaccccaccacgcccggctaatttttgtatttttagtaaagacggagtttcaccgtgtgggccaggctggtctcgaactcctgacctcaggtgatctgc

SEQ ID NO: 125073 - DNA, 1104 bp, Homo sapiens
agaaggctcttacatggcggcagacaggagagaatgagaaccaagtgagagggtgttccccttataaagccatcagatctcttgaggcttattcattataagaataagaataagaataagaataccataagaatagtaccgtaagaatagtatgggggaaaacttcccctgtaattcagttatctcccaccgggtcccttctacaacatgtgaaaatttgtcgagactgaggggaagggactgttgacctctagagggtggaggccaggtatgctgccagtcatcctgcaatgctcggggcagctcctacagcaaagaagtatggccccagctgctaattgtgccaggaatgagaaagcccaggctagaacctttcttccctaaatttcatcagaagtaacagtgattatatatagaagccttaagtgctgttttcttgtgaaaacataaatttaagaggataaagtctggacttctgaggataaaacatgaactagattatccattctgcaattgtgcacctggctgtatcccagaggagccttgctatgcccccctccctttctctcgtggtttgttaatgttggggaaaactgatgaggtctaattgggcttggttaagtgaattcccaaggggaagcctccttgctcctttgctctctcaatggctgctttgtgtacagctcccctctgactctccactggagccacgttattgtattctcacctgttcaacaggttttccctgaacggtctgagaaataaataccagttaaaggggtagaaaaacaagcttggcctttgattcctagaaggttagatgaccttttttgctgtaattctagacaattttatgtagaggtgggggcaaggtacttaaaatgcattttaatttttattatttactgtcttaacccccacgattgtgtatgctttcttttgaatagtgttacctaaaattcacacaatctgtttgcacattagagcctgctttcttaattcttatgctaggatatgtaattgaacttggatgtcgaactgaagtaatgtagcacagataaaacgcattgttcttagagctctcaagtattcaaagagcataca

SEQ ID NO: 125074 - DNA, 1059 bp, Homo sapiens
taatttgtacatgggtctcttgttgttttgggaattttgttctaagacatgttgaagctgtgctgtagttattgggtttatgagttgttggggtattatttatttttaatgtactctgttccttcctcttcccaaagcaaataatcaagaattaatgtttaactttaagttggatccactcactttatattgagagttattattactttaattcacgtttcttttccctgaagccctgatatatctttgggaagatacattttttcatgcattaattattttcttttccagtatcaattgcagatattacaatcacagcaagaaacatctgttgtacctttattatgtgccaggtactgtgctgcctgctttatatgaattattattacgatcattaaatttttatatccacgctagactttacatactgtctatcataactcacattttataataaggacttgagactggggaaataaacttgccaagtcgacacaatttaaaagtggtagagccaagagttgaactcacgtagtctctgactctggaactatgctcttaaaccctacactcttgatgttgaagatgtagggacatctttgcatttgaagacagaaatgcacatacagcccagaacttttcagtgattccaaagacctctgtattttcacgtaacataactttggaagccacagattcgctttgctcaatctattttgttcaggagtacatgcatgctaatttgctcaggcagtagctgaaagcagtgagagatattccaacaaggctccagattgcaagagaaatgagtgtggatttaaaaattaacaggctttgtatgcatataactaagaatcagcttacttgccatgaagatgagtaccaaggccccaaagtatgtatgtcagaaggtaggatattacttggttttgtgtaattggtaataccaaggtcaaatcaacttagataactggtttaaaccattaaatagcttttttggctttagatatttctcaagatttttactgcaagctacgtgcattgcagtctgcaggaaga

SEQ ID NO: 125075 - DNA, 1018 bp, Homo sapiens
tcctgcctcagcctcccgagtagctgggactacaagcgcccaccaccatgcccagctaattttgtttttgtatttttagtagaggcagggtttcaccatgttagccagatggtctcgatctgctgacctcgtgatcctcccacctcggcctccgaaagtgctgggattacaggcgtaagacaccgcgcctggccaatttttgcatttttttagtagacatcttcctctttttataaagataacagtcctagtgggttagcacctgcccaaatgacctcgttttaacttgattatgtctgcagagacctatttccaaataaggtcacattcacagatagcaggaaaggacttcaacgtgtctttctcaggggacgcctttccatgcataacagctgcctctggtccagtctttctatcccctcttcagtggtgtgtccaccagcaaaacttctgtgcctcagtttccttggctgtaaaacggtgccctcttctaggatcgttgagagaattaaatgaaatcatgcttggcagagtatcacgctcatagaaagtgctcagtaggggtttagcttttacagctagttgcttgcagtcatttgatttcataagctaggtttgtggagaaactgaggaagtgaatgagccaaacacaaaagtaaacactgttgataggacaggtggttaactctttcagtgccacaaaacacattctgactcacctgcacacaaattttgcttacaagattgttgtcagcactaattttgctccaagtatttgcttgattaaaatctcttatgctactctttgcagctgacctataacagaaataaatgaactaactagagatactttcttcgttgggcttccatctagagctaagctttacttaggctttcaaattgtaagcaaatgcaaaataactctcttgggaaaattccagagaatctaggccttgagctgttgtaagcaaatgtggccctccttttagggcgggaatctaagaaatggagattatgc

SEQ ID NO: 125076 - DNA, 1093 bp, Homo sapiens
tggaagaatattcagaaatccattgcaatctagttttgataaagcctttaattttccactccttccttttgcaacttcatccatgtgctgcatattcagcccctaagaacccaggaatgaattgatgtgctgccttcaaaacagcctggcgtttaggagttgtgattatattcgagaatctccaggcttgactgttcttagctttgatatcatgaggactatcctcacagggaaagatttatagcatctggggtgagaactttaatcgtggcccaaaggaacttgtgatattttgataaggggcttgaggaagttgttggatatagagcagaatgtatttcggaagggtgcaagcaattttgagcccttctggctgatcattgcaaaatgggtgagcactgggagatcagaaaatatgtggtgggcaaggtagaaagaacgtcaaactggatgaaataagaaaacgggggaaagctatttgagaggaaacttggcatatacttagtatttgtgtctgtttttctcttgaaatgggctgttgtgttggcagaggcttctggctgctgtcagagatatgaacatctgtgctcctttgcagaaaactcaggattctaaagtgtttggtggaaattgtttaactctgccacttgctccatctcctcattaggaagaggttagtctgtactgctcagagtgtgcttttaagaggaagatgtggcttagggttctgggcttcacttttacatactgcatggcagaagcaggtttgcagcagtgaaatctgaggccatcagatacaagtgtgtagacttggtgtaaatcagtttgcttgcttgggttggaagtaagaatgaaagatgccaaattagtaaggcagttgtgatacaggcatccgaagagagccagcaagatggacaggtcacgtgtggctaagttttggaaggctttgctttagtcactgtagttaatgctaaaagctgttataaatgaccccaaaatatcagtgacaatacaataagagtgaagtatttgatcactttaaaatgcattctcctattcccctaattaattctgctgttcaccaagtcttcta

SEQ ID NO: 125077 - DNA, 1030 bp, Homo sapiens
attattattattattattaaaaatatataataattattagttttggtgtgggttactctttgggaagtttaaaacaaaatgttccaagaggtccccagattgaaataggtctcttggtcacccttgctaagaaacccagttctgaacagcattgaccttgaacactcattacaggacagattatttgtgaaatgagtaatgtttgaaaatcatctctgtaggtttttcggcattgctaaattgtgtcattggttggaattttcagatcacaaccatattttgattcccaggcttttggccattttgctaatgtgccagaatctctaaggcctagcccaattgctaatattgacaaattcttgaggagtatatatggtttgttcaggaataaaacggataggactcagaatcttatcagctcatacctgtaggtatggggcaatccatccatctagcaattttctaaactatgtagcctactgtgggatactgaatccctgcccatgagtactgagaaggactcatggaaggatgatagctttctttgcattatttgtttctagcataggaaaactggctaatgttcgtacagtatgagaagtttttagtccactggactggagattcggagctgcccaggtggtcagtgctggcaggaaaaggtaaagaagatcaaagcatatggcttttctactttgcctatctttttcttgaaagaatttatggctgatgaagaccattttgctctggaggaaatgatgatctgttggtggcatgcacctggcctcttagtttgctttgttgtcctgggaagtgggcaagtgccccactggaccttgatctgcattccacaggggactccctgctttagagggacccctacccatgaggtccaaggatgaccacccagcgtagcccccagcaagtactcacacacacttcctccagagcagatcatttagtttaagggaagggcatcatcactttcagagatgggtgttttagtgattagacatgcgacttctctggt

SEQ ID NO: 125078 - DNA, 1401 bp, Homo sapiens
gtatgcagggggtggaaaccaccctaggactttagtccttggctgggaagagactgctgcctttaactttcaggaaagggataggagtattttaaattcttaattgctactgtgtgcctggatttgttccagcatttgatttggaaatattctttatttttcttctttttctttttcaaggctagtcaagtgaagtagtgggagtggagaaggaacaaagaaatctgtaaatggttaagatcaattagttgtaaacacctcggcacttggaccaaacggaaatattcatttgttaattcacaaatatttattgagcgcctgctgtgtaccatgtggtgtactaggtgatccataaacaatggtgagcctccttccaagagaaaaataggcctgttgatttcatgggctgggctgcttatacattagaggaggaagtttgcattgatcaaaggatcacacaaataagtgtgatgtttaaactctgctaagggctgttgaagggggagttactgatgctcagggcgcctacaacagggagattaatgtagtcagggaggtcagggaggagggtgaaagaattttactgggtacagacaactagcacatgaaggctgtgtaaaaggctgaccttggatgttgcaggaactggggagcagagtgcctgaggcagggagcactccagcgtggattagactggagaggaggcctgattgggatcatggggctgagcttttatcaaaagggcaaagggaagtgactgaagagttttacccaagggagtgacgtgatctgatttatgctttgaaaagatccttctggcttcaacctgtaaattttacatcatttaaaattggtcacaatgtgactgtacaatcactcctgttagaatctaaccatttctaaaagaatcaatttagccactagtgtcttctttaaattttaaacagcaatttaaaggagtgatttagcatgggtaatgcaaccacttaggaatgatgaagtacctagttctgtggttctcagacttcagaatgcttaagaatcactggggacccaggaaacagcatttttagcagcctctcaggtgatcccagtgcacgtggtcccagacttcacttttcttttctttcaagaagcatcatcctacaaagtggtgactaaaaaaaattataaacctcaaggtaccacctaatgaggcaaccagaagaggatggaacctccttatcgcccaggtttgaacctggatctgttctcccaatactggggggattttctttcagtgcacccaaaatggattctaaatcctttgagttacttttttcatttattttctaatcctttcatatgcagctgttttctcagatctgtggctcactctctgtgtgtctctgatattttact

SEQ ID NO: 125079 - DNA, 1043 bp, Homo sapiens
gactgttgaaatgttcattggcaggtgggtggttgtaaattgttaaattttcttctttaatctgagccagatgatcaagctgtcaaccagattagaaattatcctgggaataaaaatagaaaaataaaagaagaatgtctgtagtcccaagtgtacagacccagtgtggccccattgtcccagcacgttcaattacaccagctttcactttccaagtgcagtgggttggacaattcattttatggccacctaagtggaagccacctgcttccatttccaatcgctctctctggatgtggccggtttgtttgggtgctttttctacttattgcttcttcagaaaggcagcaactagcttacaggcacaccagctcattaagcagtagctcatgtacccattaaacagtcacttagtaacagcttttaaggagtgggttgaaaagagagaaaccttcatctagacactaaaatgccctggatagaagtatgggtgtcagagagccatgtgccaaacagaaactgcttctccaaattagtgctttgaaagtgataacttttggtctccaccttgacttccattactatagtcatgaaaatcacttgtctaatggctgtatgcatatcttcattggacctgacaaatatacagtcttcagtgtgaaaaatttctggtcactttattttacctaggagagtggtaaacatgggttattcagcaactacagtgtccgctgtgtagcaacgcctcttttctatatatcaggattggtgtgtaccttgaaatagaatccaatggtaaatatatgtttaaagacccataagaagacttagataatgaaatacagatctacagtaactcactggagagttatgttcttaccaaaatatctagcagcttaaaagtgatttcaaacatgtacccattttacagatgagggaattcaggtgtcagggaagctggctgcccaacttcacatagactcaaaaccataccctcttttctgcagcataccatatggtacatacccctgctgccaagtttt

SEQ ID NO: 125080 - DNA, 1066 bp, Homo sapiens
agctcctcataacttttgctaattctcttgttgatagattcataccaactaagaaaaccagagactggagtcctttgaccgtgatggtttctcctttgggcgatgctgaggctacttgtacggttctttttctacttgtaggctgttggccattttactgacccattatttcaggcagtgtcagcctcagtgctattgacatttcgggctggataatcctttgttgtaagggctgtcctgtgtactgtcgaatgtttactgccttccctggcctctgttcactaatgccagtacattagtcgtttgtgacaaccccagatgtctccaggtattgcagattgtcctatcaattttcctgtccccaagctgagaactgctgctttgtcttcctgtgttagtgagaccagttgtgtgttatcagatagtctagactttcaacagcagttataagtgccccagttttctccttactggttattccttagagtctaaggtggtgtattaataaatgagagggctcaccctttatgttcatttctttcctccagctctccaagtttcctttctagctctcttctctcttatactgcagttgtttctctaatccaaatgtttttcaagtttcctttccatgcatgtttcttcctagtacctgtggctgaaaaacactgtaactagtgagtttttgtctcagtttcttaacaacgttttgaattctgaccactggttactgccttaactgtaacctttacataatggcaataagataaatgaaatgagggaggtgggtagcaaagctcagcttggcttgttcagaggcctttgtcacaagacaaaggaaatgtctgtgtgggaatgagttaagtgagttcagtgcctcctcctttgcttgtcaaatccaccttgactagttggatagtaatggttattgatattccattagtgcgaccaggacattgtagcaggtcagggagaagccttcaaggtactgctttatgcgaagtcctttcccactttgtatattagatttctgtcctaatcttgccatgttaactttcttatgtaa

SEQ ID NO: 125081 - DNA, 1022 bp, Homo sapiens
ttctgctctcctacaatatggaagtgaagacaggaggctgtaagggaggctgtgtggcagatgcaggggagatgagaaatgcctaggagaagaaaaataaaagtgagaaaacattaaggtgttctgcaggtgcagctaagtcttgaacatttactaaattactatattgaaaagaagctaactcttgagtgtttcaaagtaatttaacccctttgggtgtttggtgtgagtgggtggggcgggtggggaaagggctttgaagcctttgctgaaggatgtggctgggggtgaggcaaggagctcacctgatcacacactgtgcttacttcatcaggttgcctaatgctcaagggttaaaggtgatcattcctatggaggtaacatttcccttccagatctaagacagtggatacaattaaggtttgtaactcaagcttgtaaccactttttggtgcctgaaaccatccaagtagatagtttggtttataagacattctgttgaatctggaaaacgtggtggattaagaaaccctctctgcatcacaaagcctggagtgtttgctactaattgtgcaactttagttctggttccttctagtcaaccagagaagtgctttttaagcttacggctgtaacccatgagcggatcatgatatcactttagtaggccaagaccagcagtttaaaatgtgaaagagaagagtggtgtggaaaacagcatttcataaaacagacacccagtcttaatgtcaaagtattgctcagtgtaggtaacgattttaaaaagcctgtttcaataattctggggaaaactacatttttaaccaacttgccagggattctgatgacgacgttctagagggctacaagaaatacttagctatctccttttaacaaaatactgttggtttaaccccctgcaggagatgctatttccaaatgttgaaccagatgcagttctgtcggctattgacttaacttttcaaaatgctactattggccgggcgcggtggctcacgcct

SEQ ID NO: 125082 - DNA, 1067 bp, Homo sapiens
aaactggagggtgtttggaggcatctccatgggtcttggtgaaaaaagaatttttttatattacataattgtattaaaaaatgaatttgtataaaatttccgcatggaagctttcaacatttttaaaaagagaaacttaagctttcctccttgaacataattttttttttaagtcaggctttatgcatgaaatggttacatgcaatttctggtcaagatttaaaatgatgatgtctttaaattcttgatagtcaccactgatgaaaaccattgctgtcaaggtaggtaataaaaattttaaaatcatttaataacaattcaaaaatgataatgagtcaaaaagctctgttttttcattgacaagcgttacattgaaaataccttgctaacgcaactcaattttaaattcaatcaaacatttttatatcaactgttacaaaataatgaggaagctctgatttgctgagtaggcttgcatggctagagtagtcaccctgctgctaaatggatgtcgtaaaagagaccttctgctacaaactgctggaaccattcaatttagacctctgactaatgctacatcttccagtatcctgtctgacctcccagcaaccagccctagaacccaaaaatgagacttctcagtttgtacactttgagaggagctaccccactggtatttagggaggaaaacctagctgtgtcttggaccaaagggctgctggaggacttccttgtttgtgtggcacaagaggtaaatatccaagttggagaggatgtctttcttactcgtagggtgttgtggatgggaagcatgaatgggattttgttcaaggggctcccagcctactgggtgtcttgctaattctgggtctcctccacttcagccagtactgaagagcagtcaaaagctacagcccagagggtgctgctggctagaaagcttggctcaccttggaatcatctggatgttttaaacaatactgatgtatgggtcttatgccagagattcttttttaattgtatgggtacagcctagggatcaggatttgtaaaaaacataccaggta

SEQ ID NO: 125083 - DNA, 1067 bp, Homo sapiens
atggtggatgtgtggattatggggtaaaggattattgaataatttttttacaatttctgtatttttagctgtttacttttgtaataaaaatctgtttactaagataattttttttcaggatgatgcttcttgaaaattgcttagttgaaaaatggagagatcagcttagtaaaagatccatagtaagtatcatgaacaatgctgtgaagatggatgtaagtgcacataacagatttctttagagttggggaattcttcccattctctaatctccaagctctcataagagccagcaatagcaacagtatttgtcttttgaataggccgttaagagtgtagctattctcactcagaatttttaccaggaatctatcattcgacttcaaaggtgatttagttgtgttcaatactaaggtactggttatttccaagttaaatgagccttttgtttctttattacatgtagttgttttagtgaaccatgagatacttgagcagacttaatatctattgagattaaaactgacatatatttggaggggtgaaatatctagtactaaaacttaccctatcactatacacagcagaatcttttcctgtatttataataatttaagacttttgtcaaaaattatatgcaaaaagtaatcgttttgcagtcaaatctatgatttttgtggtaacatcgtagaaatattggtaattcaattagaggagttagaataattttttcccagagatgtgaaattataccaatctaaagacaccaggtaattggttttaaatttttaaagcatccttctttgcaaaatatgtcatatatattcagaagaatttgtgtttataggttcacaaaacatattgctattgcctatgctctcttagtttgcaccaataaagagatccaagcaagagaaaagtacatattaacaattgagttatggagaatgtagttagaacacagcctccgctagtcagtgcgtttctgaataagagaaccaaacactattgtgttaaatcagagctaaaaactcatgagctgctcaggagcatgcttagttctatta

SEQ ID NO: 125084 - DNA, 1105 bp, Homo sapiens
ggcctctctttatggcatttgcatcattaggagttgcaaagtgaatttccatggtttgaaacgccaatggactgtaagatctatagcaaaagggcaccattagtttatagaacaaaaccaaacttgataatatcatttattctaaaagcatttgttcaagtattaggcgacttgaagaaagtacggaaagggcagaccctttcaaacaatatcaagggtgcaaaataatgcattatgaaatgcagcacagagcagcacagtcatcatggtggactgggaattgattcgaagtctttcaagaacatgaatgttttcagtagggtcttgaagggcacagtaataataataacaactaacagttgcatacttattatatatgaggcatgacactgaggactttacatctattatataatttagtttaaatctcacaataacttgacagtataggttttatgatctccattttacagacaataactctgaggtctagggagattaagcaactttcttaagatcacacagctaatgcttgaggaagctaggggggggttctgacgcctatggtataccaggttcacattcattcatttatttaacaagcatttgttcatgttaggcactgtgtataaacagaatggctcctggctttcagggaggtcagagtctggaggtgaagtcacataaataaaaaaaatttccatacagtgggatgaggggtgagagctggggttgtgatgagaagaactcagttgggcacctaacccaggcttcctggaggagctgaaatgagagtgagttccaaaacacctgtacaggttttccagggagatgtggagagactgctggtccagggggatgcaggtgtatccatgcctggtatgtgtgtgccatcccggagtttttagagctgagtaaattccaaaaaccacagaccactcactattagggctgaagcccaggacatggcgaagggtcatactgaggagttttaaacagtggaatttgtgattagattatataaagatccctggatgtgtccttaagaatgcattcccaagatgtggacacaaaatggagccatgtggagcaaaagtggaagtga

SEQ ID NO: 125085 - DNA, 2037 bp, Homo sapiens
tctacttcaatgagtcttattgctggcatgaggaccagcattctcaaatccaccagactaggtcattctctccctgtagtcagaactatgtggggagccaaattatcatcaggcagttgtgagcaaagagttggagcaaattcattgagcaaacatctaatgattgcctgccctaggttaggctgtatgctcaatgtggagttttccatcatgaataagacaggccagcctggggtaaggtttaatggtaatcaggcaaaggcaaagtgatgcattgattttcacaatagagatgacttggtggtggttctgtgctaccccaactgtgctgttcctgaccccttccactcagaatggacccttggtgagtactgctcaagtctgtctgagcaacccttcttccatgactccatgactgactaatatagcctttagatgtgtgttttatacctttagtggagtcacagccaactcttgctggcttagaagcatttttgtccctttgcggtgatttctcattcctctgccctaatccaataggtgctggtttcacagttaaacttctaaaagacattgttttccctttctttccgagttcttggcaaggttctttctgacagtcacatcgctggccctaagtcagatgtggaaaagaatgtttaatgcataaacacatttttaagctctttaagtgtagatttgttggaacaaactcagaaactttttcaggtattaacagtctggccaagcaaccagatgttatttgaagaaaatatggatgagttgtctcttcatatttatgagtaagttgagaagtaagttttagaattggatcaacttcttaagattttcattttgcatccagatagttatggaaaatcccattgatagttactgtggaatgactaggattttccaggctctgttttccctgagatgatggaaaagattaaacaactttacaagcttcagataagacaagcctgagcagcaaatgggaaatattagtaattgataccattttattttctaattccaactgtcttttctgactccttgattaaattcacaagtatttatttgaaagactgaaggaaatcaagaagatgattttcatatttcaggcagcatgttgaactttataggggaagcagcgttgatacacaatgaaccctctcaggccaccagtaactataggctcccccttacaaaatggtggcttgggtgttggaatcaatgaagctcttaatgcagagtgagcagagaggcagtaaaacaatatgcacagtctggtatcttggaatattatttcatcaccagtcgtacatgttctattaaggatttgtatttgtaaaacatgaaaaatatgtcacaaatggggcagcaggtggattcttattcaaattctgattaattcatgtctgcttctcttgattctcccagagcatattatttcttggagaagagaatagcattaacctcttttttaaacagagaatcagcctcctgtagtggagagagcaggggcattcatgttagaccatgatggagtgacaaccatggcttctaatcctgccttcaccccaataaggtcctcaacattgcagaacctctgtgtttttcatcttttaatttaatttgaatgatgcctacaatgttgatactaaatcacttttaggctttcatttgttaaatgctaggtacagatagtattaaatgatatcctgaaggcaccaattgtacttttattatatcaggctgattcactgtttctaatgcaatgaacttgacacagattttaaattttttctcaatctgtcccattgtgtagacaaattaattcaaagttctttttcttccttctctttttcatctaagcctgtgcttatgagtagaaaaagagaagaggctaccttgaaatgcctcgggcccaaactcagaaggctctgcactcaactgagcctcccttcctactaagaatggaatagtgttgcttataggggtgttggtccaagtatcagctgtggatgattaatt

SEQ ID NO: 125086 - DNA, 1045 bp, Homo sapiens
acatccctccccacacacactcatacatatatacacatttacatctatatttatttctgaacctccagttctaatccatacaggtgtttaaactgatgccttcattctaatccaacactacatggttcattctagttttttttttcctttcatttttgctactcccttctcagccagtgagaaaactggcttactattcaattgcagtaggtaaccagtcatgtatcattacgctgtctccttcacacatgggctctgcgctccaggccagcccatgtagaagcctatcttccttggtcctacctagtggctttagtctaaattgttcaagagaaaggagtagatgaaattatgttcttaacatatgtttgtattgcttttggattctcagtatgtcatcattacaaatcctcagagggtgtttctgtgtgactgggggaggcagactaatataaagtgctcaataaatctatttgatcatgaatcttgtcttgcatggattggattttcattttaagaaatcacgactttgtgaatattaagagcatgacttctcctttgacctttactccatcattttggtctcagatggctggagatagcatattcttttgtgagctgaggaagtcttgactgcttgtggcctcctgatcctcaaagaataaaccatactgatttgcaatacttgagtttcgcaatatttgagtttttcttcaagaaacagattttcttggaagcacacaaagtttgatttaagggacttaattcagtgtgtctatagaccctggatttcagacaattaatgctgagatggggagggagaagcaggcactggggaaaaaagatccaaagaagataagcccaggagagtaaggaggctgatggaatgtaagacaaatttacgaatggaagccagaggtggtcactatactgctttgaaaacatctttactttctccaataaccttgagctgtttcttcctgattctgaccttgaggatggtggtcaggggcaaagtgcccaaagatctgaaaatattccacca

SEQ ID NO: 125087 - DNA, 1068 bp, Homo sapiens
tccttagcagggtgcctaagttaccctcagtccccccaaagaaaggagaaactcttgggatgatggctcccctaaagaaggcaacttctcctggaggaaaaggatatacatgccttggatgactcctgcccgctcacagaaggctgcttttgttgtggcttaaagttagatcttctggtagagttctagaatgtgggccctgccgatgagtgacagccaaaagctcaccttggaagaggcaccagagtcacagccccagctctctcagggaagacgctgctccagagcatctcagaagccaccagggaagacagtggcagatgggaagccggtggtgcagggccaagggcacagctctgcctgacgcagcattgtcagcaataggtaacatataacttatgaggagtatctgagtaccagcaggcactcttgggagtgaaggatgggggaagagaatctgccccagacttcatatccattggaaatgccacatcaggtgctgtatcttggcatggattgtgtttcctgtaggtgtgggagttcttcttctcacagtcaagccctccacctgtcccttgtcacacaccctgtccttttgaatagaaattctcatcctagcccagcttcaggcacggcctggcttacccttggaccccagagatctcacccttctgaggtctcaactctccttaaggagttaggaaatgaagcttgggaatccacttctcggacatcagaacacagttccttttgcacaggacaagtatttatttaggttccacttagtatattgaaaagaatttgaagtgttttggtggtttgtagtcctctttcatcatgctgaatcaagcctcaaaaaggtcaatttctgcagttgttaaaacacagaggaatttttatagtgtgtgtgtttgcataagtttataaggagctttgtcacaaggtcttctgttttagagaaacaagccattttactcctttcatagttcactgcaatttattttatactaattttcgtatttacctttatttcaattcatgttttagtcagctagagaaattattcaa

SEQ ID NO: 125088 - DNA, 1010 bp, Homo sapiens
gaatacttttgatttagggttagggatttttccccctctcttttagttcaaacatgggtggacattgtggaacttttctttgttcactgtgtcatttgtcttctatttcacagatggaatcactgaattcatcacttgacacagtactagtttggataagtttagcaaggtaaccaagtaacgggtctaattaaatctttactggaattagtccagtttgccacatttccttgttaggaagaattctgaaaggtaattcccgtctgtataccatatctacccatacgcctctttctagaagcaggatctcacaaaacgacttatggtatccttgttttattgatggattctgataaggtggtggattattcatgttcataaaatgaaaacatacaatatgttgtcgtgtagaagtcactgtctttaaaatctaactgtctcaaacattggtcttttaaaactgcattattgcattgcctaaaactgcatgaaagaaatgaaatgaaacagcctctgagggatattaccttacttatgttcacagaaggatggtgattaacatcatttggatttattcaatggacagtttgcctgagtgattgtctatgccactcattgttttaggttttagagattgagtagtgagcaatttagataaggcccataccctcaaagactttaacttttgttggagaatataataaacatgtaaatcaaagagacaagtttagataggaataaatgtcagaaaagatactactgggtagagagtttgagagtgactgggttgtatggagaaatgggatggtcagggaagacctccctaaggaggtaacacgaggtgacattttgggtgatagctgaatgtttagctgagtcagccatgagaaaatgggctggaagtttctaggcagatataaacagtgtaaaggagctaaaggaagaatgaacttggcatgttccagggacagagggaagcccgtgtggctggagctgagtgaacctagggg

SEQ ID NO: 125089 - DNA, 1034 bp, Homo sapiens
acatgattcacccctcttagtttagagctagggctgtggaggcccagagaaggtcagtgagttttaaaataatgcatctaatggccaaacttctatcaaattttcaccctgctcattttcaggctagtgttttttctgctttattttcttcatgaaagtcccctatcaatatatttctgtacatataaaaatataatatttcaacagcatgaatttattgtccataaacttgtaaaagttaattttaaagagatgagacattgcttcttcttgggctacaataatcatttgccttattttccttcccttttctgaacaatgaacaggtataaactttctggatgaatctagtctctgttaatagaaagctgtggtttaaaaatgacttttaaatttttgttttaattttagaaatgtttgaaaaggagtttaaaatgtgttactattttcctagccttaatcttacgcttagaagtatgggaatattgcctacagtttgctaactcatagtttctcttagcaagtagagtttcttcctgttattgaggaagcccttaggtcagtgatataacttctttttcttagtaatatgttatgtttaaaaataagtcaaaatcagtttataaattaatatgaataagaaagctgttaacagtggtcttaaaatttaaaaatgcccattatttatttctaaggtttgcatattttagtaattatgagtggaatatggtagatgaataataacagactaataaatagcttaatttactttctgtatgtctttttgactctgctgtaacttaatagaatttatctttttctttagaataattttaatggaattagtatcttcttttttaaatattggaaggtacttaagtttaagcaaaagagagtttttgctctttaggccaaaataccaaacctagacatcctggctatctctattctttaagatcgttcatgcaactaatgcccatattctgaagacccaggtcatcatgatttgaccaccatcttctgccatgagccta

SEQ ID NO: 125090 - DNA, 1050 bp, Homo sapiens
tccaggaaagcattcagtagatgattttctagcccatgcacagttatacttacaggactgtggaggttttctccctgtcacagcaaggtaactgagtcgttcaccaagaggtttggtccaggtcatcaggaacacctttcagttgtagctaacatcctgccttcaccctttcctacagtcagtttgcttcttctctcttgccattctttgctaaaacagctattttgtagtattgctctaaaacattatgtgttgcttctcatttctctttctctttatgtcttcatgaaaacataaatcagtcaaggtactctgttgttcagttagagaaatagttgcacagtggagagggttgcacagttatatttgatcagcttggatttaacatggtgtctcttttttatttcccaaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtaagttggtggttctttcataactttttaagaagtgtttccagagacaacagggtttttttgttcgtttctcttatcatttgtttcatttagtaatttccatctttttccaaatgaagccattgcttttctcctcctgatttggacctttcttgttctttaatattattgtttaaggcaaatgtgatcagtttaaaactcatgttgtctggggttttgaaatttgaattcctggtattttgctctgtaacaggagttgacaaactataggctgtaagacaaattcagtaggcctgttttaataaagttttattggaacgtggccaggcctgtctgtttacatattgtttatgg

SEQ ID NO: 125091 - DNA, 1181 bp, Homo sapiens
ccctttttcatcagtaagaaaatgcagagacttaggccaaacatgaaaacgcattttgatttgcttgttttgtatttttcatgcttcatatccagtctaaaagtaagtcctgtcaaatctgcctctaaaatatattcaaaatgtgaccacttctcttcttttccactgtttctccttttccactgtttcccttcttttccactgtttccctttcttttccactgtttccagcttcaaccaagccacattatcactcatccaaactgcactcctggctggtcgcctgcttcctctcaccctgcaatccattcttctcacagtagccagggtaacctgtgaaaaacaaaagtcagatcatgtcactttctgttacagctcttcactggcaggccatgcttttagaataaaatccaaatgtcgtactttggcttgcagaggccccagaagcctctcagacttcctccccaccctctgttcctggctcacggtagatgagcacacttgccttcttctgttctcagaaaggaataagctcctttctatcttgggacccttctactagttgtttcttctatatgaaatgattaatttcctttatctttttatagaattcaacttcttattttgctagtatcagtttaaatgtcttcattattctgtcacactgtcctgcttctgttgtctgtgtagcatttgttttcttatttgctatctctctcaccttgccagaatataatctccatgaagacatattattttgtttactgaagtatttcctatatttagaacagtgcctggtgcgtagtagatgctcagcaaatatttggtgaatggataaagatcattgtggcagtggtgagcaggtgggacagattggcagtaagaacatgaattcggaagctgttgcaggaatgtcatggaaggcggtgggaataggaaggaaagaactaacctgagagtcactaaaggaaggagtatgagaagacttgttgataggccgattttatcatccccagtatgcaaagatgactctaaagtttccagtgatgaactctagaagagtagtaccagaactgactgggaagggattttgtgtgaaactaaagatagtttatttaagacatcttgaggtagagacaaaaattttgaaatgaggatttagagtataagttagggataga

SEQ ID NO: 125092 - DNA, 1035 bp, Homo sapiens
ggaataatcattcttataatattctggatgttgacaagtttccttagtccggagagacagtaatgagactaaatggttgggtgtctttcaatcattattcctccttcctcccaggttttcaattctattcatttgtagaggtctgtagccaagcaggtctacagaggatccatactaattacaaagaaatgtagacctccttaagggattttcgggcacaggatagtatttatggtatgctttcatttttgcataacaaatacaaatatgtgaaatgatacctaagctaggaatacccttccctatggcaactttcattcgaatttgaacctggcaaaggtgttccttaatgttttccctcttatccaggtctctggttaactgtccttccattggtcctcttttaaaccctctgcatttgtttgctccctctgatcaggctaatccaggggctctgacagttaccctgcttgggtgctgcattagctgccgacacatgtccccttacttgattttttaaaagtattatgctccatagtttcatttgtcgaattttgagctcgataatacaagatttattttgacagtagcattgggagaggacagaaagttgtatcaggtttgagtctagtactgtccttatttcattatctattcatgttaaaaatatatttaaattgataaaagtgcagaatctttaaatgccaggagaaataaaaatgagaaaccacagagaatgtttacacttctatcctgtgtcatgctaatggccatcattgacgtttgcccggatgtcggggagtcttggccttccaagacctaagacagtggagcgtgatcagaaagtaaggtagtcctggataaaggtgaattgccttctttaaaaatatacttttgtatgatggaagactttatcttagaagggaaaaaataattttcttaacattttaattttcccaactatgaactacagaagccattatttttcactatacatttatatctgttgagtgaatgaattcagagttgaggaat

SEQ ID NO: 125093 - DNA, 2095 bp, Homo sapiens
tttcttttaattccccacccattcaatgttctctctctctaaataaggaattgtgtcatcatctcaaggaaataaaagattaatgacagataagggagggcaacagaaggagccattcctattttcttgttggagagcctttattctttcaaatggctcaaatagaacccattgacatatctagtcactgaaaggaaaattcacctatttgtataataagatgatgaaaatgacatcttttttttcttgccttgttttttctttcataatgggagattaatgtgagacctaatttgctattacattaagttgtagagcagggattcccaaatgctggtctacagaccagtgccagtccctggtagtctccagctaaatcacagtaatgaagacagtctggtgagtttttcataaagctgtgtcatttttgtatatattttttaaaacatccctttattttcttactttcagcttctggcagtttttcgatttaaagtgttaatacttgcatatgctgtgtgcagactgcgccattggtgggcaatagcggtgagtatgccctgcatgagtgggtcatctcctccagtgctggtggccaagtcctgctctcaacaggcctgggctgggagaagatacagttctaatgcaggtggaatcccaccagctttcctgagtcccgtttcctccatacttaagtaggtttaatactccagggcttctttccaatgttaatgagtaactagatttgtctcttggtgctgagccaaatgaggaatctagaagcccaacagtgattattggccaagcaccaagccaccctctacctcattttgcaaataagagatgagaggagacctctgtcacagagatatttggaaaatgtcttatttggttgaaactgcttagtgattgttttcatgacatggtctgtacttatttaggtaattgccttaccccctcctttcttccccacaaccccctgtcttggagggaaaagctctcagtctctctgttgttgccttggacttctcaaggacaaggacttttttactcctctgtttcctggcatctagcacagagagctttggtattcttaataagtatttagagattgatagaattactagcagttctgcctgacagatgtctgaatatttgccttttgtaaagctttaataagtcagttctatgggaagaaaatgtggagctcctcagactagagagagctgctcagaaataacctgcagttctgcaattagagggtgagagctcgggtctgggtggcccaggcctgggtttctccagctgggaataggacttgtgctgccctcctgagtccactagggggcgatgtctgtctgggccatgtcttctgagcattctcagaatcacggggcagcggtcagaccatctgttaatccggaagctctcatttcatggatataggctgacagtcttggccagacttgactccctttcctgaatactcttttgctgatatcatcatagcttttgatgattgtaccctcccatttttctgcattttctacaacagatccctttgggatgttgtattcctgagtccccatatgtatgctagtatttgtcagactatccctctcaatgtttgttttagaaaagtgtttgacatatagatattcagtgagagctgtaagacagtatcttcaatatctgctttcagattatctgaagaataagtctaatttagcaaatcattttattgcttctgattcttgttttaaaaaacatttgcagagaagagtctagaagctggaaggaggagaagtcagctggtatttaaagagtgcttagtgtgagcctgtaaagttaattagtgtcagaatataaaatgctaaactgcctcctctcccaagcagctctgtgtgtgtgtgtgtgtgtgtgtgtgagtgtgtgtgtgtgtgtgtctgcaactttgttaatacttattgagcaagatacttggtgttccctgtcctccttctgtcagtcaagctactattggtattcattttggtcaggtttcaccatgctaaaaatattagttgaaggaacagtgacaaggctcaggtattat

SEQ ID NO: 125094 - DNA, 1930 bp, Homo sapiens
ggctttggaattgtaccttctggtggatcaaacttagttacctagcacaccagcctgctgaaatgtgggagaataaaccacacacagtcatttagggattgtgtcacatgtagaagcccattttgccccagtgtgggtctaggggagagagactgagtgatatgggaaggagccaggctaggcacaggtttttcaggccttgcctgctcctggctcagacgggtctcttgtgaagagggaggtaccttcacagtgtgagatgcctagtgtgaacagtgctggattatgtgtcttgcagttgacaacggcagtgaccagtgcctttttactagcaaaagtgatcctttcgaaggtatggcctaccactttttctatacagttaccatcttcagtgatgaagcctcgtttttcagtgtgagtttgtggtaactgcatttccctttcctggtcgtattttccagcttttctctcaaggggcttttggctatgtgctgcccatcatttcattcatccttgcctggattgagacgtggttcctggatttcaaagtgttacctcaagaagcagaagaagaaaacagtaagttcctctcaaagtcagcctcctgaggcggactggataccaagctgggaggaagagatgtggtttcttggtgtgaatggggctgcaaatgggtagagttaggcagtggtggggtcttcattctttagtggctacagcagaaatcgagagaagggttgggtggatgaaagggtaagtaacagaaagcagctcctctctccagctatcaggccaggcttcccctggaagaaaatgtgaacactggtgaaaagggcattcaagcaataacaaaaaatagccagcacttttttctccccagacaggttgttcttttctccctgttagcaatagacaggacagtaagcattttgtgcatgtaaacagaactgtgctgtttagggtcagagaaaataaaaccaattttaagtgagtggaagcaactattctaaatacaagccagtgattctccaaagtctcccattgtgatccatacagcagttggtggcttcagatgggcctctgttagaacagttaaatgcctagggctggggaccattggtgggtttaggatgaagattattcacaggaggatgacagcaagccagagcgacgctcagcctttcaccatcctctgagtagctgagtcatagctaacaaggtgtactcatgaatcctgccaaagctgctataatctcatcatggctttcaatatcccagaatattcactaggaaggccaaatgattgattaagctttatggtaaattaccaagctgaaattcttctccacataatgtccttaatggaagcccacatgccccacccacccatcttaaaggtgaaacgatcaaagctcatttcagacacccatgcagtttcaagacatgctgtttttatgcctctgctggccatctggctcaatttgccctgcctcataggaaaaaaaaagtatcttatagaaagttaagcatgattataacttcaaaaaacagcaggatgcaaaataatcttgcaagtggttttattttggaaaatctcatttacatagaagaaatatataagaaaaggataattcaagagtagattttaaaaacccattaatcagactgagttgtaccttctatcctgtgccgtctattcctttgtgaaagtgtatcttggagaagttataagtaaagctaatgaaagtcttttttaattgtatataaatataaaactgaactttgttgaaaacatatgaactattactatgactgaggcttgaatggttataggattaaaccacattcaaagtgactaataaagcagaacacacaattaatgaaaattttaaattagcacttattttcattgtcagtagcatgtatgaca

SEQ ID NO: 125095 - DNA, 1036 bp, Homo sapiens
atgtacccaaaggaaatgaaagcagagaccacagcagatatgtgtatacccatgctcatagcagcattattcacagtagctaaatggtggaaacaaatcaaacagctgtcagcagatgggtggataaacgacatgtatgtacatccaatggaatattattctccattaaaaaggaatggaaagctgggcacagtggctcatgcctataatcccagcactttgggaggccaaggtaggaggatcgcttgagcccaggagctcaagaccagcctgggcaacatagggagaccttgtctctattaaaaaagaaaagaaaagaaaagaaaagaaaagaatagaattctgacacatactataacatgtatgaactgtgaacacattatgctaagtgaaataagccagacacaaaaggactgtcgtatgatttcacttagatgagatacctagagaagtcaaattttcagaatggtgatgatggctgcacaacagcatagatgaactgaatgcactggatggcatgcttaaaaatggttaaagtggtaaattttatgttaaatatatttttctatggtaaaaaacccactatttttaaaattgctaacacttttttaagtgtcaggtgctgttctaagctttattaatattcactcatttactcctcccttgtctgcttatcttctgagatacagatcacaaaccatagtgtctaatcactcctccattacatccattttttataagtctgtgtcttaccactaatctcttgtaagattgtgtctaacctattttcatattcttaatgcctggcatattagatgtttgctaagtgcctccactctgtgatgtaaaactcgtattatccctaatgtagagatgagcaaatgtggcacagagaagtgaagcaatttacccaatatcacactaataataagtggtgtagctgggatttgaagctggggtccagtgctagagttcatgcttataactgctaaagtatattagcctcttggtgtttatgaaaatatagacttggtca

SEQ ID NO: 125096 - DNA, 1082 bp, Homo sapiens
tgtgatctcatggcatttaaagttttatttgctatacatttgcttttaccttacagcgcatgcatttttcatgttataaattctatataaccataattttaagtggatacaagatatgttatggaactacagtattaacctttcttctattctcagacacttagctttcttttctaatttttagagagaaaatctacataatgaataataagcattatttcctcagggataggtctatcctaaggaaagaattccagagcggaatgaccaggtcaaatctaggaatatcctgaagctcatgagacattgatccagaagggccagactgtggtcactgccacagtgctctctcactgctctctcgctcgtctgccacagccattgttagaaacacctagattcaattatttgtaccaagctcaacatttttgcatgtaaaaaaatatatgcaagcttgtcagcaaagaggcagaggaagaatagtgattgataatagttattggtctgcatgaatattcttagtacataagtgaaatccattttgacagattagtgtaagtgatagattattgtttaaaggttttcctgttacaagaaataaataaagctttcaaatagcagttaacctaaatctcttgaggattaaacatatgtttaatgtttttatgtgtatatgttataattttaaacctatttatttaaaatagtttgttactgtaatggaatgaaatactttttctttgtccccttctccaccacgtaggatctgaagaagctgaagaaaaacaggacagtgagaaaccacttttagaactatgagtactacttttgttaaagtaagtgtttgaaatgaaaccataacaacaaagtagttaagtatggagatttcctttgagtagagtcaaagtagaattcaaagaataagagtgtaaggatagccagagttatcttacttgcatgaatttatcagtcacattttattaatgccaagtgtcttaacattttttatacaggtatacatttataaggttttgaaaatacctcagatttctaaatttctaaagaatagagatgaatttatg

SEQ ID NO: 125097 - DNA, 1018 bp, Homo sapiens
ccaccacagtcatgtagacgcgaagcaaaaatgtgggcatgctcgtagttgagccttttctaaaatgttttaacatgaattctaatgtgaccacacgcatggtccttcgtgtgtctgtcacagcccctcttcagcacacagacttttatgtacatgtaaggtgaccgtggcattttgccttttaatgctatttattaaatacttttgtcttctctctttttctaagtgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattatactgtgtgctgttttttcaaacatgaatattccccttgactcaa

SEQ ID NO: 125098 - DNA, 1035 bp, Homo sapiens
aaactggttgccattgtatataaggtaggatagggaaggaaggaaatatatttacacagaattgatcacagagttttatttagtagtaattactgtataacctgcaagtggtggttttccttattattatttgacagaagctggggttagaggagctttagacattttgggttccagttaaacaacaaacagtaataaagcatcagcgataataaaatgcaaatctctaacaaaaataagatgaattaaaatttgattaatatagtgcttttccctgttgtagagggcattgcattactattaataaatatacatatgaatggcctcatatcagagaataggacttcccttctggctttagaggccttcttcctccttgggatatggcaaatatcttcctcttttcatccaggttggagagtgacttgtaagagtgtctgcttgaaatctggctgggaaattgatttttatgtattcttatcttctgcaggtggaaacactgcatgattttgaggcagcaaattctgatgaacttaccttacaaaggggtgatgtggtgctggtggtcccctcagattcagaagctgatcaggtaaaagaaaagataggaagatgctttgggctacgttgatttttttctgagggtctgttggacacaatcacttcctaaagatgtttctattttctgagatgctacaagccatctgaaaagggcttaagggcttgtgacagcatagatcattaacgaggtttctaggacacccttttgggatgctgttgcattctttttttatataatacaaacagttgactgtttcttatcacgtaaccactttctgggaatgttatctctgtaacacctgtcttcaggaaatgcagacactatgaatgtgaactaaaagaccccttcaaaagtggttgcctctgggtgtgtggatattgatgaggaaagaacctggggaaccctctggagtgatggaaatgctttgtatcttgagagggatgtctgcatgtatttgtcaaaactcattgaac

SEQ ID NO: 125099 - DNA, 1042 bp, Homo sapiens
agaaaaaacccagcatatagaaaaagaaagtcaacatttcaaaagtatattctagaaatgttagctaaacccaagataattttccataaaacaaagtataaatggatccttgacgcataatacctgagccaggcaagggaaaatatctgagagtgtcatccatctccaccctcgatcagagacaactcgcatctaccccgccatgagtatgggattcctttctgaagcatccaggccatttggggcctgctgctactctcacagaagtatatcctttgacacatatatttaggggattcagagcaggtgattctatgtcaagacttgataaatccctctccagctcctgttctgaaaaggatatctaagagtccccagatagcgagtaaaatggaacaaagaaaatgtttccacgtctactgtaaacatcaagcctatagagatttctcctgatttgagaaaactaagcaagtaaatacatttttagattagcaaacacctatagagcaatacaaaagaaaaaataattattgcatgccagagttaaaagtttctttagagaacatgcaacaataacaaaaattacctgacatacaaagacaaaatttgaaaattgccttcctttttgttgtcagtaaaactcaagatgacctcgataggtgaaacaaaagatgaagggtgagatgataaggcaaccatattgagaagaaaagaaagtcactttgaaaggcagatgaaaagggaactcaataacatgagaaaagattttaaggggaggaaatgtaatattagaattaaaatttgcatgagatgtggtaaagacgagaagcaacactatagagaatcgatttagtgatatgaggacaagctggaggagttctcccaacacataaagagaagcacaagcaaagatgatagatttagggaccaaggagtgaagatacagctcatgggtagaagttcatcctgaagaagagactataagaatgttacagaagcagaagtggccagtataatagaaaaaaacatgctcaaactgaag

SEQ ID NO: 125100 - DNA, 1043 bp, Homo sapiens
acttttctagaaaacaggagagaatgtgtctgtaaaacctcagtgtgactttgcatttggttatttctattcacacaggcacagtgattccagcaaaaactagtctcctaatgatgaaccccagcagaacacagtgaatccattaaagacatgtatatttccatgtgaatataacttaagttccagtatttaaagtgaaattgtctcaagaattcatgcttcaaaataaatccttgtttgtttcttgaacgtgaaactaccccatttatcatctcatccctccactttgtgagaggtagaaagcagtaatgcatagtagagttgtgattcctaatttgataccaaatgagaagagagagaaaagcttagttaggggatgagtaagaaatagaaatagttactcctggcgttagagaagattcttaaaagatcagtgttgcagttatgatgggaaacatttttagcaacagcttaaagcttactagtaaagatgaatgaagagaccttaagagatatcacttttgagcatgtcattgctacacttcagaggatttgggctctttgaggactagttcatgagggttatttgtagcactatggttttctcatgggaatagtgcatacttatcctagctcctgcctttcatattggatgcttggaattgagattaaatagaatgatttcttttaaactattttaagtaaggaattctcttctggaaagtttgtcttcaaggctggtttgatatatttgcaaagacaggtgtgtctctcataccttgtcaatagattgtcacacttttgccttttgggcaaccagctgaaaggcagagtctctctggcctgcaaataaatatttaaatgtttcaaatacaaattatacttgtgttagtaatggagccagtgaagctcattcttcatgttcattggtgattctccagctgagtgatgaagatggagaacggaatttttaattatcaatcatgaatggtttatgagaaatggagaaataccagtataaaaggaaaggcaattggttataa

SEQ ID NO: 125101 - DNA, 1081 bp, Homo sapiens
ttaagctggtcatcctacatcctcttgaatgagatgggaaggaaatagcattagcagtgattagggcctgcatttcctcaaagatgtgacaagctctaaaatttggacaccttgtttacttcattttaatgaggtgtgtgtgtgtgtgtgtgtgtgtgtgtgtgtgtgtattaaaataacctcatttgtgtttcaaatatagttttctactcacatagtgaaagttgagattgattagacctgtgctatccaaagctaagtgccatttaagcttatattaagtataatacaattatgtaaaatttaaaatgtggttttgttaccctagcacatttcaagtgctcaatagccacatgtgactggtggctaccatactggataagcacagatatggatcatttccttcaccaaaaaaagttttattgaacagtactgtacaaaatgcttaaaaaatgcttatgatttcaagaacttttgtcacctcagcatttttttatgttttagatttgtataactaacagtatttttgtttatttgctttcagacattgccctgggacctatggacggtaagccactaataactctgttttttcatgtatcttgatccccagaaatttggaaaccttgttatattttatttcatttgcaacagaaagaagacacatacatttaatgatgatatagtcccctagaatgatcattaggccactgaaagtcttgagcattatcagaaccggaagatgatggtgaaggaagagtacagtggaccagactcctgggtgaataatggtcaataatttgaataatggtcaagagtttggccctttgtttctttctgtggtggttggtggcaaaaggagctgttgcagtgaaggacacacacacttaaatagaagacaaggaaagtgtgaatgagaaaatggaagagatgggctacttggcacatggtaccattttaaaaaaaagtgattgtattcaatgaagcttgggttaataagaacttgagttttagagccagatagccctggattttagtccaaactctactactcataaccttgagactttgagcaattact

SEQ ID NO: 125102 - DNA, 1062 bp, Homo sapiens
cactgcaaccttcgtctcccaggttcaagcgattctcctgcctcagcctcccaagtagctgggactacggtcatgcaccaccatgcccaactaatttttcttttcttttttttttttttttttgtatttttagtagagacagggtttcaccatgttagccaggatggtctcaatctcttcacctcctgatctgcccacctcggcctcccaaagtgctgggattacaggcatgagccactgtgtctggccctcacttttcatacatttctcagtttttaatgtctgtgatgaatattaattagaataactcctattcttcaaaaatctgtctccaaaaatctgtttttatgtatactttacccattggtttgacgtttcaatttctaggcaacaaagtttttttaaaaagaattttatattgaatgctaaacacatgtaatttaaattgtatgaaaactgaccccaactcccttttctgtgatgtactttatgggactttgtcttagcctggccctttactgtgtaacttgagcctgggttatgctgacttcaagcccacattgttttcatgtattatgataccacaaataaatgaacaaatgataatgtttagtattatagatttttttgtattatcaaagcaggactttcgtcctgtgtcttatttggcttaccttctttctaatccaaaaatattattaatgggagctcattttgcagcaaatgttgggaggcatggctgtctctctcctctctccctcccgttcaccctcactcatacacatacacaattgaaactaacaatgctatggatgaagactggatcaaatgataaccaaatcaaggggtagggtaccagtgagggaatgaggccgttgggatgtggtcagcagtacacaatggcaccttccttttaaaattttagcttcccagaagaacatcagcagtattgctataatgagtccagatcttggcccattttatcgattgggtcatctgtaatttcttgatccaagttctctgagctgacagaggagactccttgcatcttggtatattagg

SEQ ID NO: 125103 - DNA, 1133 bp, Homo sapiens
acttagcccagcctaccttaaacgcgccgagaacgcttaacattagcctacagttagacaaagttatgtaacacaaagcctattttataaccgtgttgaatatcttgtgtaatttactgactatagtacactgtagaacataatagcagtcatttaccctcgtgatcacagggctaactgggaagtgtggttcactgccactgccccgcctcatgagagagtgttttcacacattctgctgaatgcctattgcttttacactttcctaaagtccaaaaaaatcatagattgaaccatcataagttgaggaccatctatatgtagttgaactaaggaaagtcttgggaagatacatgcattaaacagacctttaaagttttctacttttcaaaatccttgaatggaaagtgaaatgtaagctgcctatagtaggtctcaccaattcaaatgaaaagctgctttagttttgaaattttaatttatttccaaaatgagaaattattttcagtttagttcagaagagggtattgccctagtttaacctttaaagtatatgtgcctggccctacagctctgtgtattgtacttgagttgagatgaatggactcttatagcctcagttttgtttttgccttgaaccatggcttatcagggctcagagagcctcacaagtagacagcattctttacctgtatcagataggcttgctgctatatgcagatacaagtttcaatcagagctcaatctgtccatgtagctctgttcatgtgacctttcttcgtgtctgacacattgtctttggctggattaatgtttgtatttaatgcttcctagacaaggaaagggcctcctgtcccacctctacctaaagtcaccccgacaaaggaactgcagcaggagaacatcatcagtttctttgaggacaactttgttccagaaatcagtgtgacaacaccttcccaggtaagtgcctggttcagggctggtatgtccatgaaagtcccatggtggaaggactctcaggggctagccctaaagaaagtggcggttccagaaccaacaacataattttaattgtcattcaggcttgttttaattacttggttagtctgaagcattcttacatgggagat

SEQ ID NO: 125104 - DNA, 1021 bp, Homo sapiens
tcagattcactaaatggctgggtgattttagagtttttatttttaacctatctatgccccactttactacttgtaaagtggggacaataaaacatggctactgtgaagacaaaagataatacatgaatgaggtctctgtagtgcaaataaatggtaccagttatcaccatcactgttgcaattaaccagaattaacctggaaggggagagcaggacaacagacagtacctgttaggcttctgggtttctctgaaatggaaaacccctgattagatgaatactgttcttgagaaggccccttgcccaatcccctgtgttcctctagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacaggtaggaagaggtcaaatatattgggggatagagctcatgatgagatgaaggtggccccatctaggataatcccacggtgccggggctttaagagaagtttccagttagggagactgagatgtgaggctttaggcattgtgattgtcatgaaggtatccacctgcttttcttatttgacttgatatttcctcacatgccctatattcaagttttttgggacttcttaccacgttctcggcatgctcaggcgagcatgctctctcttctcctatctcttgctacaaaactcttttctttcaatgctccatttaaatcctacctctgcatgaaaccttccctctcctagtggtttagagttggcaggtactgccaagaaaagcggttatgtttatatgtcatctcacattttttggtacacctggacattttttagtacacacacttgcatatgagtggccacttaataaaattgaattgaagaaataattgaagagaaacaataagggctgggcaaaggtaactgtagagagaaactaccacctttattctccctatgt

SEQ ID NO: 125105 - DNA, 1071 bp, Homo sapiens
ggccttgttttaggcaaagtcagcctcatatctgtggttggatttgagcgagagtttccttccctgcccaagttggagcagtccactacttgttgtaggagtcaggtcttgggcctaggaagcttttatgccccttgagactttttcttttacccttttgcctacagcaattatttttgcctaaaatctagaggtcagaaggctctccatctctaccagagccacattggttttacttttattgctccccgagaagcagtagatctttgcttgcacctgtgggtagaagggtttggtgccccctcctcaagcggcttaaagctttttgtttttgtggttgttgttgttgttgttgttaagaggaaatgttccatagaaatgagcagggctttacgcctatcccctagcagccatatatcacctcattctcatccacactgcaagggaatgtcttgttctcagactttctcatggcttccaatgttgacccatgggaaagagcttgcccattagcacaatctgtgcctttggccctgtgtctttggccaccagctattccaaatgacacattagtccaggggattctaatgaacaaagtattgagaatcacttgtaggaaaagagatttcttgggaagtaaatctgtttttatagaattgctgttggtgtgagtgttatcagaattataaaaccaaatctaacatagtttcccactatcttcagaatagaacatttaaagatttcgactagagaataatgagtatagttttgccttctctccctgaccaattctggattattttctggtctttgactgcaaactctgccctcagctgcttgtgattagcctaattattatcaaaagggaagatatttatctaatggcttcaacacaaaggattggaggtgttcatctgattttcaggagtcacttagctagtgaaactccagcccatcttgatctccagtcaagatcctcagcagctctggccaaggaaagcattttggcacctggctgtcaaagggagactcttatgtccatgcttctttcttagtgagtgcatttcctgt

SEQ ID NO: 125106 - DNA, 1037 bp, Homo sapiens
gagaatgccttaacatagtgacagtaggaatactagttgtaataatagtaatacctaatattcattgtacgtttaacataattgatactccataaatggtaagacctttcccaatatgactgtaacttttctgttttccctggggaggcttcagaaatgatttgttgtttgtttcagtggtggatttttttctgatttcatggagtgcgtcaaaagcaaactgtcttagtggaattattctcagtctcttagccccaaagtccatctatagggttatggggatcttttgaagtttctgcattctttagtaatttagaatcagaaatacagttttaatgagctgagctctgagctagcctgttttgttaactagaaccagtggccaaattgccttaaaattttattgcattattaaatgattctcatttttcccctagcatctcatatctgggaaagtattacttgtctaattttatagtttcagatttttttagaagtttggtgaaaggtatccaattaaaataattcagcagtggtctctttatttcttttagaaatgtgatgtgctgtgggaagacttccatcaaaaactcgtggatgggtccttgctaacactggatacctacctggggcaatttcctgacataaaggtattttactctgtgtctataaagggaaggattgagtggggtcatgtagttattgaaacatgggcaagagaagaattattacaagtcctcaaactgacatcaaagatagttggtaacttttcatttatttaagcgtgggatttttatgttgttcctatcagtttgaaaagaaacgtcattacagaaatcacatttcgcttttagtgaactgcttcagcttttattattctacagaagtctttttaaacctatagatataaaatcataaaccagagctaccaaaagttccaatcttctttataatcaaaacttttattatatagcatttgacagggatttccattagaataaccagtggtcacaaggaagtgagaaatttcattgtaa

SEQ ID NO: 125107 - DNA, 1282 bp, Homo sapiens
acatatttactgcaacatcatgcttttagtcttgatgattaaaatcttatataattttattttaaggttatattcatgattttatttttcatcacaaagattatttggtctacagtgccaaatttctttttcttctcttaagacattgttaaaaacctatctacacagttgtgtatagtttccatcagacttaagacaaagatttaaagaaaatgccagaagttttttggcatctggattatagaagggggtccactagtgactaacgcttgttatgaatttgaggggtatatttcttgatagagatttgcttgtacttgggtgagggtgaatttggacacttggcataatgtagcttccacctcagtgttgaccatatcatgagagaacgcatccccccttgcttggattcagagtgcgatgggttggattcaggttttgtctcctatttgctgtcccttcacctgcacgactctgtttcatcagagtccccagagtcttgagtcatactgtttttttcctaccccagactctgcaagggcttcgtccgatggtggtcaagtctcttcagctcatgtaggcaggacacctcattgtcaagggcttcgtggaatgtgcccagcgatgctctgagggaagggagatgttggctgtgtctaaagagagcacaagtgctatgaaacaccaagttacatgtggacttttatacatactcctcaaggatgtacttctgtcatttcagacatcttttagtttgtccttttctctcacagttgaacccagaattagctacctccaatccagcaagaatgttgagttttcagtttaacaaatgatttttatcttaggattcactgaccttaagtttacaggatgtgttttttatttctcatgacagtgctctgattttcctctcctctccctgtttccagcccccttttatcccccgtagtgacaaaggccaagacatcaatgtggccaggtcccaccttccggctgtcggggagagtcttctgccggaggcgcatctccaagtccccagctcttcctggccccttgttttgctctcagccatgagctgtcttcgtggcttttcagtacattcattaacctttgtgcagggggtccttgggagagactaaaaggactgggtgatactttatgtcaccatgttgtgctcagaagcatatatctttaatgctattctttaatgttgcaaaccatagttttgcaacatatcaaatgtatccctaatgaaaattcagacccaaaggcttaggaa

SEQ ID NO: 125108 - DNA, 1031 bp, Homo sapiens
gcgattctcctgcctcagcctcttgagtaggtgggattacaggtgcctgccaccacgcctgactaatttttgtgtttttggtagagacaggttttgccatgttggccaggctggtctcgaacctctgaccttaactgattcgacctgccttggcctcccaaagtgctaggattaccggtgtgagccaccacacccggcccacacatacatttttacacagaaaaatctctgacctcttgtctggggtagtttccttaagataccctcttaagaatatatatttacatgacttggagcaaattctacttgttcagtgcccactctataggacacaaattatttgtacctagagtttgctttgggctttctctcacattcatagtactaaatctttctttggccatccctaaggatttgatcacacttccccttttagtttttggcagagctcaactgcttatcagccaagtaaatggcttttctctttagggatcccgttaaggaggctgatttgaattaagatgctctgatgtaattaaaggcagaaaggaagttggtgcagtgaatagttggtggtctatgtctgatagtgtaattttgggactgaattgctggctttcaaactcttttccacttccctcactgcagctacttccatatgatttgactgcccttccttcccggatctgccatctccttatgttcaagtcccatcttctttaaggtcaactcacaaggaatattctagtggtattttccccatcccctcagtcaggagtctcttttcctctgtttacttcagtagtacgttatttgttatctagttttcttacatgatagtaatttagctgtgtatctatgttctcattcaattgtaaaatatttaaaggaagactcaacgtttagtcatttttacaaaccttcaatggcttctagtacttgctaggtgcctaataagtacatcccagttttgacttgcctgcttgtcacacttattctctgtatttaccctttgctttgcatattatgtg

SEQ ID NO: 125109 - DNA, 1022 bp, Homo sapiens
gactagtaatgtacctatattatagggtatttgtgaggcttaagtgaaataaagcatgcagcaccgtttttggcacagcataagtattcagtaagtgaagttgtgaaaattagacatccccaagtgtcagagagacaaggtggaacttccatttgtttctatatagtctgactcagggatccagctggtcatgtgagcctattgtcagtgagggctgactggggtgtattgctgggatccctggctccccattccatcgggaaacccagtgtgcctgactttcttccaggacattctgtagaaaccactgtctgttgttctccggcctaaaaattagatttacacctcatcgtccttcatctatattcaccttgtgcgggtgagctgtaaatgaggcagtcctttgactgctctgttatttgctgttgccataatcaggagagaagctgaagtaatacggctgggtaactggttgtgatttcagtagtgggcctgctgggtttgcccacaggccgtgttacaaaatgctggcagctggcaagctgcacactttgtgggtccctaggaacctgagaaggctggaaaacacatgaattatacagtttgacaacgtgaacatggaaagggcatgtcctttgtgactttagtttttcattaaatgaactgttcttggattcagaatctatatataaatttccttatgtctcactgtttcctgtttggtatgttgctgccagtatagattaaaaggagtgactacaagtagaagaatgcaaaataagcttctttatgcaggtctgtttcttatatacgtgccaattgcaaaaacaggagactgttattttctttcatcaattgtcactctagatgccttttgtccccatgttgactggcctgggtcaccggagtacagtgtgtcagcaggatgtgtctcaggacaaatgctgaaccagcatcagcgtctttctaaggcaactttcttcgagataggaaaattgttacataacatgttgttttatatc

SEQ ID NO: 125110 - DNA, 1014 bp, Homo sapiens
tccttcttcacatgacagcaggaaggagaggtttaaatgaactttgtttgagaggtttgagtgaaatgttataaaaccatcagatcttatgagaactcactaactatcatgagaatagcatgagggtaactgcccccatgatgtaatcacctcccatgtggtccctcccccaacacatggggattacaatttaagatgagatttgggtggggacacagccaaaccaaataaatgtcctttggagacttcccttagaatccttgctttgacaatataatgctcattctccattttctacattcataaacattttgaaaattaatatttaattataccagtattaatgactgtattatctaggttaaaaaaattaaactgttatagataagactaaatattttttggtactatatccccagtgcccaatggagggtctatatagagtagagttgaaagtacgtatttgttcatgtttgaaagatgcaacaggaaacttgagatctgggtatacttacacttttccatcactgtgaaatgttttaatagtgattttttttttttttttttttttttagacagagtctcggtctgtcaccaggctggagtgcagtggcgcaatcttggctcactacaaactccacctcctgggttcaagtgatactcctgcctcagcctcctgagtagctgggactataggtgtgtgccaccatgcccagctaatttttgtatttttagtagagacggggtttcaccatgttgaccaggaaggtcttgatctcttcacctcgtgatctgcccgccccggcctcccaaagtgctaggattacaggtgtgagccacggcgcctggccttaatagtgatttttattaaggtaatagtattgaatgataaatttggaaggcctagaaaaaaatagaatagaagaataaaaatctcacccatcgtcctaccacatgaacataatgttgataatcactcctgttattcttttatttatccctaaatatttattc

SEQ ID NO: 125111 - DNA, 1100 bp, Homo sapiens
gtacaaaatgtgatccaaatatcagagagccttttattacctggacttaaataccacagataactcagggagtttaagctgacagtttctcctggaaccacctcttctgaagcacgtttagatcgatgtcaagattggtttttgctggcactaaatagtcacagctttgaaacctcctgacccacctgccccaggaaacattagcacccagagctgtttcctaatattaaaggtgctttgaagtacagtaaacagtgtcgactcagtgtccagatgagcatggccacagctccttgatttgtttattctcttcaggagcgaaaaaagttataaaattggtgagagccccacagtctcagattttaaccagatattgcacaggtactggtcattttattcattagcacactagagattcagaataggtgtggattttatgtgtgtgtgtgtgtgtgtgtgtgtgtatttacacaattcctaatatttgggtcaataatacttgggaccaaagtgtgtgataggagaaataatgcagacttcgaagttaggacaacctggtttctaatctagactctgctgaacaagccatgaaatctctctaaacctctgtttcttcatctgcaagttgaagataaaatagatctatcctgttggagatgaaagagaagacatgtaaagtgcttagcacagggtgcaggatagcacagatcatcaataaatagtcatgatgaggataatgatgagaagcagaactgggacctgtgtcccctacttggtgtggccgaatgtagactgtgtgtacctttgtgtttctggttggagccacctgctgtcacttgtactctgcatcagctctagacccctccttccatgtcagaccttgtatttttacatgaatgtgatatatatatatgagaaaagatcagtctatgttgcttagagctaactcactagcaattggccctttcatatcttgatttgttgcaaatgtgagttactgtttagagtagttttgaaattgagcagatgctgttgagttgatatattctgtgattggtaccacaaggtagaagaatctatgttattatagaaaatacaaa

SEQ ID NO: 125112 - DNA, 1502 bp, Homo sapiens
tctctactaaaaatacaaaaaattagccaggcatggtagcaggcacctgtaatcccagctacttgggaggctgaggcaggagaattgcttgaacctgggaggcagaggttgcagtgagctgagatcatgccactgcgctgagatcatgccactgcactccagtccaggtgacagagtaagactcagtcttaaaaacaaacaacaacaacaacaacaacaaaagaacaacaacaacaacaaaaaacattgcgaacacaagtaatgacttaaacagactaacttaacaacttgctttcactaaaaggaagttgaccttatcttgttggatattaaaatattacaaatataaatagacaaatcagtggaaaattatggaaagttaaaacataaagtcaaaggtatgtaagaatcattcaataaatctatttgggccaacaactcatcatttgaagaaaaaatgaccccagctttattctatatgctctatacaaaaataagttcatagctaagatgaagactaatgtgaggaagataaaataaatgttctcagaggataagggtgggcacatgcagggactgaggaaagggaactctttctgagccaggtgccaaggcagatactacacctgaaaagattgccagattccaccccatagaaacacaaaacaagaatacaagttaccataaacaagatggaaagataaagctattttcaaattttaagatatctcagcatatggtattagtattttccattgagttgtgatgggtggggttttttaagactggctaagcctattagacattaatgtcacatcctgtgagtatcattggtatttggtaggagtaatttttgcctctgcttgtgagagttgataaaaatctattttcattgtggaaaaaaataaaaagataattcacctcagcatggggaatgtatacagtatttaattctgcttaagaaatctcagacagtgaattacctcagagcatatctcttgaattaaaatattcatatttgactgtataacatatgttttaccttgaagtcctagttgcagagctgattcagaggcatctaggtcaaatacatgatcttctgatgtcagtgattcattataacccttttcctgttcctcttatggggcaaatattcagtagagggcaattatttaacataatataactttcatgatgacagattcctgttaaatggaaatacaatcatatatacaaatctgcatgagttgtatgaattcatatgtcataatcaaatggatgactatgaatctgaaacttttattatttattgtatgaaaaccatgggctgttttttttccctgcccttttagtttactttaatggttgacaagaactatgtgtgctttttgatagtcagctcagaggtttatcctgactcaaaatggagtagcatacatgaaatgatgtaaaatcaaaatgttcacttattcaatgactatttgttgcattgttgctatggg

SEQ ID NO: 125113 - DNA, 1996 bp, Homo sapiens
ctccgccttgtgatcaaatgatcaccctcttctcacagtcatctcacctttccagcaaatgggattggggccaagagcccactgggcttttaccaaagctttgctttggcttaaaatatcgctctttgcctcatgatgatttatcattgactacgtaaagcacgttcatatagcaacaaaaagacactagctcatttaaactgcccgttgtgttgcttagaactctcatatctcctttgccctaattcttctgtaggaatattcctaatgtgggcttgcctaggggaaatggacaggttgaagaacatggtcattgcataatttcgattgctgatgtgtactgcacatgtgggttaaaaccatgaatcacaccacagatgacagtgtctgggggccaggccttccaccatcacttcttgcagccctcagccttctttctcctgtttgatgtcagtattgattattggtgtctgtagtgacaattattggcatcaatatattggaggattggggagatacacagcaaaggcaaaaactgttagcctttctcgtttcaagtctgagggttttcagggagctgaccaggataatagatgtgctacagaaccccaaaagcctagagaggggtcaaaatagtatgttaggaagacagggagctccccagtgaaaaaaggtggaagaagggggcagagaggagagataccttgccaggcaattgtttattgtctaagttaatcttcactggcagagagagcacgttgccttcagttttacccatgaggacaccaggagcagagagataaagggctggatggtcagagctgctgacagtgattgtgaagctgcacctgggaaagctgaccgggagccgtgctcagatactcacaatcctgaatgccacccaggctgtgtcttatgcacagcaacacccacgggtgctcttacaggggttctaagaagagccacagaaaatctctgaagggccaggcgtggtggctcttgcctgtaatcccagcactttgggaggtggaggcaagaagaacacttgagttaggggtttgagaccagcctggacaacacagtgagacctcatctctactaaaaattgaaatggaaaaaaatttaaaaaaagcagagaaataaaatcaatgtgacaaattaagaaaagaaaaagaaaatcactgacttatatcagccttttctccaagggggaagctaaaagaaaattctgtgttttaagtaattttcataaggctttgtaaatggagtttaacatcaggaattcatcccacaaagtcctgggtattggaagtctcaggtcctattttcagtgccttcagtggcctatgtaattcaaataaactgagaacattgtgcagggttccttgtcttcatccttatagcatctggaccccctgcactttcattttattgtgcagtcatagatatcgatgacttagcagatattaattaaaccattttccagtagtagaaacagagcctcttggtttcttttcctcaactgctttcctccacttactatactcctaccttgcttcaccgggggtcctgaggtccctgaaggggtctgtcaccctcctgctgttgaccactggagcctctttgatggtagcttgagaaatcataaagggtatttaccttttgcattcaaaatgtattatacattaatggacatgcaccatttatgtataaccaaatagacatttaactatgttagcattttgcatgttctgctttggaaatttagctaaagtggagctcgtaataagaaaatgaggtgatttgaagtgctggttagttgctttcatattgggtggatcttctatgaatatttgggacctttagaaattagtactgaaattgagaaattttcggttggtagaatttagggcatttctctgaatgtgtcatttctaagtcaccatctccattaaagaatgcttttctgagcctccttggatccctcaaagctagg

SEQ ID NO: 125114 - DNA, 1053 bp, Homo sapiens
gtagggacgtttctctcatgaactgtccacattttgtgtttgaatcaggtgggggagtggtcaccattttaaactcagactacgacttgcttgtgcagaggagatgtacacatggtgtctgtgtagatgattgggggaaggattgtgatacagctaatctcgtggtgtcagaggttctttggtgtgctatattctgcctcctgtcctctgggagcagtgtcctatgctcacatgagtggtattccctgcatgtatatgtggttcattaactcacgatctccatctttggctctagcagaggccagtggcatggcatgcacccactggctcaggctcaccttcattgctctgccatctggctgcactgacattgggctctgatccccagcccttgctacagaaccacgtggccactgctacagtagctaacctgctgtgtcttcactacatgagtattaagggcagctggggtaatctcaacttcaggtctccttagcctggctacactgtgcagctacaggatgtaactgtgccctaggctggtgagaggggcagcccaagaagtgatctttccagagtgttcagtggggcataaggactgtagctcccctctgaccctgacattatcctcacttctcagggaggagaggagaaaattggggtatattttcttccacttttgttactcttttttgcagaggggaaggctttcttcttccttctgttatatcctcctgtggcagagcttgccaggcaccatggatgaagggggcacgttcattccactttgggaaagagggctctatgagctggggcttccaggttttatctccctttttagacttaatgaagggtaatggaaaatttgcactcaaggtatcttaattcttgtgccaagtccagttagaataaagaattgggtgtttcccctgctaggctctgtgatgagcagtcccatatattaactcatttcaccctcgtagtgaacctatgaagtaggtgctattattatccctatcttacagatgaacagactgaagcacagagatgaat

SEQ ID NO: 125115 - DNA, 1045 bp, Homo sapiens
aatgccttatcttttgaatattcatttttccagtgtttctatatggaaatacaagtcagtgagcaaatttgtagggagaatgtttgcacacctctttaattatctccttagataaattcctagaagaagacttattgcatccaaggtttgcctatttttattatagctagattgccttccagaaaggtgtaccaatttacattctcatcagcagtccatgagacacttgccaactctggataataaaatttaaaacaatgtttagctatgtcattggataaaatttgttcatgattaatttcatttgtttgatttttaaaaagcaaacttttgtgcattcgtgtttttgttcttgaattgtgcttttatatttctgcccgttttctgtagcaattctgtcttgttattagtaagggcaaaaactttatcaagcctaagggttacaaccattctttcttccttttctatttacttttaaattgtttggtgatttctactgagaaaatgtttttgttgatgttttatgtatatctgcttacatctattggttggttttgtctggtttctcttttgcgtggttgaattagtcaggatcctgctacatgcaggtgtcagaaagctcaacccaaactggcttaaggaaaaaaggaatttaattgctaataataataatatctaacaatttatatatggttcttgtacatataaatttagattagcttttaatgaataaaagctatatattcacataagatatatgaatatcttacctatagtagcctatatacatattcttatacatatgtatatgtaaaagtatatgcagaccatatctttcctttagcttttttttttttttttttgagacagagtctcgctctgtcacccaggctggagtgcaatggcgcgatctcggctcactgcaagctccacctcctgggttcatgccattctcctgcctcagcctgcccagtagctgggactacaggtgcccaccaccacgcttggctaattttttatatttttagtagagatggggtttcac

SEQ ID NO: 125116 - DNA, 1036 bp, Homo sapiens
ggtcaaagtggaattgcaagaaggatggagttgtgcctgggcctcctgaactctggtgatgccagggcttgatctgcaaaggagatccttgtgcagcctgaggaagcaagattgacttactggagttgagttgtcacccacaacctgccatccatgcacaatccagataaacaaactgaggagcctcggagaaccactggttgcccagaggagttttaccacaaggatgggcagtttgtcagtatttaagccgggactttgagctgcattctcacatattgcttctccattgtgaatagtgtcagctagagtcagggccatactcgtcaataaatagggacagggtattaacttaatattaggggagaaagtgatggcaagtaagaaaggagggcactcccctagatgccttctggctaattcctacacatccttcagtttaaacattgcttccccagaattgccttctttgcctttccagataaggctaccttccctgttaagtgcctccatagcaacctggagttatccaaagatatttgagcccttggaataatttaatgattcattttgttcccattagactattatttcctaaagagtaaggagtgccattatttgtctatccccagtgcctctgttaaatgtctggggatggatatatgtaaaagacactcaagtatctgttcactgatgttgtggattggtttggatatggtttgtccccacccaaactcatgttgaaatttgatcccccaggtggtaatgttgggagttggggcctagtgtgaggtgtttgggtgatgggagcagatccctcatgaatagataaatgccccccgacatgggtaagtgattagttcccttgagaatggattgttaacaagagtctggctccctcagtttctctcttttgcttcctctctccccatgtgattactttgcacatgccagctccccttccactttctgccatgagttgaagcagcctgaggccctcaccagctgcagctgcccctatcttgaacttcccagc

SEQ ID NO: 125117 - DNA, 1124 bp, Homo sapiens
taacaaaaattaatctagttttcaaatgtaaaaatatttagaaatgttctatgtactatagtaaacataaaagcatacccatttgaaggaattcattcaggcccagttgacagctgtcatgctgtagagatgagcaacaacagtagagagccattgtgtatcttatgtgtttctcagcctgatttgtgttccatgatgctatcatttttttagtgtcatattcctccaggtcacattagacgtattctgctgttgggtgtccttggagtcacagagtaacagctgatctagactaaatcctatgttaaccagaaataaactccagagaaaggagtgccatcctattacttcctctccaccccctgactaacgctaccttagtgtttctgaatatgagagtagaaaaagaagatcattttttaaatatgtgtttttaaattgcatttttagaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttact

SEQ ID NO: 125118 - DNA, 1079 bp, Homo sapiens
ttcttacatttgtatggttaatataacatggaatcgaggcgagtatgaaagcagttatagtggccattagatcgggccaccccaacatttttagggagaataagtattgtatccgtttgagggaattaacaaaaatgtttttcagtaaggtaataatttttcttgaagccattcagtagtctgttgcctgaaagctgttaaaatataggattttatttaaccttttgtctgttttctagaatagtgcaactttattatccttgttaaatcagaatttgtcataagaacagtggaactcattattttcatataaattattatactaattacaaagcatcttaatcttttccttaaaaagactctagcaattactatttttcaggatgctggtaacttctatagaacttgaattaaaacatttccttaaaaattcggactgttgttcttcctctaatttacttgaaaatgaggttttattaataatggatgaaattactttcctagaaacaatttttgcaggtaaagccaaaagaaaaggctattagctgaggagcattatgatgtgagatccattgggccaggattcaccatgcaggttgcaaagtagaggtctgcctgcactcagggtgacagccttaggtaagaggcagggtggaaaggagaagatattgcaggaacattggtggcatcaaaaacagatgtaagagatgaaagggatggcagagctgcagggacaagaggttgtgccagagagtgtgatgtcattaatgtttctgaagcggagtcatggtgtatacgtgttcaaaaagtgggatgatggtaaaggtcatttgtgtagaattagtagagaaactgaggccacagcctttctgagtcatcctaatggacatgaaggccaggaggaagaaacaaggtgctctaagccaggctccagcttctccacaggggacagtagtattaactggacaacacgactttaaaagtgaagaagtctaaagatgggggtgggggtgtgagagatcatgcagccttcactccggagagctttgtgggaaattgggttcatgggagagaaattg

SEQ ID NO: 125119 - DNA, 1113 bp, Homo sapiens
tcagaaaagcagtatgcacagctacctcatgaggcagaatgactttagggcctttaaacattttaagtgtatctgcatgtgaaggtattgacctccagaatatatataagtctatcaaaagtaagtcagagtatgacagacctggcttcaaattcacagtgtactatttagtagctgtatgatcttagcaagctactaacatttctatttcctcttctataaaagaggaatattagtagaacatgcctcatagggttgtagtgatggttatatgatgtcatttatatgaggcacttaaatgagtactcagtacagagtaaatatccagtaaataggagatacttattttgctatgttatagacagtaaatgttggtgtcacatgagaaaatagccttgtcttagctttccacctatgtaaacaaattaagagatatgcaatttctttaaaaaaattattaaaataccttaaatgaactctttctcccatcttcaccccaccaaggccgaatgggtaatagccgaagtgccctgaagatgattatggaggaattacatgatgttgataaagcaatcgaatttgccaaggagcaagatgatggagagctgtgggaagatttgattttatattccattgacaaaccacgtaagcataaaagccatctctggttataacttttttttctctcagtgtaaccagttatgtctagattaaaaactatttcaagatacattgggttaagaaaatggtagcgtacctacaataaaaataggccaggtgtgttgtaatgatttccaatactcctcctgtgctggaaaacctggagcctcatcactttgcattacctgcatgtgatgaagaacaggtggctacacagtttattaattgtgtccccatgaggcatatttttacctgctgcaagcaaattgaataaatgtcatctgggttgtgttggtgtggtttttttttgtttttagcttgtatatgggagtgtttatagtttaagtgtatagaccttaccagtcttttttggaaacatgtaactgttctggacattgatgatatttggatgtttgtgttgtagtatttagcctctttcctgcactattttta

SEQ ID NO: 125120 - DNA, 1071 bp, Homo sapiens
caggaagcctgaagattggtttcttaaggtgcatgtgtccatggttaggcgtcattgtgactagattcaacagcaataacaaacatcagcgcatttacagtctcagctgcagggcggctggtgctctatgtctgttataaaccaatccacttggaaacagcaacccaaggtgttaatgctcgtgggattggtgattaagtcttcctgtcttcagtagattgtggggtttttgtttacatttaatattaactaaacattgaattgttttttgacttctgagtactgtattgatagacttaatcttgcctgtgaggagaaagtgaattactgatttcctgtgaagttaactttttttcagacagctaaggtaaggaatcagttttgaaaactgtttcagaacacctgcattcttcttgatttttactttgtatttttgtttttgatgttaccagtttaggcagcatttcatttgaagagtcaacaaagaggagatgcagaatgtatggaaatgagtttagtgcccgctacttgagtttttaagaatatgtgcttgtcccaggactctaccctcttttgtgtaaaataatttttatgatctgggaagaccactcatctttttatttctgagccaaagcagataccaatgatgatattgacaactactgtcattaacatttctgtagttcttagtgtatgctaagttcattggttctgagtgatttcgtaatggcaactcgtttaattgtcacagtaactcaataaaatttttgtagataaactgagtctcagagagattagtgacttgcctaaggtcacagttggtacgtggcagagtcaggttttggggcccttctagagaaattatcggaatcctttgctctcccaaagggttttcctttccacttctccatcacctagaggttttccctgaagactgcttctcccccaacctgtccatgggaggtgtttagagctaaaaatagcaatgttagccaggtattgcttttctcattttaatgggtcacggcttatcttttgttccttttagtatttgcataagcttttcaagag

SEQ ID NO: 125121 - DNA, 1916 bp, Homo sapiens
tgtgtgtgtgtgtgtaaaagaaatctaattacaagtgctcatgacagaaataatgaggtttataaaacagtgttcttattcaaaaaattgaaattttagataaacctaaaagtagaaccctaaaggctccaaaaggattaatgcatttttcaattatattgtactgtatttagagatattgtgtgctatattaatctccaccaacttaaacttaatttagataggagctagagctacgtctttttctcaaagatgctttagccctttttaaaatactgagtcaagtctttagggactacagatttacgaagaattacgtagctccaaggaagttcaggtagagaggctctgcttgtctggcagaggatgagatgcttatgtaaaaattaattacattttcctcatatctagtctcccctcatgcacccccttccattgttctccagagctcgttttgcatatgttcctgtggaaaaaagatgaatgagctgaaactaattgctattctagaatgtgatccagatgtaaggaatcagagtcttctggttagaagagaccttagggataatctactccaacaccctcgtatttcagagaacaaaagtaacatttggagcagacagctaggtcgtagcagagtctagaacagggcccccaggtgttccgtgtgaggctcagtctggtgtgctgctttccctcttcctcttgacataaactgtctagtttgtgtttcctgaatgataaaagtggctaaagtaaattctgaaagtccaaaagctttatgtcattatgaaacttcaggtatctcattctctttctgactcttattcccttctcctcataaaaccagctccttctgtctgtggagtctcatagggagactaggtcgaggttgaagtagctggaagaaaagctcattttcttgatatactggtaaagagatgctctccataactactgagagtctcatgagaaggtgtgaaggtatccgagacatcggagggcggggggctaggatatgggcagtcaagatgttttgtatttgggaagttatagcaaagcaccattttagtagtgtgcaaaacacataggcttcagattgagatgcatttgaaaatgcagttcttcacaaatgtcattttccataagagccattgtaaagccaagggcctccttaagtatacaaaataagccttccacctgtgaactgtggtaggtacactgcattgtgtttagtcttctcttcttaaataacggatttcattgactgtggcttttcttatatgtttcagaaagctgttgacatgcttttggacaatgaagataaaatttcagtgagtgtcatttgtttttatatgtgttaccagatgaacgtctgggactcctatagctgtgaagaagagagtttatcagataattttgtagctgtctttctgtcctcatgactccaccttgaaacttttcttttttatctagattaaaaaggtagtggaagaattggaagacagaccagagctacagcatgtggtgagcatggcagtctcctccttttgcccttttgattgaccagtgggtgaatcacctttcagtattggtgcgaggaggatactggagtgaattcttcaaggaggttaatattccagttggaggtttcaccacaaacaatgttctgtaattaccaaaatgcagcatatgctgtgaattcaaggtcagggattaattgtagatcaggcagttgaattttgacccacaattgaattgtgatggaaaaaagttaccaatctatctattatattactataatataaatatatgtaacataactatatatttaactataatgaatgtttttgtgttatgttgtgtctaggaataagcactctccctctgtagttgccattaaatataaccatggc

SEQ ID NO: 125122 - DNA, 1141 bp, Homo sapiens
tccgagaatggcctggagatctgtataataattcagtcatagttcaagcagttcgggatcatttgaagaaagatagtcagaacaagactttacttaaaaccctggcagaattgtgagtatacttaagtgtttctttttccatatcagtctgtgttgaaaagtttttcatactttagatttggcaaactccaagtggagaagatgtattttataccattttcctacattccttcttagtaaaaacctctcataaacctcaaatgagtaggcgataaggacatgtgtgaaactgtacaattgcaatgtaatctgtttcccagagaagagaacccctaacgcacagcgcttgggagaggcagtggttaggaaacaaaagggtgccaagttttagatcactcaagcataacagtttcccaatgagcaaggctctggattctgctcttctagggtcttcaagtcagttaatttaatctctcaaatgtcaattccttatgggaaaattttaaactttaaaagagatgtcataatagaggactccctgaccctgagtcagggctcagaaaatggcagcttggttaatatttttcatatttcttgggcacattcagtgatgcaggctttgtgcgagacgcttatgatacagagatagataagatatgctctcaagtacttcgatctagggaaacaagaagtatactgcaggtctagccaagacgaccatccctgcatccacctctcctcagtgcccccatcacctcaggccactcctctcccttgttttttcttcttttgcccaaaaccaaaaaaggtataccaaaatgacctagaactctggacgtgttggattttccacaagaggaggttgtgtttatggcattctaagttgaaatgctaatcattttctcttggaaacgttgtcctgttagataccccttagagtctgcagcacgttcgtaatggaccaacagtacagcttcagttcagtgagctctcaagagctgacttagggacttaatgtgaaaaacattgtttcaatggaaaaacacatttcagttagacacagcccccttaaaatcagcttttggaatattagccatttgtcagctgaatactgcttgtaagaattggaacggatgtttct

SEQ ID NO: 125123 - DNA, 1028 bp, Homo sapiens
gtttaattgtctgcatatctttcttctaggacttgtgagctccttggggatggtgaccttctctgtctgtccccagtaaaaagtgtggtgattggattgtagggcattatagggtcattgaacagtatttgtaaatttgacttttaacacagtactgaaaatatctgaagaacacaagatgtatttttcctaatttcaaaagatgattatgagttggtgaaggttggtaaactccagttgaaggaaggaaagatgaatagattacctgtactcctcgattacttaagaagtcgacttttttcatctctgtgactttctccctcctattatttagatttctattaactcatcaggaagaacagagagataaagattaacctaggcaatttttaaattcattcatacatgtatatacttttgaaaatatattataatttattgttagaaagtagttttcatttaaatcctgttcaaaacatttttttcagagtactgtattccctcacatttttaaagtaaaaatatactttatgttttctgcataattggaatgcagttttgttttttcatattttaatggacttttttttcccttttccttacctaggctattagtccttatttgccaagaggtgatccagttctgaaaccactcatctatgaaatgatcttacatgaatttttggagagtgattatgaggtatggtgttctgatgtggtcatatttacttgttctcgatgggaggtgttaggaaatctagaaaggaatacaatggagcaatgcctgtaaaggaaacagatttgtagtttgcatgtggcaggtgaaactgagctagagaaactccagtataactcatgtttatgtagacagtgaaaacacttagtccgtgtgcattttaaggaattccttaaagttaccttctttctagaactaaagaaaaagagctaagtgctattttgtagatttcataaatacaatagcagctgctattccatctttgatatcatcccagaagaaagagaattat

SEQ ID NO: 125124 - DNA, 3499 bp, Homo sapiens
acattgctgatgcttttcttatacatataaaagagccttttctatggtctagtgaagtgattttctttttattttgttcaaaatatttttttattttgctattctgattttgatatttttattgttacagtggtcaatttttaaatatatttcagttttctccattttttttcagttgtttcaaagtttagcaatttgtaatttctccacagatctgatagatttttcttcactagttgatcttttatagttgctattttatttttggaatgttttctgattgtaagtttcctgaggcctttcccaccatgcagaactgtgagtcagttaaacctctttcctttataaattacccagtcttgggtatttcttcataggagtgtgagaagaaactaatatgtatggctaactagaattaatttgtatgatatatagaaatgtaatttaaattaatgtttctctcttttcccccactaggaaagagaatactgtgccaggcctagactggacatcatccagccactttctgagacttgtgaagagatctcttctgatgctttgacagtcagaggctttcaggagaatgaatgtagagattatcatttaggtaggagatatgaaagatctggctgatatgcttttttaatgtttttttctcccccttcctacttgcaataaatggaatttaaattaaggtgctgaaagaatcttaagagaatacctgcgtagactgtgtgtgctgaaaacaaggacatttggatgcagagatgttgcaaaacttgcataagctcctatagtaaaagggaaggctagagttcagaccaggacccgggggaggattgggccccttgttttttgttcttgtattttttctattgtcctaactatttaatgtgacacataatttaatgtcaagctgcatggctccatggttgtcatatcactcccattttatgtgtcaggaaagttcgctctggggtggcagagaagttgtctttcttgtttgtaactgagtgctcagagcctgaaagacttctggcacattttaggtgttcagtgaatatttgttgagtggacggagaaatacacttagtcactgctcataaatacagggagaaccattaatatttagtcataccagagacatctgtgtttggctgttatcatacccttgtaaaatatattaatgaaaatagaacagttcagctttgtaggaatgctgtactactttaaacacaattgacatttgttgagaatattttcagttctcattgtggccaaaggaaatgaagaaatattctatatatgtttaaactttcttatatgaagaccctaatccattgaaaaacataagagtatattctagacttggcaaaaagcaactgtgattcacaactgaaaagtgtccaatctaggtatttggctcagagcaaactctcctgcacacttagaaacccttcagaacaggttttataattgaattctgcaggaaaccctcagattggcattgtgcacaacatgctgaaatgatagattatgtccctagggcttgggcatctgtcatttatgccttaggtggccttgaccttgatgaggaggaaacatttatcgctgaccatggggtgtaattgttctgtaaaagtagaacaatgctgtaaatggccacaaataaaatttatatacagtagatgaattctaatatgcagtagacatagagaatttttaacactttttcagctgaagtcagagtgttgatgtattaaacgtagaattttaaactcaccttatttttttttcaagttttttagtatgtcattccctccctttctgtccttctccttccctctcttgctttttggtcaagtatttttacacttaaatatttttaaaagcactgaaatacgcttctgtcattctttaccctgtctcccacacttaccttccagcagagccaaacacacaacaaagatagacacattttctgttcgctcttgggttgggtaacctaaccaggtcctctgaaaccattgccaagttttctgctgttcagtcaccaagtcgttcctctcttttctcacctacagaatactctgaaggggaatcacttttttacatcgtgagtccgagagatgttgtagtggccaaggaacgagaccaagatgatcacattgactggctccttgaaaagaagaaatatgaagtacccttgattttacttctttgaaagtattgactcatctacagcatagagagagaagataaaatgtttttgtaataaatcttttatgtagtcaaagtagagtttcccaagccaaaaatatgtaggaagttaataactttctagtacccccttcagaaattagggaaccaaaagattgcaatggattgactggctttcctgttaagtgggggaggagttgggagtggagggaggaggtgagttagatctagactgttggaagtttcattttttgattttgttcaaagaaattagagatagtatttcagaagtgtctatttagatttaatgaaatcgtttattttatacttatcacatttttactcacttaggatggtttgaactatcagtttggatagaatgatgttgtccacttcattgaggtttggcttagattaatttgaatagataatgcccaatatcgcttaaaaaaaaagaaaaaaaccatttttcaactttaatagctacaaagttacgttcttagatgggcttatatactaatttaaaacaacatccacaacaaatagtctacgtatttgttgtactaagtttgtcaccatctgaaaggatttggaaaaaaattttttttttcatttataaactatttaaagtccaggtatcgatacctagttcataacccagtaattaccatgttactttaaatccagtagtttctcaaagaaataattgtatgttttaaatatttatgttaaagtagtatttgtaaactttccaaaataaaaacaaaatcagagatttttcaaagacttaattttagatatacataaacatgcgtatagttcacttttttattgaaacataagggaaaatgctcctttatcaatatgtcataaagatctagaagacagctgcctttttttgtatggagactaggagactttgttgtattttgatttgtgtctgaaatgtgattccattgtcctaatgaggaaatgaattcaaatggaagtgggagaagtcttcattttggttgactgcctttgagtttgaattcagtgaggttcattcaaccatagcattaacaattccaatgcttcaagcaaaagccatgggaaaatggagctttattcgtgtagtgcagaatgctaaaccataataactatagtgtttataacctcaatatctttctctcccaccttctcccattttccctccctccttttctgcttttttttttttttaaatcatccttatgtttggaataaaggaagcattgatggcagctgaaattagccaaaa

SEQ ID NO: 125125 - DNA, 1057 bp, Homo sapiens
tatattgtcattcaacatttctttctctaaatctatatgaagaatattccttataccttcatgttcattttgacaccactgtctgcagccagcccttctgggactcagcatcgctataaaagataaacagaatcttgttaaatctaaaagcaattatgtttcgctgcattagtaaagactaatggaaaaacaagacaccaccatttattctaaaatgtcttactttgtggcagaatggctgcagacatttccctaaatcagcaactcacattagaagtgagttcttttttgcatgatatcattaccagtgggtattaatggagatgaattgctgagtgggagagtactcgaaaccagataaatggccattattttggaattcttaatttgagaatcatgctgagtattactataattgcaattttgttttctataagagatttttgttggtataagggaattactttaacaaaaagaaagacataatttagtttcagttttatccaaatgttgattacttgcttacctgtgcgtctggaagtcttgacaatattattttcatgtaccacatcttttctttatgaataacatttttgtcagcttgtgatttagccactgcatatagtccgtgtccaaattattaattctcaattagcaaaatttggcaaggtttagtacttaacaagtaagcgtttattacaacatctggaattgagaagtgaaatagatatgtgcacctgcaatttttctttgttttgttttagaacacattggagtttctatcatgttcttaattagagaacaggaaattttctgtcttactcatacaagctattgtggactggggagttggcatgtagaggaggaaagatttgggtaggattatttcgtagtttctctgttctgtatcttggagctcattctcaagaaccaaggcctttgatgtatatttggttacctttaggagaaacactgacagtgtctgtcagtgagactaggcagcctatttggcatcccaagtggggagaatacctccttctcccaccccttcttttgt

SEQ ID NO: 125126 - DNA, 1115 bp, Homo sapiens
ttccagggaggcaaggaagtttgctgaagtgtgtgatcttgatgaggttacttaaccttcttgaccatccttttctcacctgttaaatggaggtgataatatctatcttttaggatgggtgtgggaattagacatggcataagaaatgtgcctaacatggtacttggcacacagtagatgctcactaaaccatgatggttattatcactatgcagactttcatcccaactctgtgactgctgatagctggctcagtggtggccctattagcctagaaccctgggatcacattattgcagtgtggttcatctgtactgtaatttacgtgaaatagaccatatgtggatactaacagtatcacattactgacattttactactatggttaatggttaagtaccattttttcccctcttaagagtaaacctttaagaatataagccatttccacagcaggaggcaaaatagtttggataagagtccttaagtaggataacagaaagggaaatattaggaggtctggattacaatttcctttagccctgaatagtgtgagccactgttctttggtaaatgaggtgaaaatggcattaagattaaagaaatacgtatggctgtacatttcttagaagccaattgtttataactctttctgttacaactcagactctcaaaaatagcacgaaagttattcctatcacataggctgttgatttattctgttaaatgaaaaataataataatataatgaagattaagcttcttggccaatcaccaacacatgaagagattctctatacatagggcttttgggacatcatattttctttcaaattgcattgttaaaaatagattatggtttgtgcctagcatccatgttttaacttcacttgcatctcttgtattctcacaggactccctgagcctctggtacttttcaccaaagtcttccatgatctctgtggtatggtagttggagagctgacatcatgatgttgggaaatgaaaccaatgtttgtgtgtcattttctgggagttttctgccaggggtagttgacttacatgcaaggaattaatgattgacttcttggtcttaatttcatgtggaattttgt

SEQ ID NO: 125127 - DNA, 1014 bp, Homo sapiens
tgagtcaaatgaaaaacatagactgtttctattacagtttaatctgtgactaatatcttattttcagtgaaaaacttaaaagaggttttgatttcccaatttacaaaataaattagttcccggacaatcatttgaagaacttttgcgatacaaatcttttgattaactaatgtgcattattttccatgaatcttggtgttttggtgccaccttgtggcttggccttgtagtaacttcaacactcatccattttaaacaacttcctggggagaatatgatgtgctaggaattctttccaaggtacaaataacatactactgtaagtctacattaaagacgtcgagagtgacttgtttgttatttggtcacgaggataggtaaaactagtaagtaaagaacctgatacattattttcagtttctaagattctttgtttatgctttttgtccctagctgctactgtttgaacggtcttggatgaacagatggaagtctgctgttctgcatgaaggggaagggaacataaggagtgtgaagtggagaggccatctgattgcttgggccaataatatggtaaaaaatatgcctctgtcttcctaatgcttgttcagtggcagaagaatggccaacttgatagggctgtaatgaagggaaaagatgccacttgctgtggtggtgatttctaaagggtgtaaggacgattggtatcatacctaggaggttaaagaaattagattgcttttggctttcataatatagtaattcccaacatattctggaatctattttagagtaagaaacctgaggcatggagagtagccaagaaaatgaaaagctatcttaataattgaaggactgcattgggaatgggtcttgaaaatatcatttgcctgttggccaaaggcaagtaagagttgatatgaaacaagtgcagaatattgctgatttctcttttactcccagtataatcatagacagaagtatagacctgtctgtaagaaagtggatcgtaat

SEQ ID NO: 125128 - DNA, 1050 bp, Homo sapiens
tctgtctatataggtttcgcagaattaactgcaagggcatgtccaaagtctgtgttgctaatgcaggaacggaaaaccaaataccacatgttctcatttgtaagtgggagctaaatgatgagaacacatggatacatagaggggaacaacacacactggggcctattggaggatggaggatgggagaagggagaggatcagaaaaaataactaatggatagtaggcttaatacctgggtgacaaaataatctgtacaacaaacccctgtggcacgagtttacctacataacaaacctgcacataaacccctgaaattaaaatacaagttaaaaaaaaaagtctgtgttgcataggaatggtgtttactaaaatattgtttgtaagcaagtggcatttgagtgggctctaggaacccttgtgcacagaggttttccgtcgtaccaacattttgtctatactgaactggttttaaacatgttaaattcagataaaggagattgaagcattataacttgttcagaaaataaccactgaatttaaggaaataatatatttgggaagttctctttttcttcccacatgtttatattctatcttgatggacacagtagagctgttggtggtgtttagagaagctgcgtgtttgaaactttggcactaagcctaagcacgaagcaaaacaaagacacttacctgctccatatgggttcctggtcattcattcctgcctccttcagggttcaagaccccatttgccatcagtagccagccaccatcctaggtcttctccacactcactcatatttttctcacttgccttcttgacttttaaaattttgctcatgatcttttctaatcttgaatatttaaatccttttgtaacaagactttcccattgttatcccctttgtttatttttattgagacagttttatttgctgggttttactattctctatttctctattttattacctggatcttctgcaccttcctgacgtagcacaggtcctcctttgtgaaatatttgttttcttcaagccccttgg

SEQ ID NO: 125129 - DNA, 1018 bp, Homo sapiens
ggctacaaatctttttagaatctagataatccggtgagccttttcttaccactgccatccctaaacatgaagtgtaggagtgcttcctcgtgtgtttgttcatctttgggtcagattggagctggggttttggtggctagaagggttttgacattagcagttcctctctgtctcctgtccagtgtttggatctctaggatagtatttccgcaagttttcagatgcttgattgtagccttctacctgaaacttcttcccacattacttaccattgtagttttcaagtgaatcgtctgaacatttttaagaattaaaattaaggctccctagttaattcacagttacaccacaggcagccaccaatctaacggttgcacgttgaggcattgtaaatacatacctttatttattctaggtactgtgttgtaaattgtggtctcattcctagaaatgtatttcatgctgtcatcaatgtaccaaaattgattaaaaaccattgattagcaggaagtaaaacacaaatgtaaccttcacaagcatttttttagatatgaaaaaccaagcaataaaatagctctactgtttaaagtatttttcggtgagttttcctatgtatactaagctatctgaggctaaaaatagaaatataatgcttaaataaaaatcattttcagtcggaaaaacaggtgttcttcattgctgattgcttttttgatgtcaatatgtaggactcccagagtatttgaatggtatctacagcggtcagggtgggagagttgggtccatagcaacttcattttcctttatgattcccattgtctcatatccatcaaatgcctgttaaaaaatatacttttttctttaatgagttcagctaactttttcatatatttccatactgattgtagctttcccctgaactctgatgttaaaactaccatctctcttccttataaccatcttttgctccttgctgataatatcttcttttgcatatggagagtcctgtgcttattct

SEQ ID NO: 125130 - DNA, 1078 bp, Homo sapiens
ataagtcaaagactgtctactcttaaaactttggtttggggttctttccctttaaaaagccattatatatcatcattctttaaggaaaacctgtttttattcccagtacaatcaaagcaccctagggtaatacaagcaaattatttccacttactacagaagatatatatatatatgaatgagatatatctatctatctgtatatatggaggggtgtgtgtgtgtgtgtgtgtgtgtatgacaaaacaagtcttttaaaagtgtgataatagtttgtgatttagaataatttatttaaaaaagccattataatttattttacttatgttaaaggctttagaaacatgtaactgtgtccgcaatttaatgacttgtaacatacaaactttgatttatttggatccattaaattttatcatgtaaatatgtatttactaagtactaaaaagtaccattttcttgataaactataatgatctgtttgcatatggttaaatggagattttcaaaatgtgtatcagcttggtgtggtttgcagaaatctccagagaatttcctttttctacatgttgtgtggtatgtacttgtaaagattatttatgcttcatgtttttgacattagcgtgttttgtttgttttgaaatagatttatttagttgaggtattttaggatgtatttttctaatttcattaagaaatatatctgatgttaaaaactaaaggcatttagaaggttacattaagaaaggaggacttgtgaaatgatcactttcattttgaaagtgttcgcaaatttttaggaggagctgctctttttgtaactgagttatagaggtttatatctttgaaaaatgagataactacattggctcagtagctacttcaatcctttcagctgcaattttaaactagcagcagaaactaggcagaacaattttgaaaagcccaacatttagcaaatggttataaccttgcaataatcatgttatagatatcaagatccctcctctgttgagaacaggtggcagatcacatagggggaaaagagaataaagacatatgtcagataactgagagg

SEQ ID NO: 125131 - DNA, 1049 bp, Homo sapiens
atgaggaagtagaaacaatcagcagagactcttctttaaagaaatttagtaataaagaagagagatcatctggtagagagaggggccgtgtcctgggaaggtttttgccgaccatgttttggttcatggcaaaaaccagtgaagaggaaaagattaaaaataaagagaatgcttcttggagcagcactaagcaatgagatcaacagcttaggtagggaagataatcttggaagagtcctagaccctctgcctgtgaaacaggcatgaaggaagtggactgagcctagctattgcaagttagacagtgaaggaggagcacttgtgggcaatgaccctgatggctttattttcttacatctgaagggaagaaaagggtaacataatgtgtttgaggagcagaggagatgtttggaatcagtccctgatctacagttatgcattacgagagagctagggggagagtttaagaatgtgaaacaatagaatgtgtgaatccttcactactggtattgaggatggattaggaaagtgttgaagggaagaagggctaacctgggaggtaggagtgtttagagcaatgaaggatcatatgctaatccttaaaaatgacattgtaggaagaggaatctattccattgtaggagggaaatgtgtcaattaatacaagtataaaatatgtttaattgaaggtatatagaagtaaaattgtgtgagattttgtgtgtgtgtttacctaaaaaaaattctctatgttaaattagaaaaacacaaaattagttaagttggtgatttcatgggtggtttggggataaagagagaaggaggtggagtctatgcaagcttacagccacaacagatgagctccaaagatggaggtgcactgagtggagccacgagggcttttgttttcatcccctccccaagatgttaatgatgttatgtaatcataaagcccttgcaaatgaaggaaacagtaacaagggtggtggagcaaccttaagagaaacctgggtagcaaggggctggagaaagattggatgagtgggaag

SEQ ID NO: 125132 - DNA, 1023 bp, Homo sapiens
ttcacaagagaatgtgaaggaagattgggctggctttacattcaggctgaagaatttggactccatttggtagataactagaaattactaaatatttaagaacaaagtaaataaactgaactaagctttaagaaaattaatatggtgactgtatacagtattgattgaaggacagataagagtcaagaggactagttttagataaaaattatggtagttgaggtgtctattatagttgttgaaggaagaggtcatttatttttttcacctgtttattcaaacatttattgaccagcaggtaaaggagagatagggtctgatgtatgttttaaaaagttgaatttgccagagtggagggtgatttaaacaggagagtgattggggacaaaagacaatttagaagcctaatataatactctaggcagggcattacaggatctcaatgaaaagaatgatagtgagtgttcaagatggaaaggatgaaatttatttggacagcctgtgctaaatagacttagcgagccttagtgatggcttggatgagggtgatgaaagacggaagagctcagggtcagttcaggttctcgctttggggatggggtgtgggatgccatcagttgcagtagggtatgtttgagtaaggacatggctaggctagtttggtcctgagtttagataagtgtagtacatcaggtggggacgttacggaggttttagaaacatgaatatgggcctcaggatggagattggcccttaaacacaaacgtgataaccatagttgaataaggtgaagctatttttaaagatattatccaatttagagctgtagagtgagaagagaagactgatggtgaaattctggaacactctaacttgaatactcaggctgtggaagaaaaaacagcaaaggagtctaagaagaagcagttggagggactgtaaggaatcccgaagagtggtgtcagagaagccaggggagagagggtttctacaaggaggaagtggtcagcagtgtcgaatgca

SEQ ID NO: 125133 - DNA, 1053 bp, Homo sapiens
catcccttactgtttcatgagggtaggtttcctctatttcgggtaacaaaacatgtaccacatacttctaaggtactcacatggctctctggtttgtagctaatgagaattctcccaggactttgcaggagcttggttctatggctcattgttaggaattttctctttttcttcattaggtatttttttttagcaggttcagggtagttgttagggctactacaggagataccgttttcaaaagggtcctctctcgtaacctttaattatgtgattcttatctcagatgagctcttcccaaaagcggagggattccctttacagataagtgtgattttcacagacaaaatggcaaaataaataaagagggagagagaggggaaataaatgagaattgttttggattttattatctttagtagtataacgtgtgagcagctagtttggcatgtcatagtagtgaaatgaaccaaaacattgaagattttacaaatcacccttgtgctgatactgacaaagcttatgagatttgtctcgtgaagttatatgttttttatattgaaatagaatataagaacacttgaggaaaatgttgctcagttaaacatagtaatagaaactgaccagagagttctattcttgatttgccaccttcagcagttactcctccagcccctactgtgggtatgacagtgacatttttgcttctggcgaattcttaaggatagtgatgtgtatcggtgcctgtttactatgaacttgtttgattttgttctcttttttgtttattcctctttatcactatactcttatgccttcaatatgcatttttaatttttgaagggacatttatcctcagcaattcctaatttaattttcagcattacatccacagtcccagtatttatccacacatttactgatctgtcagtctttttctacaggcttatgcatcatttgtttacatctcatatacttttctgcataatagaaatcactttttttctaaaatttctttattccatctataaggcagaaggaagtttatccatt

SEQ ID NO: 125134 - DNA, 1019 bp, Homo sapiens
ttttagtgtggaaccatgatatatttttggaaataatcttcccgtatttttattaacattggtagaattgaaagtaaatcttttagtacacataattacatgtaagctacccccttaccatgggttagtcagtattgtgaaaattgagaagctagtatagaatgatctggtaaagtggttggtgatgataaaaatataaagacattacacaaacacattccagatatctaaatctaatgcatctttaaataggttttgtgggtattttttcctttcttcagtgtgttaaggttcctagataaataattatttattagggttatttcaaggataacctttgatatttgcattcagttttcaagtcataattccagcagttgtttaaaatttacaccgtttattcagctggtgctcattttcaatcttttttttgtcatgacttttctgcagttctacattttgagacacacatatcgtatgtgtgcgtgtgtgtgtgtgtgtgttcagtttcagtttactggcatatgtttctagaaaacttttaggataagtacatacaaggtttattttgggatttcttgcatatgttgctttcatatgtaaactatagtataaaattctgggttggaatattttttctcaaaattttggagatgttgctcccttttttctgacatttatttgtgtagacatgtctgaaaccagcctacttttgttcttttctaaaacctttacaattttttttttggtcctgccttggaacttggactaataataataattacaacaagaacaacaacagtaataaatggtctgtgtaattcagtttgctaagttatgtctagttctggtctcttttcattaattttttctggagtaccgtcagtccttttgatccatacactgaagtattgttttcatttcagaaaagtttagttcggttataattttgatgattgcctcagttgcatttgttttcatttcttcaaagaaattcagtaatataaagctgaaggcaa

SEQ ID NO: 125135 - DNA, 1044 bp, Homo sapiens
agataaaagtagatcaacagcatctaattgttggatagaaaagaaaaagaatttgagtaatatagcaaataataaaaaatgaaatggggaaacataaaaactataaaataatgtaactaagccaatgctaaatggatcagatattgttatattgattaaagaaaaataaccttagctttgaaggacacatattttacaaaatgagaaagtgaaaaataaaaatgtgagcaaaatacacagtaaaaagccaaacagaaatcaagcgtgttggtagtagaaatgtgataaaaactagaatttagggcaaaagagcattaaccagcagaaggcatagtatattgattacatttacaagttaaaaggaagattgagtataatcattgtaccctttgatatgccaaattatagggcatctagtatctggaccaaaattcatttgaaattcaaggataaatgaacaaaactacaattggagtatgaagtttttgaaacttgtttttaatcagtctttgatagatgaaagagaaaacagtaaatatatagagaaattaaataatataaatagcatgattttaaaatacatattttgagcctaaaatagagaatatgaattattttgaaattatgtcttaggtttacaaagacaaattattaaatttctaaaaatagatattatacaaaccacattctcagaccacaatgcatccacactagactttattaataactagattaatgggcaaatacaacatcaccatccttggaaatgaaacaaaatgttacttttctcaaaaaggaaataattactgtaattacacattaacttttgtcctttggtttttgaccaatgataaatcaaaagcattttattatatgactgacaaatgagtcattataattattaggcagtatattaatgtctggaaattacaagatggtgaacaaaattgttctaaagtaaaaagggaaaaaattaaggaataatagtaagaaattaataaaatagaaaaattttaaaataaagtgaattgttgagtttctgca

SEQ ID NO: 125136 - DNA, 1042 bp, Homo sapiens
tttattgaagtaatgttttgaacatttcccagattgtgaataactgtcttgagtacatagtcactgtctggtgctgtgtgcgagccaggcttctaccattgtccgtgggcttgtggcaggcacaggcagaagatgaagtttaacaaaaggaaaacagctcaaggaatcagcagtatgccagcctcttaggaggcaaacccttcaaatcctccctgtgcttttaaaggttgttaggatttagaaaaccaatgtctatctaataagtcttctgtaggtggaaaggccgttccgtgcccctgcctctgttgaggttctaccgtcctggtgggtgcaacagcggggtgaatatctgagccttttacctgtcagccatgcacacggggctgttggtctcaggcacagagtaggcacagcagcctagggttttaggggtcaaatgaagttgcaaatggtcattttctatggtctcataagtttacagcatataaatgctcttatgggggagatggttaaaaactcttgattagaggaaaagttaaggaaaaaagaagggatattttaatgaataagcagagactgatttataagcattctcataaatacagaaaatttaagctccattgttaaacagggatgacatggatgggcaaaattattttctttccaaacaagatgactcttcctcaaaatttctttccgttcttcacattctcagatgatttttattttttttagattatttccaagatgttaaagtttaatcaaggacgtttatattctaatagagtaatttgtttttaggtcattagaatggaagtttaagtggctaaagtttcctaacaagtttcctaacaaatttagttttttcagtctatgttagaagttagagaatattagggctctacggagatatatataaatgatgcagtctgtatatcttaaagtaatgattttatattattcactttaattttgtagcatcagggcacagccctgatgaaccataaagctacttgaagcactgcagctagtttgaaatcac

SEQ ID NO: 125137 - DNA, 1672 bp, Homo sapiens
ctaaaagagcatcctgtaacacacccccactggggcttcagaagcttaaacattcacccctagatgctgccgtggggtcaggagcaccacagcccacccatctgcatgttcctcctaggggtttgagcagcagggcaccgaagaagtgagccacactcccatcacatgccctgtgaaggagatgagggaacttttcctgtttcaatattctttgtatgtccttctaaagttttaaagttttgctttttacattgtcttcacttttcctcaagaaaaaaaaattctcactggactgtgagaagaatttattccttgatattgtgacagatactgaagttcttaccttgccagaaaaaaaattacacgaaaatgagtcccttgaacctactgatttcccattttctttccttagctcctgtccagcccttgaccccattgcattagtggaatctactatcccagattggatgtagaaagagcagtggtgatataatgattagagaagaaactctggcggggcggtaatgtccagcagaaggatggttgacgggttctggaggtggcagcactgcacgcaggccaggcttggggtcagacgccagccagccagccctgccacacgttcattagtttggtgtgttaccacactttcttcatctgtaaagtgtggatcataatcacacctgatttcaatgatggttttgagaattatatgaacgaatacatgtaaaatatgtaacataaggcttagtaaacattagtcgttatcagaaggtggatcaagctaagagtccaactgaacatgtttactacacttcctgaagaactattatttttgaatttattcatatgtttggctttaataatgttcaattgtatatggggtaggcaaactgaaagggaggtagggaagaaagaaagaaaaacgaaggggaaaaaaagagaagcttctgcgacacacccattcttacacccattttgctgcctccctatccctcagctcctgtgtttatttgggaggagtgggtatcttttatcacattacacaaatagtattttaagaacattattaagcttgagtaattaggtgtgtgaagtcgatcccagtgcaggtctagtgagttgacttcagaaatgtcttttcgatgtagcaacattgcaacatggcttgtaagatgcttcttttgaaaagttttgagagactgcttggaaaatgatttaatggggattgataaagcagtgtttttacactggagagcattataacaataatttctgtggtggaagtagagtcaaatttgtgaagtgttaagtagtctttcttcgtcatatgttggaaaaataaattaggcattttctctttggttaataacttggtctcagttatttaaattatttgtactacccaccctttttaggtaagtgactttactaatgtggaaaacaagggctttactctctcaaatgtttagattttagataaatagaatgcattagcattgctgcagctatcattaaatcaaaaataaaagtgagaaaaataagaacacacctttactcctaacagatttttcctttatcattgatggtatcatttacttgtatattgagaacttaaacagggatatttatgggccctgctgagatgttcagaaagctctgcagccttcat

SEQ ID NO: 125138 - DNA, 1011 bp, Homo sapiens
gatggggtttcactgtgttagccaggatggtcttgatctcctgatcttgtgatccgcccacctcggcttcccaaagtgctgggattacaggcgtgagccaccgcacccggccacattcttcttatgaaacagggaatcaccaaagggtgaggaacatttaccatggacttcttgtcttcatgtatattgtgttaattatctagtagtatcttgggagtaggggagtggagaggaaagaatggatggtgagatgcaataggagcaaattatttggcaggtttagccaaaggaccaaaggaaaaagaatggagtgttttcaagggagtgtctttgtggtgactgactttggagttcagagtatttagggaactaaatgaaccagaaggatgatggtaaatcggatgtcatggaccagatatgtggataaagtatgagtgtctgtgcatatggtttaacaataaataattttaagcttgagtttgttttgttaataatagacttcttagtctctgggaaccatgacagggtatacttcaaaatggtagtgtatacttctttcttaaacaagctctgtttttctgtttgtgtagctttgttttattcacctgctctagaacttatttatttggctataatttctaatgtttttcatttaataggatcatgatatattaggatagttgaatacttaatggatatttttcatctagccactcaagacatgaagttcttgttacccacacaagaggttggtttgattgttgggctaggtatcaacccaatgaccacaaccaaggagatttagtaagatttagtatttagtaaagggattttattgcttgtaacaagtagggagaacaccagggatagttctcaaagcagtgtctcccggagctggggactgggtcaggttttataagcatatgataatgaggtgtgatctgactggatcttgcaatgaggtgatgccgggaggtctgatcttactggatcctgacttggggtgatgct

SEQ ID NO: 125139 - DNA, 1052 bp, Homo sapiens
cttaagctatgtatccttgaacaaagaaccctgctctactcttggtctaatggtactcacttatcgacctgaagcaaataccatctgtagtatgctgttctagatgtggcatcattaattggcaagcagggcatgtatctttttgatatgatcaaagtggttcattgttggctcaagtgtgccagtgcctgtaatacttgtttaagactgattgacaggtctcagattcttgtgtgtttaaagaacttgttttctatatttgaaccccgtattttgagtgataagagatgtgtcaaaggaattgaaaattacttaaatggaaatcattctaacttctgataaatgatgccaaggcaagtcatatttccagttgtctgcattaaaaaataatctcaagtttgtgggttaagtatttatagataacttgataattttgatggcttctacgcaccaaagtggctaagaaaacatggtcagaattaaggatgcttctctcttttagagtaaagtgtcatacttactgaatgttttaacatctgacccttcagtggtaactacatttaggcaaatatcccttaaatagctaaaactgaaaatattccttcactgaatgaaattaccctggtatttcacatatttcaaagtcagggttgaagtaattttaactttgtggaacatgactctgaattgggtagtagactggggcttagttgtctgaagcctttggatttcattcttcagtacagggtactctcagttctggtggttctttctttggggttcaaggccattattgcaaagtaagagctttaaaaggattatgaataaggtgtagacctaggggaggaatctccacctttgcagttgggagacagggaacctgtagaaagtgaaatttgaggtgaatctggaaaggtgaatgtgtattttccaggttgttagagtggagttaagacagtgatactttttttttttttttttttttttgagaaggagtctcgctctgtcgcccaggctggagtgcagtggcgcaatctcagctcactgcaagc

SEQ ID NO: 125140 - DNA, 1013 bp, Homo sapiens
aaacccacctttctaatcttagttttaatttcttccctctctagtaatttttatctgctcactaccttctaaatattgccatgggcttgcctgtttctaagcttttgatgacttcttttctctctagaatacacttctgtgaatctccattctttctgcaaggtacttcccctggattgtagccctgaggtgtttccttcctgtaaactcctatattactactatttcacttgtagtgtggcccctcatagtgtcagtaccagcctcacattcctatttaacgtcttggaggatagttgccatgtctcctggtatacttctctcctcttccccaccctttctcttttctctgctgccgtttggtatccagtaagtatatattggctgataatattgttttgaaacataaccatggaactggtgattttctgttactacctttcaggaggcctctgggagctggttctctgttctcctgtgtattattctaccttcacttgtccattggatgtataattagaaattttatactgagagctactgtagactgaattcttccccacctcctaattcatatgttgaggtcctaaccctcaatgtgatggtatttagaattggggacttggggggtaattaaatttagatgagggccaggcatggtgtaaactcaggaggctacgacaggagggtcacttgagcccaggagttctaggctgcagtgagttataattgcaccactgcactctctagcctggttgacagagcaagactgtgtctcttaaaaacaaaaacaagttaaaaacaatttagatgaggtcatgagggtggagtcctcaagatgagattagtgccaacataagaagagacaggagagaccttcccttcctcccccttcctgccggccatataaggacacagcgggaaggctgtctgcaaaccaggaagagaaccctcaccagaatgtgaccatactggcagattgaggacctccagtctccaaaactaggagaatt

SEQ ID NO: 125141 - DNA, 1087 bp, Homo sapiens
ctttctgtaaggttattttttaaagattgtgctgcttgactgaaacacttagtagtgcctgtaaatttgagcgtttcattatgggttgcaatgaagcatgctcacatgcaatgaaatacagagaattttggactatttgagtaatgctgaaataaataaaaaggaagaaaactctcatgtcatatttcaggtagtcctaaagtttcttctggtttacttaaggttagttcagagaattaaagaaacagtaggacttacgacataaaatgagtattttttgacagttattttataacacaaaagggtttttattttgcatgataatataaacattaacactcaacattatatattaacttttatagaagcatcctaaagctaactgatggtataagtacacctgagattttcggtctctcaatatggcatggattttccattcgaaaaaataatttgttgtttgtgtatgtgtgcagcttaagcgatagcactgatttacacatttgccataaattagggggagtttctgaatcattcttttctcactttgagttcaactgtaggttggtcgtgttttcaccgctgcatttaatttactgcctcagtccatcaggcattgtgtatagactgcatacacaccattagttgtcagtagatgagggtcctcatgagtcattctgacagctggcttgcactatcacaataaaataggccctgttctgttatttcccagaagctggaaacaagccttctccaaggcatgcatatcttttgagacattgcagatcatttatgcattaagcatcttgtctttaaaaatggttttgttactacttgtgtattaatagtattattaattaattaactggcctctttgttcttcttacagtttttggcattgggcacacattatggcaaggtttatttacttgatgtccaggggaacatcactcagaagtttgatgtagtaagtattctgtataaaataatgtatgagctaaacttcatgttaagtatttgtgttttagaatattggtttaccagtttgttttaatagcataaagaggatctttattaattcaatcag

SEQ ID NO: 125142 - DNA, 1031 bp, Homo sapiens
tgtctattttctaatttcttttttaaagttcagcacagctgtcatctactatgttccatagggtcttagagatacttccattttaagcattctctttaaatttaattgtaattaatccatttttatgtctgtttccctcattataccataacccttttaagtcacacttggtcattgtctaagcgtattatagagtgtttttttttgtgtgtgtttgttgaatgaaccagtgaatgaatgaaatggagaacaaagtttgcctgcctagaggtcaaacttcattaacattgtacgtaaaccaactttgccaaagagcctgatgtttgggaactgtaatcaatgctaacttttagaacatgcactctttatctgaagtccatgtttctatttaagaggattctgatccagttgagtgttttagcttttaattctgatcctaattctgctactcatcgactgtttccagggaagtctcatcaactttctgagcttatttcctcatgtgtaattgaaggcactccctgctgtaatgctttgaatactataaaacactatgtgaaggtagatgatattagacagttgaccagatttaaaatggactactcttgtttcctttgcattgtccaaaggactgcttatcaccttttctgcttgtttccttacataaagtccagtctttatggatgtacatttatcagttacttaagttacttacatgaagtttaaggtaaaagcagttgtgcttagtggatgatgcccaatctggtagtatagaaaatgagtcaagtttctgtaattaaacatgaaagggtctagtgaaattatatttattctttgcccatcttgaattttaagtacattcaggtgaaaaaaaaaaagaaacaaaactcaataattacaaaagttcaaggcttttaatggctggaaggtgggtaaaatttgagaatttgtatttatgttgtcacatttgtggccattttgcattttttgttatattttaagtagtggaaagtattagcaaatgatgaaaa

SEQ ID NO: 125143 - DNA, 1069 bp, Homo sapiens
tacaacacactccaagactgtattaagtagaatgtagacagtgatcaaagtcaaagatttatatgaaacgggttttggcaactctgtcgctcacttaattcctcaaattataaggattcaattaggaacctgttaagattagaaataatgggaagctcagtgcttttaagttattcttttattaagttattcttttattaagttattattggaaagtataagggattacattgtaggtgttatgaatagtagaaatgccccaaattattacttatacgaatgaatgaatttattccacatctgggtccttgccgtaacaaagctctcaccaactttctgagtccagggtaagtactagatagcaccgttagcctattcttggaccaaaacagtttgtgtcatagtcagaatattggggggcagggagcttcacccattgctctcttcttccctgtgaccttgtaagttttactccttccacaaaaagcaaactgctcttgtctgatccatctcctggctttatcctatgttactagcagttggcctcatcctcccgcttgcttcccacccagttcctttttacttcaaattttgtttcattgtaaatagagtcctgtacccccaacactttattagaatgtatgcctgctttctcatgttttaccagcaaccttctcctttgagatgccagccatttggctgcaatgccatcgaccccttttcattgctgccattctccaacttctggtcccttttcttcactcattgaatattggccttgtagttcttcaaccaaatttcattccagtgacccttacctcttctctgtttcatctccccattgataaggccacactttggatggtgtcagcactggaacttgaggatcttagcctctgtgacactctctgttgacccttgttatacttcaagcttttgtgctcattttcccacaagctatatgactttatggagtcctgatctctaatcctttcattctttttcttttatttttctgtgtctatgaaatgattgattatcctaactctatcttaccagcatcttcagt

SEQ ID NO: 125144 - DNA, 1047 bp, Homo sapiens
ggtgaagctggagaggatgaaggtcatctccacagagtgagatgtgaatagttgaggagtgctccactggtggtggtttctaccagcctaatttgggctttataagatatctcacctttccccaatcagtatattgagtatcattttattttgtaaaaacaaaacaaaatggattttaataaagaaatggtatccagaggtgacattttaagttctgtgtaagtagtaacagtagaaaatgtgatgatctttctcttaacccctagaattcatgtgacacacatttttaaaaagtaaaattcaagtcttcatttggcctgtaacagtgatgccatataaaatgtaccaatatatgtgaaagatatgtttaaacaagatgaaaaatgtagaacccattctgcacaattatttttggttgtaaacactgaaaaaatcaatttcttgtatacaaattttaaattattaggtgaaaagaaatgtaaaatattcttgttggtatacaagaccaagttaggtaaacaggacttcctccatgaaaatttaccccatggtaacactgtaacaacatcactaaacagtttttcagggagaagtctttaaatgctttgatttgttatccttaaaagtaatttccctcctcctaagtccaaaactcagtaagattgaccatgatgtgacatttattttcagatagtgtttagaattctgtaggatggtataaaggacttgtctttaattaaaagtgctctacacttagtaaaaatctatgtgagttgaggaattgattctttttaaaagaaagccgcaaatttttcttgtatgggtaaatgtcactctgttcatatcttcgcttagctgcaagtcaggacttgtactattccactaggttgtcatagaaacgcagttaactgtcatcttaactcagactgttgatggttttatttgtaggtttgtaggattattaaaatttaacaaaaattattgatttgctttttattaacactgggttgtttaccgtggaagtccaaactgcatgaaaaccttttt

SEQ ID NO: 125145 - DNA, 1049 bp, Homo sapiens
aactagggctttgaggaggcctttgtcaaacagaaacaaggaccactcctcgcctcctgactcaaccggagaattgttttatcccatgccgtgtcctcacagggatcaatatttaatttaggagcaaacaaatgagaagtttttttatttagctttgagtttggctcagagcttccaactcttttgctcaccatcatttttatcctctctgatccttatattattctctgtaacaggcagaataatggttccccaaagatgtctacatcctaatccctggaacctgtgaatatgtcatgttacacagcaagggaaaattaaggttgctaatcagctgactgtaggagagtgagattatctggacagggccagtataatcctaagggtctttgtaaatggaagagggaggcaggagaaaaggctgtgatgtgggaatgattcaacctgcctttgctagctttgaagagggaagaagggcccacagccaaggaatgctggcgctttcagaagctggaaaaggagaggaaagggattctccccccagcttccaggggagggcagcactactgacaccctgattttagcccagtgagatctgtgtcagacttctaatctacagcactgtacgacaacaaatttgtgtcgcttcatactactaagtttgtcacattttttttacagcaatgataggaaactaatacagtaaataatttgattgaatgaccttgtctccttaacacttttcattaggccgcatttcagagttttggaagtcaaatacatccagcaaggagaacatacagaaaatggttgtgacgaaactgctaatactgtggggagctgtatttataaaaatgtgtcttttctgatgattgttcaagagtgtgtttaaatgatcatttcacttgacaattagggcctgattctatgctgtcaaggctttaaggcattcctgtctctgcaggctcaagaaatgctataacaaatctaaatagcacaaaggtttctttcatccatgagctatttcagtttcagtgcagccgttttta

SEQ ID NO: 125146 - DNA, 1661 bp, Homo sapiens
ggtttcaccatgttggccagtctggtcttgaactccttacctcaggtgatccacctgcctcggcctcccaaaatgctgggattacgggcgtgagccactgtgcccagcccagatgtttttgttttaatgaagaacataaatggggtattcacccatttacctcatgtgcatacttgagtggattctatatgaggaaaaaaaaatttccttaggtttaatgtgattttcctgaaagagtactcaagtgtctttttagaactgtacatacaggaaataggaatcttaagtgtggtttattggcatagttatcaaagccttgtattgctgatgctaataacataatattcagcgactcacagagatggaaaggatgttagaagtcattaaactcaacctctaagcctcactcttccaaccccagtggtgttaggaaagtttataatgttgtgggtggtgaatggaacataatgagcagtttataatagatgttcagtaaagaagtcagaatagtgattgttaatgttaaagtggactatgtccacaagagaaggatcagtacagtaagaggactaaaaccaggaactgtgatggtgagtgcagaggagaaacattttagaaggtggaacatgatacatgtcattaactctctggacagctatcatgtagtgcaataattgttttttttatgtagtgctaagaacaaaaatgttactgtggattattgtagcttcaaatgaataagaactttatgagacttggattgacattaagctaaacaggctgcattgagttacagaggagattctaatattcattgtggttaatgatacaagtataataaaattcttaattacaaggaacatatccccattttacccatggcctttgaaggcaaggactgtgttgtcctccaggctgtactttggaaggtgcctgccacctgtcaggctcttgctaatttttgatgaatgaaattaaaatgattttaaacactagatttacatttatcccgctgtccaacttgtattgagtaatatatgcatcgatcttccttaaaatgttcatttttttcttgaaaatgtattagttatatctaaaatgtccttgccccatttttttcttgttctttgtttatctcatggattgttgtaaagtgcttacattcagtgtcagcatattagttgtaaccttttattgctattgatatctataagtacgttaagtaaatcttcattttgctgacctctttgaggatgcatggcatcagcagattctctctttcactggacaggtgagagattagcaggatcaagtcaatttttccctttttgctttgtttccttcagagcagcaagattcattgtctagcgagagggaaactgtgttaaatggcagaatttgtcttagtggtgatggtttaaagagtgcatgtaaattatacagcttgtttacacagggtctgataggtaccactgtaggagattcttttaaaaagctattttagcaagacagtcattttaactcaaccagattaatagcatgataattaatagcacaagaacttttcagtataaaaattggcttgtagataacatgagatggcagtttcctcttcccttctgagattagtgaggctgctttgccagatgggtttccattat

SEQ ID NO: 125147 - DNA, 1679 bp, Homo sapiens
agctaaaagtgtataaaaatggagaaaatagggctgcgtgcggtggctcatgcctgtaatcccagcacttcgggaggctgaggcgggtggatcacctgaggtcaggagttcgagaccagacgggccaacatggtgaaaccccgtcactactaaaaatacaaaaaaattagtcaggcatggtggtgggcgcctgtaatcccagctactcgggaggctgaggcaggagaatcacttgaacccaggaggcagaggttgcagtgagccgagattgtgccattgcactccagcctgggtgacaagagggagactccatctcaaaaacaaacaacaacaacaaaaaaacccccaaaaatggagaaaataactgttctattgaactttttagaaaacttggcatacatttttttcttggtatcatgtatcataaatgccagtaatctccaggattagcaacacaaaactaaatgtctccacattatctttcgtgagtgttgtttctttggtgattgctcccctccccatttattttcagaagaaccaaaatagtgacatctgcactgagttattgtggtataaaacagctcagaggatctgaaactaaaaccactttttaggtatgaatgaaaatttttttataagtcactgggaaattcttgcttttgcctaatatggtaaaggtagttgtcaaaagtaactacatatatattttatagtttacagaaaaaatgaataccctgcattctgcctggaaatcttctaaccagcagttttgcttagctccaaaacgatttatagttgaccttcatattcacagatgcccaacagtatttgtccatatctttcttatgaataacattctgcttgaagtctggttgtttgtgtatttgtcttatctctcctagagattgctgagtcctcaagaataagaacaagaacttactcatgtctgtatcttccacagggctagtgctttataggtactaagtgtttagtaaagtgtttaaatgaatttattagggggaaaatagcatttcaaattgtcaaattgtatattagtaggatttgcgtgaaattattttatcttacttgcaccttttttaagttattaattcagatgtaatgtggattacatctatactataatgtaggttacattctatactttctttactcttgcctgctccccaggtaccctttgatcttcctaatcaaccaacctggaccctggtccattaaagtatttccacgattagaccatctatttcttaatcaagtaggagagtttctactttgaattctccttctgcattttagaaattaggggaattctgtccttattgtagatcacttatggattattagatgtcatatttgtcatgtatatccccatgtgattatgttacaataaaaatcaaatcaatacaaatttgagtgcttcgattttcttgcctgtaactgggaattttactctctaaaacttttgtgagtatgaagtatgttaaaacttttgtgaatataaagtatgttaaagtggctaggttgaaatggttgtataaataagacagaggttaatcatcgaaacctggacttggcttacgtatgcacaattctcttttcttacagtttggctaagatagatattttaaaggcagtgttactactaactaaaggaaaaacaa

SEQ ID NO: 125148 - DNA, 1067 bp, Homo sapiens
aatatttacttctcccattaattatatcctgtactcctagtaattttctaacaagccaactggaatctgcaggccatcagaaaagtgttaaaaattatgcctcgtgttctaaaaggaattaatgtctacagctgcctgcttacaaaaaaagagctggtcacattggagattgctgatggcatcgaggtggttgcagtagcctagaatggtggctacacgtcttgtcatctgtagagtatcaatatgtttttataatgatacaataacctgaaccctgtaacggtttatggtccttttgagaattcttatggattcttagagtgacagaggtctgagaaaagatcttgaaagctttcacaaaatctggctgggtgacagaaaactagcaggactgtgatttagccgctaagaaatcctgttgaccaggaacatcattaaacttttaagttaaaacaagaaccacaaaacaaatggtagatgcaaagggtaaggggtacccaaagtggcagcaaaaattaaaacgtgccgaagattcttagataaaaggcaaaatgcagcaagcccattgttgatcttgatctcctacttagaaataagcattttttaatataccattctgaatattgcaatgtgtgttggaaatctgtattcatgcatttcctttatggaatctgtcagaactgattgttgctctttcattttctctggctatttttagtcaatgataaataaagaacttgaattttgaatctggcaccagtgagatatagaaccagaaacagcaggaaataaccacgatgagtaacttcacatcagtatctgcacggagagctcagtcctcttaacatttgtaatactgctaatttctatgggctttttaaaatacttccacatgagctctcaaaacccataaaagtgtggcatgtaaagtaaattgtttgtcacttgccgacgacctgccatatttattgtcaggagaaatggacattagttggaaaagcagttgttaaaggccaaacaatttttaaagatggcaaagatgcacgagggttttcctttttctaaca

SEQ ID NO: 125149 - DNA, 1034 bp, Homo sapiens
tgctcagtgatttgtggattttatggagccaccagtagcctatatttttccaacttaatcacacagacatactttgttgactttctgcctaaatccacataatggtagtaatttgtctatagtttcctccaagtctacaaagctaatgtttctcaggggaaaaaaaaaaagaattcttcctctttatttgttcatggataagatgtgccagctctgtgccattgccccctttaagcagttacaacccgcttatttaatacagttgctgtgagttttgcatgagaatgaagtcaatttctccagtctatagttttcagaaaccatcttattccatcttttgaaattttttacattttctcaatttcacaccccattctcctatgcaaattcaaaagttatgagacaagttttgttcaaataagctttgaactaaggtaacctaaggactcttaaaaaagagggtaatggacaacaggggggatctaccccaccacaggaataaagatcataatagatggatctaataccaaaaatgcactgttggggggtgatatttatttccctcacactctatgcacttgtggattttgttccaaagataaaatgtttgggtaagagtcatttgaagactaatagagtgtaaaagaagaaactcaatactccacattggtatcactgaattcagtagttgaatctatattctaacctggcgctgtttattccctgcatgtttgattggtctcaatgaaactatgagatccttgaagatagaggctatgtcttatcattgcttggactctctacagtggttagcacagcacaagacatacagaatttcaataagtacatttgtcttgacttgaaagaaacaatcaatgagagccaggaaactagagtagaatcaaaattacttcttagataagcaatatgcgtaaccacatcctttcttcatcgcttgagcatctatcatacaaccagttccattagagtacagtaagtgtttgtagaactgagcacacagtaggcatacaaca

SEQ ID NO: 125150 - DNA, 1043 bp, Homo sapiens
aaacattattaacgatataccgcataacacacagaagatacctggggatcagtggcacagaaaaccaagaaagcctttacagtgtgctgttatttcagtctatttttggtgaatatattaaacaccctggcagtgccaaccagtaaaaacaaaccaagagagcaagcctgtgagagccagtaggacgtagaaagcttctcagacactgcatcctgtgctccatttgtcattctgtgtgtgggatggacatccggtcctcctcctctggaaaatccacagccacaggctcacatgagctgttccttttctcttctttcttgcagattctccatgctttcagcctatttacactgggctcacagctcaaaaaagggcaagaaagtgattatgtaaactcagacggagagaaactcaagctcctttaggcagtctactaacagtagggcgaataaatagaaaatacgatcatataaagaggatacaatactgagaagagtaagtttgggggtagtacagataactagaattaattatatcaagcaaagaacaatctgtaggcaactgcatctgagatgtgtccccaaactgcactaaaatcataacattatttttggataatcttctagccacctgagagtaccatgttttttttcaaacatggcattttaaatagggaactgcagacaataattcttaaaccagaaaaatatttgaaattttatattagggaaaagaaacacattgatagatcatgatgatctacactatggctgatcaacttgaaagtgtagctcaccatgatctatcagtttgaacatacctcatttgttcccacaattcccagctccctgctgtttccctgacctgtaactgctcatctccgatgatcgtggagttgagaggcagcggggcatagtggaaggagtgctggctcttgagtcagacttacatggattgaaagcttacttataccagctgtgtaatcccaagtaagtcatttcatcttttgaagtctctgtttcctcttctgtaatgatatcacc

SEQ ID NO: 125151 - DNA, 1026 bp, Homo sapiens
atctgagttttctggataagaacactaatataaagaaatctgagtgttcacctctggcagtcaacaaattttgcagagagatgctactttgtccaatggaccatcaccctgtttaaatttcataagaatttctattttatcacggagctaagtagaaccaggagaaaatacaagagtggaaactgtcagaggaagaagaaggaattcagtttcctggtggaataactgtttcttgggggcctcatggaagatactgggctcagtagcccaggctcccatccctctgagctttaaagtgaaagtttgataatccacacaacagcatcaatgcacacagactaaaagtccacagcttccttttcaactcttgttattgtcagtgatctgacaaaaagcagcctgcacgatcacacatacggatttagttgatagactcaaggaactagtaaggacacataaacaatagagacggcagaggaagggaagaaagattagaggacacatttacataaaatgtcagcccaagtcattgggctgccgaatcctgtgccagtgtctggtggcaacacaggccttgggactggagtagaccatggaaacccttccagattaaagacctgcccctcacatactggttaatccaactgaatctcgctgatctagagatggggctaacaaaggcaaaaattttactttcccagcccgctgattcccagatcttggccacttgccataagtagtgacagtggggtaaggaaagggccagggtgggatgcctgctccggagcccctcctcaacagacctgtctggcccgtcagtcctatacaggtgagagagcaagttttctgtgtagtgaagcctgctgaataatggtaaaggatcagtaaagacaatggcacacagagtgcaccacacccagacttggtcaagccagggccacaaagaaagatttctttctgtagttgtcagcagatcccctgcatcagaatcgcttgtgttacttgttaaaaatgcacatccctggg

SEQ ID NO: 125152 - DNA, 2973 bp, Homo sapiens
agcctccttccagcagctctctccagttcttgtctgtgatgatgcgtacgttgctctgccgcctgtgggtccagggagcacccccaagcaacagtaccaggactgccagcggaactgcaagactcctggagggtgccatgtctgccgcttgcccacctcacagcaagcgtggcggcccaacactaggttttttaaaaactgtgactatcagtgttttaaaaattgcccggtaactctagacttcaaaagtgggataagtaatgataaaccaataataaacttaggagaagcatagtctgctttagttatattgttatgccatattatggtcagtaacacagtaaaggcctaattcatctgctttctaaattggttctgtacttttctagaaaagcctacatgtatatacttagttacagctgcacttctccattacttatttttaggaaggttatagagatggaatagatgctggcaaagcagttactcttcaacagggcttcaatcaaggttataagaaaggtgcagaagtcattttaaactatggacgactccgaggaacattgaggtaatttttaaagtctaaatgctgaatcattttaacctcaatactactggaggatgtttctgtataaataaagtgtttaaactgaaatgcttttcctggtgctaaatacactaaagcgtgtcgcagatcatagaattatattgccttcaaaaagtcaaaatctttatcagctcatctactttaatgtgtgaactacatattgtcttttcgtgcaaagaaatggtaagaagatgtatacttctgctacctgaacaattatctatctcattgaaaggtcttcagattttgaataaaacttgtagtacttccacacagtatgacagacctctagactagaagtacatgatgaaaatagttggtaattaagataaaattgatttaatttactttagtcctgaacattgaatacttgtcaggatgccattgcaataatggcatatatcggagccaaatggtcaaatgatacacagagccaggagcctagcagccttgtccagtttgatgctctataccaagcttgtccaaccagtggcctgcatatcacatgtggcccaggacggctttgaatatggcccaacacaaattcataaactttcttaaaacaatatgagcattatgaaatttttttcatgatattttttcttttttcttttttttttttttttaactcatcagctatcattagtgttaatgtattttatgtgtggcccaagacagttcttccaatgtggcccaggaaagccaaaagattggacacccctgctttataccctttacactgtccttggtagagaaaaaaaaaatgcttcaaagaatcgctaattttaaagaagagtagatgataaaagttaccaaaacaaaccgaaaaatttattgtatttgggattttagaaaatccaactattaggaaccagaatttagtctgctacagtaggaaaacaatgtgaatattcacatcatcaagttgatgttacataaccttagaaagctactgctgaatcttttatatcaatggattctatttttaaatacttttcataataatcattattttatgacatgactataatattaaatctgttaggactagaagaatttttacctttttcaaggaaattgttagtagttcagcaaacagtttctactctgtgacataagcccaggaaagtgaagtctcttgaaaacttcttttctctaaccttcattcttgatggcaagcaactatgtgcttagaacgatggttttcaactttggttgcaccttaactctgaaacttaaaaaaaagataccccctgagattctgatttaattggtgtggagtataatctgggccttgataggggtcagagctcttcaggtgattctaatgtgcatccatgattgagaattgctagttaagaagctgtttaatgtccttaaagaagaaactaatttttctttctcggagttgtattcatcttcaacagatattacatagtcataagagaaaaatataaaatcaggaaaagcgtatatagagttatgaaagaggggttatgaattataaacagttttatgattaagtccaatcgtttaattgttattgaaagatagtcttatatttttaagtcctattttgctatttaacccttgtttatacttttgttcagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttttttctttgtcactggtaatttttatgtagttttaagatatggtcagaaatttctactgtcattgacatttccaaacttgtggtcaaaatgaagtgttttcagactcattagcaaaagtgaacaagaattaaacatattttgtaaggaccta

SEQ ID NO: 125153 - DNA, 1022 bp, Homo sapiens
agaactgctgaggccaccaaaaatgttgtgatatgtaaagggagtgggcagctgaatgcatatacctgcgtccttacctaatatatatcctttacactacttattaactgctttgtgggaaaccaaaataaaagccttcagcccagtctaagttgtgattctaccctcttccaactaaggttagagcttagttcttagaactaagtttccagtctaagatacaggagagagagagagagagagagagagagagagagagagagagtgagtgtgtgtgtgtgtatagagagtgattcaccaatcaggcttcttgttctacagaaattctcaaatctctgtcatgaagatactttaccgcaacagttgcctttcttgattttgcccctacgtaatgccttttctgaacaaacatgctggagcacgagtctgccatcactgtctcaaattcttaatttctcatgcactctccacctttaaactactttttgctaaagtcactgatagccagtcacacaactgtccatcactgacttgttttcagtcctatcatttgtctcctctccatcattggacatgaacaattcactgcttatacaatcccttctccttgccttctccaacagcactttttcttgtccgctcattactattccctatcattttgctaactctccccgactctgactgctgcttagatgtagggattccccagagtttcactgttggacctctttgtttttatattctgaccagatgatctcacctattaatgtcatccctgttcatccatagctggaaacattaagtcttcctctgcccttcctgtgccatcataccctacttctaactgagttgctttacatctttcaaacagtttgagtctggcctcctttcattctaatcacccagattttaattaatttatgtaccagcctcatcactaatgtcagtacctacaatctagctgtcttcctgtccattctgtctcttaccaatattatctttccaaaacagtttacttc

SEQ ID NO: 125154 - DNA, 1126 bp, Homo sapiens
tccctgcctactcgaggggagaatattatgtagaaagtggtttagcacatatactaaaggagaaactaaattctcctcggacttcttagactttctatcctccaaacgggaagatagtttatgtcactcattttgtgatgatgtgtctagcttttacatattcctattcaactgaaaggaagggtgttagctcaccactcacatatgtgcatactgctgcagatctgccaaaaagagccaagagtcctcagtgtgtaacactccgttttcttgccctataaatagtctgctctttccaaaaagaagatcaaagtactaatcagaactacctacagattgagttctgcggaagttgaatcctggtgctttcatgcatgtgtatgcaactcaccactgagagaggccttggacctttggatcctctttctttcgaagaagctgttgagttagttcaaggccactaggtggtgctcgtgcaccctgataagttagcacgtgtttcattccttggtaatgtgccctttgcttagacctcatggtcacaagtacaagaagctagtgattatccctaaagctataccagacagattgagccatttgtgaagttgggtggatgaggagggcttttggggtatgtcgacaaataagaaattaggatcctcctgttcttgtttaaattctaggctgagaatttttctaaatcaaaataactgatcataagaaaacctgttcaaaagaaaaaagcaccttttttccaaagctctgaggcctaaaagtaaacacctagaacccaaagcatgcagccttcaatcagaagcaatgtaaaattctaacctcacctgcaggaagcatctctacttgccaagcaggactgcacctaaactgtttcaaacaacacttgcagttcatctcttgatctcactctctctttttctctcacacacacaaacacaacttttcaggatgtaaacatagggagagacaacaactttgttaacctactcaaatatatcacaactcttctctttttagtcaacaaatcgacaaccaactaggttttcctctcatcaaatacaactctagaatagttaagcctgtttccttattaatgacatagtcatcgtta

SEQ ID NO: 125155 - DNA, 1066 bp, Homo sapiens
cagatttggcaatctgtaagtcacttatttttttttctttttttggaggcggagtctcactctgtcacgcaggctggggcgcaatggcgtgatctcggctcactgcaacctccgcctaccaattgaaccaatttggttcaaacaattctcctgcctcagcctcccagttctcctgcctcagcctcccagcctcccaaatagctgggattacaggcgcccgtcaccacacccagctaatttttgtatttttagtagagacgaagtttcaccatgttggccaggctggtcttgaactcctaacctcagcctcagcctcgcctcagcctcccaaagtgctaggattacaggcatgagccaccatgcccggctttaagtcacttccaataataattattcctcattatgtagcttaaatgtttacttctccttaacaactttcctaaccctgtttacctcactccctgactcaggcaccattttctgtgctccctgtgcatatttacattaaattacttatgacgttacgtgaaaagtgcctatttacttacctctcttccccgttagacaatctgctccttgaggatatgctctgtctctcacttgactttgtatcttggcccttaggtcagtacctagaataaaatagatactcaacacatgcttgttgaataaataaatgaatacaagacacaactaatataggaaaaataactaacatgttaagtaaacaggccatgtccacaaaaatttcaagggaaagattttagaagcaaatatgatttgacatctctgaaactgactttctttctcttgtaatttgtgcttgcaatttaaatttgtacctggacttttaaaagacatttctgtgataagtcatgatgactatggcatttgccatcatttaacagattagaaatacaaggcttgtcccttaaaggaaatcatttttgaactgtggcttcttcatagtaaaaaaagattctactaaaatctttagaaatgtaaaagaaaatatttagcctagtaacgctttctctcattattcatgatgtgctacataatcaac

SEQ ID NO: 125156 - DNA, 1006 bp, Homo sapiens
ggggtgggatggcaaatccggatccgaacagaaaggagatgcagcacggggacaaataatttgttgagaagaatgagtaataattacaggtcttgaagttcaaacttaggttgctgaagaagatgaggctggagaagaaaacaggagccaaatcacgaatcgtctatgccttggtgaggcaatgagtggacagattacaatttaagctattcttctgttggtagagaacagataacttgggggggtggaggtgggggggcagagaaggataagcagagagcccacaagggggccattgcagaagccagtaagagaaaacttaaggaccctgtgtgaatggtagtgagcatccaaaggagatggattcctaaaatattcaagaggccatatcaactggtaattggttgctaggggcagctgccagataggagaatggaagaggcaatgatgatgccttgttttgctttgagggaggggcaggataagggtgtattttactaaataagataaggaagagttaggatgagtcctgggaggggacatttttgcagaaaaaaaatgagttcagttttggagttgatgagtgaagtaagagtggtgctgtctaatggtggttgctatatgggtctagagctctagggaggagctgggctgaagttggaaacaccacaggtttagatgaccataaccaagctgactgcagtcttacgtcattgagcacagtttcaaaaccacttctcctttctccctgcctttacttgggaaaattactgaaatactgcattaaaaaacccaatatggtgatatgtgtccatccatagaccaatattctaatgtttaatggtcttctaaggaccctaaaggtcaggtttagcagaaactggatgtaacagtggtaactattaatagtatagcatcattaactcataaaatgaaatattatctatgtttatattttaatattttaatttttttcttttttattctgtaggaattgctccattcc

SEQ ID NO: 125157 - DNA, 1052 bp, Homo sapiens
tcccatactttattaaggtaaattgaagttatttgccagaggctaggcacctagcttgtgtttagtagagcctagatttgaaagtaacaattgctgagagcactgagtattattgcagttaatcctaaatggctgtggaaaaggcagttctgactgagctggaactggagcttcaggaaggtgaagatactgattcctctctcttggacatcaagtgtggcctggggttgccagcagtcctggccaggtggcctcaagcagcagccattcttctcttttatcttcagcgtgcctacaaatacagtgttatcaccgtccatgtgtgccatgatggaaaaatggttgggcatttttcccgtgggtgtcccggtaaagtatttggactcaattctggtgtttgattagtgctttttaaagtaacagaatcgtccctatttgagaggaataccataaatctatttgtagtgacctttccttgaaatcacattttttttagttcgttctttcactaatggaaatgggggagaagctatgggggacagtagaaagaatggtaaaagaagcagagatgtgcttggtctgtttttaaccgtttgagaccattaatcattttctctgggtttaagatggaggcttaaaagtggcagaagtcttgtaagggtttagctgctattcagtgctggtagaattctcttccctcctaagcctgtgcactttttaaaatgcacttttaaataggcttaatttgaagaatgtgtccatctctctctctctctcttttttttttttaaaagatgtacccttaagtaaaaaacagctgattgtctggcccccataagtaacagttattctgttttttctttaagacatctttcttattaccttatcgcattcataaggatttgggttgccgtatagaaaaaaagaaattaaagttctatgggtttctaaaatatgtatgagtaaattttaggtgagaatttgcatctttgatttaattatacgtgaaggtgatgacttagtttctgaaagtcaagagggtagtctttaca

SEQ ID NO: 125158 - DNA, 1194 bp, Homo sapiens
aaagtatacctgtgactgggtaattcataaaggaaagagatttgtttggcttacggttctgcaggctgtactggcatgacaccaacatctgcttggcgagttgaggcctcaggaagtttttactcatggaagaaggcgaagggtgagcaggtgtgacacatggcaaaagaagagtgagagagaggaggaggttctgggctcttttaaacaaccagctctcatgtgaactaatagagtaagaacttgctcattactgtgaggacagcaccaagccattcgtgaggaatctgccctatgacggaaacatcccccgactaggcccgcctccaaccttgggaattacatttcaacatgaaacttggaagagacacacatccaaatcatatcaattacttccatcattgcttctctcagactttccagatatactattgtgtcatctgtaaatagttttttttccttcttttccagtgtttatgcctttaactatttatctaattgcactgactaatatctccagaacaagattaaatagcagtgtaacaatgtctttaatagaggtactgattgcttcattgtattatcttcaccatggatatacaaatgtgtacatttcaatgtagataatagtttggctatgtatataccttacaagggttgcacacagtccttcgctgtgtctttaagagatgcttatggagattggctgggcgtggtggctaaggcctgtaatcccagtactttgggaggctgaggctagcaggtagcttgagctcatgagtttgagaccaggtcgagtaagatggtgaaaccctgtctctacaaaaagtacaaaaattagctaagtatggtggcatgtgcttgtggtcccagctactagggagctgaggtgggaggatcacttgagcccaggaggggaggcttcaatgagctgagatcatgccactgcactccaggctgggtgacagagtgagaccccatctcaatttttaaaaaattaaattttaacaaaagatacttaaggagatggatgtggtaagaagcaggaaaggtcaactttcctagtgcatggtaggaaaatacggtgtttagcatggtaactgctccatggtttctcagtttatacaagcagccctgagttttcttgcttctctacacagttttctggatttcattttgttttttacccagcta

SEQ ID NO: 125159 - DNA, 1053 bp, Homo sapiens
cattcattggtcatttatatttcttagcctgtgaattgtctttatttcctttgcttattatttttctgtagtgaggacttgaatcttctttataataacagatttattgggatataattcacataccataaaatttgcccttttaaatgtgcagttttgccaggtgtggtggctcacgcctgtaattccagcactttgggcagccaaggcaggcagattgcttgagtccaggagttcaacatggcaaaaccccatctctgcaaaaaatagaaaaaaattagccaagcatctctacaaaaaatacagaaaaatcagccgagcatggtggcgcgtgcctgtctgtagtcctagctactcgggatgctgaggtgggaggatcgcttgagcccaggaggtggaggttgcagtgagccgagatcgtgccactacactccagcctgggcaacagagccagacctgtctcgaaaaagaaaaagtacaatttagtggtttttaatatagtcagagttgtgcaattatcaccaatatctaattccagaacattttcattactttcaaaaagaaagccatactcattagtcatcagtcctgatttcttctgcccctcagcccctggcaactactaatctattttctctctctacagcagtggtccccaaccttattggcaccagggactggttttgtggaagacagtttttccacggaccaggggaaatggggaggaggatggcgttgggatgaaactgttccacttcaaatcatcaggcattagttagattctcataaggagcatacaaactagattgctcaggtgcacagttcacaataaggtttgtactcctatgagaatctaatgccaccactgatctgacaggaggtggagctcaggcagtaatgcttgctcaccctccgctcacctcctgctgtgcggcccagttcctaacaggccacagactggtaccagtttgtggcccaggggttggggagcctgctctacagacttgcctattccagataatttttggattccataaatggagtcatacaata

SEQ ID NO: 125160 - DNA, 1054 bp, Homo sapiens
agaactacctgagactgggtaatttatgaagagaagaggtttaattgactcagagttctgcaaacttaacaagaatcatgaccgggagccctcaggagacttacaatcatggcggaaagcaaaggggaagcaagcacattctcattatggtggagcaggagagagacacgggggcaaggaagtgctacacttttaaaccatcagatctcatgagaactcactatcactagaacagcatgggggaaaccacccccatgatccagtcacctcctaccaggtccatcccctgatgtggggattacaaattgacatgagattttggtgagggcacagagtcaaaccctatcagatgagtttcaagctattaaaaacattaaattgttaaaagcacactgttaaaatttgtggtatagcaaatagaatgtttaagagtaatgaaggggaattattcatagtgaatactgacattgtctaagtgaatttttagtgcagtgttgactacataattgaggagtcccagttatagccaaagtaacccaaaatgatgctaggtttaatcctatatttctgtccctattaacaggaaggtacaaagtgtgactaattttttttaatggaacctgcacttttgtatacattatccttgtttgatctttattatcagccaagagatatagagaggacggctattcttccacatttattaaccttcattcaacaattcttttgaacacacctgtaacttaaagattttagcaccaattcattatgttactttgacttaagtaatacttcaaaaagtattccttaacaatagcattttttgtaaagctttaagtggttcagtctctgaataattattttatacttttagtttcatttgttccctctgttagtttcagtatgttaacacaggtagaccaaaaagatgacagtatttatacaccaactatgtgcttctttctaaatgcacagataactgtattggtgattccatttacatttggttaggtttcaaatgagagtgctatttcctcccagctttttgttttga

SEQ ID NO: 125161 - DNA, 1377 bp, Homo sapiens
ggaatggcaaagtaatttaggatctcttagacctcataaggcttttattcccagtgatatgagaagtcttaggaatggctgtattttgagagtagaggtgacagatttgccagccaatcagttgtgggctgtgaaagaagagttaagaatgactccaaggggccaggtgcaatggctcacccctgtaatcccagcactttgggaggtcgaggcaagcggatcacttgagcccaagagtttgagacagtagaggcaataagtcaaaatccagtatctacaaaaaatacaaaaattagctgggcatggtggcatgcgcctgtaatcccagctactcaggaggcttgaggtgggaggatcgcttgagcccaggagatcaaggctgtgctgagctgtgatcatgccgttgcactccagcctgtgcgacagagcgagaccctgtctcaataaaaataaaagaatgactccaggagtttcagtgtgagcaacctaaagaatgaggttgccatttactgatagagggaaagctaagagagaagcaggttggagtaggttaaaccaggcatggagttttggacagtttggaatttggacagttaagttgcctattagacaactagttttatgtgttaagtaggcagttacatgtgaatctgatgttcaggggagagatgaaatccagagatataaatttggatgtcatccccatatagatgctatactgagtattatggtttgaatgtttgtgttgcctccaaaattcatgttgaaacttaatccttaattcaacaatattaagagatggtgccaataggaggtgattagttcacgagcgcagagtcctcatgaatgagatcagcaactttataaaaaggctaaaggaactagctaggcccttttttgctcttctgctccttttcctagtgaggacacagcattcgtccccgctggaggatgcagcaacagggtgccatcttggagcagatgatggtcctcaccagacaccgaacctgcttcaatttggacttctaggccacagaactatgagaaataaatttctgttctttataaattacccaggcttacatgttttgttacagcaactcaaacagcctaagtgaactcatgaaaggaatgaatgtagatagaaaaaagaggcccaaaaagagatggatggaaaaagagaagccataatgactttggaaaaccaggtgattgtggtatcctggaaaccaaataaagaaaatgttttaagaaagagggagtgatgatctgggtcagctgctactgataagtgaggtataacgaagattgaaaattgactgttggatttagcagtgtggaggtgaccttaacaaaagctttatatgagtaggcttg

SEQ ID NO: 125162 - DNA, 1074 bp, Homo sapiens
tcacaattccattttattttttaggacctttttgaacattagtcttgtagtagcttatagcttctgagaccagcatttaatttgtttgtagtacattgtacttccaggtgataaaacagcattaagcagagtacctattcctcctgggtggatgtctcagaattttgccaatactgatgaactgttctccaaaatcattttctagagtttagggtttttttccatctgaatatgtactagttattttcatgtactgtgctagatgctgagattacagaactgagaaagatagctctcagctcccaataattaatttgatgagtagcactgatagaagttatatccagaatactagggaacaatgaaacaagcccattgaaggctggagagcaattggaaggcagaggacactgcacagggggttctatttgaacaactttctttacctttatgtacacagtcacatcaccctatcagtaaaaatgttttaattgaaaacatttttattgaattgtatgaatcaagaacataattgcttctttcaccattgaataatatgttatcaaatatgcattaaattggtcgtcttagaaatggctaaaatatgtatttatagaataagaaggtatttgaatttaatcagctcagtctccaatcctctttctttatctgtttgaattctttgatggggcttacagacagtttattccagtttttacagtaataagtaattggaaagatcttgctagtgagccaaatctgcctctttttgtcttctcctcagtaattttagttttaaattgtaaaaattatctcccagtctgtgacttatcctttcattttcttaaccttcaaagactggaagttttttattttgatgcagtccaacttatcaatttcatagattttgcatttgacattgtatctaggaaatcatcgaatgcctaacccaaggtcacatgcctaactctatgctttcttctagaacttttgtggctttaggttttacatttagaaacaatccattttgagttaatttttttgtatatggtgtatatgtgaatctaaattttt

SEQ ID NO: 125163 - DNA, 1042 bp, Homo sapiens
tttttcttttcccatttcttaattttttttcatactgtaactccagtttattgttcttcttaaaaaggtatgtagatctgaatatagcatttggaaaataattgattgttgtaaactcacttcaagtatatcttctgtttctttgagttatgtcatgccagtccctacagagtctgttaaccttacttggtatcattgtttcactttgcttattataatttaacccaaacttccccaaattttccacaattatattattaatagaaattacagaatacatcaggatcaaggcatataaggattaaggggagaggagtaaaaaaagaaatgcgcaggggcagaattaaggaatttagattttcacctatgagcaatgtggagtctctgaagaattttaagtaagctgagttaaactaatttcactttttattgtgatcagctgaacttacataaaaaggcaggcagtatttatctaaggggatttgcatcagtccctttggtgttttagtgagtatatagtttttttgtagtggcagagtcaaaacccctattcagatatcttaaatttattcccaagccttgtacattatagttgcatcctgtcaagtgaactgtaactagcaattcaaaattcagagttacttgaatgttcttgtttctgagtatttcttgggtttatgagattgacaactctatttaggccagagtatttagtctactggaattaagcaaatacaggtcccatctattcatgtttgctatttctcaatttaaaatcctatagcatgtaagagcattagcattttatttgtctttctttcaatcctttagagttaagactcactaatttgggattagttatgactctatgaggctactactgatttttgataggaacaagaacccaggaaaggaaaaaaaggtaatttatgagctgcagccaattatctggcaaccagaatgccttgttgttaagagtctattgtaacaagtttctttgtcttcatacagcacctgttactgtgcaacaagaccgtgtttt

SEQ ID NO: 125164 - DNA, 1020 bp, Homo sapiens
gtgtgaaaacaaagagatcctttagcctgctttcgtatctgtgtggacatattgcagtgcagctgataccccattattgtcagcatgcagttgtactgggaaattttcacttttgatcatagctcattactgaaacccaactattttaagagaaatgcccttgagtcataggcttgttttattgccatggtattctctgataaatggttcatggtttttcccctaagtgagcatacttcatttgccatctgtttaaaatcactacagattgaaaactagtatattgaactctaaggacatatctctttcttacactggaattctaaagaagaatgtactgagcattacttattctttcattcttcttagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgaggtaagtgctaattttataatggatcaaagtttaggctttcagagagtatttccctagcttagttttggtgctattttgtatggattgtttgaatccttgaaattactaataatttttttttcatttttgtgtttagagccatctgtacataacttgattttacaaatcaggaacttatggtccttaaaaacctcaggctttaaaaacaaagctaaactaaaaacagtacgcctttttttagtaatctaactttagcttttttgtttttaggttttattggcgattcctacctttaattaatagaagtggtgtgtataatacttaagagagacttgaggttaacatatataaaatatcttttaggctgggcacgcacggtggctcacgcctaatcccagcactttgggaggccaagacaggcagatcacaaggttaggagatcgagaccatcctggctaacacggtgaaaccccgtctatactaaaaatacaaaaaattaa

SEQ ID NO: 125165 - DNA, 1076 bp, Homo sapiens
ttgggaagaagtctcataaagtttaagatttgactttctgttgagtagtgtaaatcactttattgacttagttcattttagaaaaagaaaggatttaatgatactttcagtgcttaccaaaatattgacctttaagttatttccacagttctagcatgaaaatttatattcagagttacatagaaaaaagactattataaatttggtaaaatatatgtgtaatagtttttgcaggtattgtgttttaaggaagaaaagctgttttcaagctgtaaacagcctagaggtaataactcagccctctctgtttgcaaatgaggaaaccaagaaattgtctaaaattaaaattagtgtagtttttaccattggaggaatctgggcaaagggtatacagaactcttcttgtactattttggcagcttcacatgaatttataattatttcaaaataagttttgaaacgtaataattaaaaaattggtgtgtttttatcttttctagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcaggtatgtcctagagtaatgttgttgcttgtgacatactatacaacaatttcttccccagaaacaagtagacaactagaggttctaacttgttagtcttttactctgtctctaattgtgtttattccctttttgatatcagtatatgactctctctactgtgttatgtacacacagttaggatactttgcatagtcttacagctctcccggtgtcacctgtattggagtttgattttgtgacagcttcagttacccagagtctctatgagttactgaagtatttctctttagtgtaaactactactgccataacagttcatacttagagcacataatggagcttactcaggttttacatctttctctgt

SEQ ID NO: 125166 - DNA, 1016 bp, Homo sapiens
cactttctaaatcttcctcccaagaaccaataaccctactttaatcatgaggaaaacatctgacaaatcccaattgagagacattgtacaaactgccagccagcagtcctcaaaactattaaggtcatcaaaaacaaggaaagtctgagaattaccatggccaactcaaggctaaagagacatgacgaaactaaatgtcatgtggcaacctggatgggatcctggaacagaaaaaggatgtcaggcaaaaagcaagcacatttgaataaagtttggaccttagttgctaatactgtatcgatattggttcattaattgtgatttgtgtaccacagtagtagatgttaacaatagggaaaaataggtatggggcaaacaagaactttctgtgctatccttataatgttaatatttctttttcattttctcttatccagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtaacacgtgactctttactactgcatcatgttaaaataggttggtttgctttaacttggctccattttgtctggagagtctatgaaactttcaaatagaggtttaatccttgttgatttttatcatccctgaatactcagatacatgttaggaattttagttcaccttgtccttagcttcccaagagacattaaaacatgagacactacagctaaatgtactttttttctttttaaagcactgatggcattcctgacttttttccccccttatcctattgagtctttggataatttagaaggaatcgtgtgagtcccaagattccagcactaaaccgttcttacctctgacctgacatctacccaaccccacttaagttcttaaaaataagggtacctcccaa

SEQ ID NO: 125167 - DNA, 1019 bp, Homo sapiens
ccattatgacaaccctaccctagtgacgtaattacgacccaaaggccccatctcttattgccatcacataaggaattcgggtttcagtatatgaattttggggtgacacaagcattcagtccatagcatgccctatcatagtttcctgggaaccatggtttctgaacacagtaactagggcttgggtatttcagttagcttccatttggaaatgggaacaagaatacctgcttcataggattattgtaaagatgaaatgaaatcacatatgtaaaatgcccagcctgtgcctgccatttctaagtcattagaaaattatagatttgaagagacaatttgtatggcaaatatttttaaaatactaatgaaaatatatgttaagattgagggtgtttgaggttttaaaaggcaacgttgaacattctcatagcatatatatacttttctaatcgatgtttcgagtaggttgtagaacacactataaaaactatttgaacctaaggggagtggggaagagatgcagacactggcaatccaagatagaaagctatattgtaacagtccttgtggtgatcatctgttggcatcagaggccctgggaagtatggtgtctgtattagcacagctcttacaggacaaaagcctagggaaaatggcccaaaaacagcaactggcatgtcgtagaaaggaaacacaaatggcctttaaactggaagagaggctcggtctcacttataaaaagggaagtacaactttaaaatatagtggaatgtcctttttttacccgtcactttgggagaaaaaaagcaaagaggttgagaatagaatatactgttagcaagagtatagaaaaacaggaacctctcatatgttggtggaagggcagttttgtgatacccatcagaattatgacccagcaatttaagtgctaaaaatgttattttttttttttttttttttttttttttttgagacggagtctcgctctgtcgcccaggccggactgcggactgcagtgg

SEQ ID NO: 125168 - DNA, 2216 bp, Homo sapiens
aggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatctggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaaggactcgtgtacaactacattgaagatattct

SEQ ID NO: 125169 - DNA, 1010 bp, Homo sapiens
tcaggccaacgtttgatgtctggagggaagcgtggcctattaactatcgaatagcctgcaagttagaaacaatccagcccaatattgagcacaacctttcaaaatctggttcattttaatttcgtaactcataagcagtgctagaatgagcacatttaagtaataattggcataattttaaatctcattgtgtgtacagatccttaacaccaatatggaatatgatgttaaatactatgcgtcataatcccagcattttgagaggccaaggcaggaggtttgcttgagcccaagagttcgagaccagcctggacaacatagccccatttacaaaaaaattaaaaaatcagctgggcatggtcttgctcacctgaaggagttagaaagtcatgtcccaaaattttgtgagaagaacgtaaaaatttggcaactttatgttactaccttaagctatcaaatcatttactaaaatttctgtagaggtttcagagtaatccagtatcagaagtctcctttaggcgaagtctgtaatcccagcactttgggaggccatagtgggcagattgcttgagcccaagagtgaagactagcctgggcaacatggtgagacctcatgtctacaaaaaaatcaaaaaattaagcaggcacagtgacgcgcgcctgtaatcccagctaccagggaggctgagggaggaggatccactgagcccaggatttcaaggcagcattgagctatgaataagccacttcagccactggggacaaagtgagaccctatctgtatttaaaaaaaaaaaaaaaaagcctcctttggtgtctgaagtcaagaatggcaagtcagtagaggtctttgtgcctttagtattcaatagattttgatggactgcctgctctgggttcggctgggaatacgcaggtgaaggacaaacaggcgtaagggacaattgcagagattcatactgaagaaagtaccccatgtataaggagaggaagtgaagtttcaaaaagat

SEQ ID NO: 125170 - DNA, 1479 bp, Homo sapiens
acagcagcagcagctggcgccgctctcgcagtccctacagccctgtgctcaggtgagttctgccgttctgcctgtgtgtgccttggctgcgctggccagatccccaggaggaagggaaagtggtgcccgggtcctcagaacgactcaggtccaccaccgagacgagacaacaccgcctgagcctcccaggaaggataggcgttttcgcgcgcgtgacacttttttagggggtcgaagggacaaagcaactgggcgaagggaacttttctcctagctgtggcagggaagatttctaaggaagaattaaaagtttcagacttgttgcattaatgtgttaacaggtttctctcagttgctctttgcttttctggtacaatttgggtaaacctagaggtggtttaagtcttaattttgaaagttctgtgaagaggtttcattgttgggaatttaggaatggactgcaacttaagatctagtattgtacaggggaataagaatcaggtactgatgtcagagttagatgtggattgcagatgtttcttatgattattacagaaatgggagaagcagcctttctgtaaagtttattcttttagtatgttaaaaaagcttaggtggaagccgatagttctgaatactgaagttaaaaaaggtatctatttagtgatattcttgtgtgggatagtttttacctgatctttcaaagtcataattatagaaggtagaaaaaatgacaagactgtggtttctttgttggtttgtgatgacacccagttgctaataacattataaatctgggtggtgtaacctagtgtaaccaagtgaatggctgagtacattcttatactattataagcctgtaactgcttactttaaaagctaagtagactttttcttagatatatacccgaaggataaaaacacaatataactagacctttaaatatcaggatctttgtccagaaatctttaaaaggtgtaatttaatttaatgaaattggagtaaaacttttctgtagctttcttgccttttttgttatataatattctttttaaaaagtgtgccttaaaatatacttatccactaagcaaagtgcattaaaaacaactttcgagtattttatgggttcttatattccttgagatgtttggacattccagaccttatagtgtagagtattgcaaaatgacatttgtatcagtttttcctcctgggtttcagtaatggcaagtggatgtacagtacctctaagtatgggttatgtggaatctcaacataatacgaatatgcatctgcaaaattagcagacctttttgaagtatcaccataataaatgtaaaggtgtgatgtttatagagatctgagcgtgagtttgtctttaagccaaaaaagttctataaattgcttcactcttaaagagtgttgaagcatacttaaaatgttagttgataccttagcgaagaattgaaaaactcatt

SEQ ID NO: 125171 - DNA, 2038 bp, Homo sapiens
attttttatatacatatatgaaatatataatcgtggtatgtatgactaggactattcatatttagcaagtattttttgaccctgtattgtatgccatatactgttttaggtattgggatgtagcaggaaagaaaaagttacttgccctcatagagcttgcattctggaggaccgttcaacacataatcttttcatggtgtttacattgaccaccagtatttctaaagagttgaatttggaaggaactttagggtgtcttggctaacattgctgacagatggccatttggtatgtgcctgaaatacatctagaggtgggaagcacgttagttagaggcaacctgttcactagatttgggacttgagtgttttagcaagatccttgaagactcagtttcctaaactgtaacagggaaacacttgtttttctggattatttcaaggattaagtgaaaatttatctttttaaagcatgcagccttacagaaatatttaaggtcgttgaattattcaatatcccaaattgttagaattcttcatattgtgaccaaaatccaccttcgaaccattgctccaagtttaaccctttggaatggtacagagcacacgtgtatgctaaccctttaaaatataaagacagttgtcatgatttctgagtcttctagactaaaaaactcatacggttttcagatttttcacattatatctagtttgtcaaatgtccagcttaaaacatagggcctagaattaatagctaaaatagttgattggaaaaatctaaagattttaaaatataataagtgtattgttactttttaggaacggttaattgaactcacttgtacagattaatggaaaagttttatttattttcagaatttattacttgtggtaagtggcccatgttctttaatgaatggactgctgtgagttccatgaaggcaactgggctgtcttatccatcattgtatttctagtgctcagcactgtatctggcacaagtacactcttaataaatgttgaataggtgtaaatgaagggatgctggagtttactgaacatacaaaatattaatgtgggctttgtattacaaacttcattcaaaatatttaatacagaccatgtgtaatgctgtaagaaacagtgtaatatttccccagcctatgcagaacttacatattaatgaattgtcagcgtagatattttcaaggaaatgcatacacattcaaaatagtattgaaatcgtggtatgaagatgaaaaacaattttaaataagctgaaaatagagatagggtttcaccatgttgcccaggctggtgtcaaactcctgggctcaaatgatccacctgctgcatcagcctcccaaagtccagggattacaggtgtgagccaccacatccagcctgaagctttttttgatgtcagataaataaatccttttcattttagtgatttccacttcacaacttgttctttgtcttcatttgaatcttcagtcctcggctcatgcatttcttttcatcagttccctcttagctttactttttcccctgtataatctgtttgccgtattttctttactacttgactgttggggtgtggaaggtcacgtaatcttgctgactggccctataataaatgtgagggtgtgctgaaaagaggggagggtaccgtttgtagtgttttactgtgtgccaggcattgataaatatttaacatatattgaccaccaaaatccatgtgatagttggaaacattcccattgatggattgggaaacgggagctctaaaaggttttaagcgatttgttccaaggtcagcttggattcaaaccctaggctgatttgaaagtacatgctcttaatattaaagagcatggattttggttacaatatgaaggtggattttggttacaatatgaagaattctaacagcagtctattcattaaagaacatgggccacttaccacttaaagcatatgctttattgaaatttagttggcattcaggggcgctggccacctcacataatgacctg

SEQ ID NO: 125172 - DNA, 2102 bp, Homo sapiens
tcccgcctgggcctcccaaagtgttgggattacaggcaagagcagctgtgcatggccaagtctaaacttcctaatgttccatcagttaatgccttttatgatctggctccattctatcacagttctgttttcaaagacatttttatttctatttttatacttgctgttctgttagcttaaatgataagagacactccaaactctcttttgctcttcatctccagctttgcatttaaaactcagctcaaaaatcccactgtcgtgtgtgtgtgtgtgtgtgtgtgtgtgtgtgtgtgtgtgtgttttggtagagatggtgttttactgtgttgctcaggctggtctcctggggttgaacaatcctcctgtccttgcctcccaaagtgttgggattacaggcatgagccagtgtgtccagccttaaatcccactatcttgagacctttttccattcatctagataaaagttagttttttttcctgtgcccccacagcactttatctttgttgtagagttttaaaaaattctgtttaatatctgcttagttggctggctgcctttgtgttttccctactagattgtaagctcctagaggacaaattacagagcttatttattggtggtttaatttaaatacattttttctctacagattagtgcaaaccagtctgcacagatgcgagttatatctgtaaacttgcttggtattttggtttacatacactctcatactctaggatagggcaggtaattgtttcgatttataaggagggaatttaagaacctccttctagcttctactttattagaatgagtagaggatgctgggagtcactttagtgtgaatggaataaattcagacctagtgtttatatttgccctctgttgtgctgatcaagataaattcttggtgcgtttgaattaatctttaaagagaaaattttctgagcagacattatgtcaaacttatttcccaactctgaaaaattgtagctatttttgaaaaaccagttggaagtgaatgttgcttaatattcacatataagataattttaattttttcctttattttggactttttttgtgtgaatatcattttgttgttgttattttggttttggttggctttgttttctataaatttataagctttgaagtgggtgttggaagcaaaagtaccaagctaaaatcagaagcattacttgtttgcagtgattttgttccttgaattcctgcacatttaaattgtggaagaacctagtgttttttatgtatttggaaagtaaaattgatgtacattagaggataaatataggtaaaactggaatgtaagtaaaatggaaatgaggttagtgagaggaaccgaaaatggtaaatgatctacacgcctccctgcttttctgtttgcattttcagttgcataggggcactttcactgggatattttattggcattccaaactcaatttacctaacattaaattatttcacctttcttagagtcattttttttctgttactgctctttattatttttcacctgtttgcaagcataatagaggctaatggtagaaattttccgttagtatagaaaagtataagagattaaaaggccccttaggtccagctacctgatgagatgatcactcatgacattttgataaatatttttctagacttttttatgcatatatgcacagggatgtatgatttttccataagcgggaacatgtaacaatgctgtcttgtagcctgtactccacagtacagcataccatttttattagtagctcctagtattctgttgtatggatatagcataaattgtttggctgaatccactttgataaattcttagttttgttttttttttaatttttgctatgtgtgtatatctaaagcaaatttttttttgtgtatttgttccattatctttagattgaatttcctggggataaaatttttgaggcaaaggtggtatatacatttgtaacattgatacactttcaaaatgcctttcagaaggcttttacaaatttacatttcccaacagtgtggaattacccatttcctgagtctcaccaacacttggagttgtcac

SEQ ID NO: 125173 - DNA, 2146 bp, Homo sapiens
tgtttggatttggcttctttcttcataaggctttatgaagtcctttatgctagtccttgagagatggataagccttgaatagaagatggagggcaagatgatattctcactaggccagtatgtgggaatataaaggcatggaagtattgggcaaatttagtacttgataagcaaaggtaggttaggaccagacaaattatgcagtaccttgatactaggctgctgtgaattcttttcaataggaatactatcagcagtgtctttaattgtgtaaatatttattgagcatctaccactgctaggtttatgatagaagtcaaggcttgaggatagaatatctcagtttagttggggaagatagattatctgattatttttattctgagatataaacagaattgtgatgggatcgtaggacaagtaccagctctagctgactggcgtaataagagagggctttataaaggtggtaaacactgtgctgagatacgaagtatccttttgtttcctacataaaggaggtgaagagaggaatatgagagaaacattctaggcctgacacttcctatattttgtgatggctggacaaggactttatatgcaagtcaagcagggccgaaggctttggggtaactgaaagattattcaagtgcagagttaattggaaagggtggagactcgaggtgggaacctggtagggagacttgcactgggcccagtgtgtgatgatgtagtacctaatgtggaatagtagctatggggataaagagcatggaaaaatggagagatgcttgagatgtagaattggtggagcttggaaaccaaatagatctgtgagaagagataaaagagatcatgtggaatgtagaataatttccaggtttctgctgttttagagggtgccactgcctcagaatagggtgtatttaaggagaaggagggtggatttgaagaggaagcttaatagttttagctgtattgtgttgaagatacatgtcagagttggaagtagagaggatgatttgcgggggtgatgggggacgaattgacaacatttaggtaatcatttaagccacacatagcataaattaaacttgtgggagaatgaatataggaaggaagaaaaacctcaaggtgcggaaacagccatagaagtaagaaaatcatgaagatgaaaggtagtagaaatagctaggaagtgctccaaataattgcagcagagagagacttttaaggttgtagccaacattatcacagacagtgacgtttttttctttttctttttttgaaaggtaggtcattggttgcttcagaggtgaccagttgcagaatggatgtatgtataagccagattgtagtgatttgaggattgaaaggacaaaagagattttggccgtaactggaaggacagataaagataatatcagtatgtcatcattttctctttgttttgttttcttgtctgtttttaaatatcttagagatttgagtaatttattccttcaggggaattaacaaatgaacagcaaaggttaacatcacaattaatagagtaagccagctattgtcatagagtagcctagcatagtgcatctcagactttaatggatatcttgttaaaatgcagattgtggttcagtaggtctgggctggagtctgagacacagcatttctgacaagctcacaattggtgctgatgctgcctgtctatggactacactctaagaagtaaggctctagagagtatgagattgatgcattataggggagttagccttagatagaaagaggaacacctcctttcttaattgaggtggagtgtacggtggatgaaggcacaggaaatacagattaaatttgcaggcaagagacatgcctggtagtctttgtttttttctgtgaaacaataagtaaagctatgctatgagaagactaggaatgggattgtgtgagcttgatgaaagttgtgaaagtttggaatagctactaagaggaggaaaatgagtgaatttgggacatgtaataatcgctgaacagtgaggattagtttggttatggtgtctgtagaaatggagcagacacagactagtaataaagtaaaaaagactagtaacgtagatttttttctttcttttttttctttttt

SEQ ID NO: 125174 - DNA, 1162 bp, Homo sapiens
tttcgctcttgttgcccaggctggagtgcaatggcatgatctcggttcaccgcaacctccgcctcccaggttcaagcgattctcctgcctcagcctcccaagtggctgggattacaggcatgcgccaccacacccgtctgattttgtatttttagtagagacagggtttctccatgttggtcaggttggtctcgaacttctgccctcaggtgatctgcccatctcggcttcccaaagtgctgtgattacaggtctgagccaccacacgtggccaagagattgcttatttttttaagatgatatggtactctagggaagtggtaatgaggtctaaagtagaacagtgtcctcgagaatggaagaggaggatgtggtaggccgaataatactcacccaacaccacaccccctccaggtgccatgccctaatcttttcaatctctgactgttacaccttacattttaagaggaacttcgtagatatgattaaattaagtatgttgatatggcggggttattctgggttatctggatgggtcctgtgtaatcacaaggatttttataaaagagaggctgtagggtctagtcagagaactcacgtgatgacaggaataggagagagaaaatgtcatgatgaaagtagaggcccaggtgatgtaaggttttgagccaaggaatgtagacagcctgtggaagctggaaaaggcaagggaacattttcccaagagactccagaaggaacaaagctctggtgacatgttgattttagttcactgagactgattttggacttctgacatgcagaactgcaagaaaataaatttgtgttgttctaaactgctgactttgtggagttttctgttacaacaacgatcagacacattcagagggtatggatataagggaatagtatagagttagaatcagtaaaatgagacaattaagaggttgtggtatgggaactgggaaactagatttctagcctgggtaaatgagtggagagtagtgaaattaaaaatagagaatggtaaggagtagatgttacaggagggtatatttgctttgcaagtcataatttcaggaactggtgagaatagtattttgcgtctagtaatatagattagagtggaagaaaatttgaaacaaggagatgaatttaagag

SEQ ID NO: 125175 - DNA, 1489 bp, Homo sapiens
ttctgaaacgaactctaagagactctacttattgcccagtagtaagtcttgtctttttcactcttgccatagacagagcactgcttacttctgaacttacagttgaggaaggtacttttgagatgtggcaactgtctcctggtaaaagatttgtcagactttaccctgctgctactactaccattgatgtagccttattgcctacttcttttttctgagacagcagtgatgccttgtcacatttttcgtcctaatttttacatttgtagaccagagcgagatcagggcaatccattttgaagaaaactatgatcaccaaataatactctactttaaagaaatttttatttttcaaaacttcaaaaatgtaactttgaaattaagtaaatttctattttatttcataaacttgaattagcactgtctttgtaaattccaaactgaacctttctcaattactgattaaatcttaattatttctcaccagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgataggtaagtgcaaaaagtatttgtcaataactgttcaaagaaaaaatgtaagtctgaagtgagaaatgagttgacctcccctaaccccctcgaaacaactttagtgaaaaagactacaagtgaatgaattttcttgattatatgcatcttaaaatgaagcacattgcatacaagatggcaaaattaaagtttatactaagacattcagggaaaaattgccattgtcttgggatacaatgaatatttcaatatgattttgggtattagaaatgccagtattctctttggtttagttttccttgatgatgtaatcagagacagaatattttatgaataagttggccc

SEQ ID NO: 125176 - DNA, 1202 bp, Homo sapiens
ggcacctgtaatcccagctatttgggaggcttgagacaagataatcgcttgaacccaggaggtggaggttgcagtgagccaggatcttgccactgcactccagcttgggtgacagtgagattccatctcaaaaaaaaaaaaaaagaaaaaaaaaaagaaaaatgctttgcaaaactgagtttttatgcaaagcatgtttagttgattttcaattttaatgtacagttttatagttaattctgtatcgttttaaaaaataaactttatttttataacagtcttacatttatagaaaaattatgaagatactacagggaccctgaataccccgtacccagtttctttactgttaatatcttacatcagtatggtacattcgttaacaattaatcaatattgatacaaagttatcattaaagttcctactttatacagatttccttagtttttacctaattctatatcatttttactccaaattttgcattatacagttgagtatagtgtattactttagctggaaagaaacttggacaatagtcttataatgtgaaatactgttgaatattcatgactattgctacttaaatgtaagtcataagcatatttttattagtcaacaaaatttttgttttatttgtctgacttctttcactttcagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaagtatgtgcttgctttctacctgctcttaaattgaccagcagtgattctgggtcatcagaagttcataaaacactaaattaaggtttaaaataaaaaatgtacttattctttcaacttaaatatatgaattctattagagttttgaaaaaaatcataattgcttgcattcctattcacaatgactaataaaaccaaatttaattttctctcgtaatttgtaatgtattaatttcctggggtattgtatatgttaaagatactttctgttattaagagattgaaataacacaaacactgaaattgggcagagtagaagtcagcatttagtgagaccaaataaaattagtaatgggcaagctgctgtttcctt

SEQ ID NO: 125177 - DNA, 1197 bp, Homo sapiens
aaatttgtcaataagttttatagttagatttttgttcacattctttatcaaactcttgtttcgtaaaagtagattatatatattattgttaatggatgcaaaataaaactttctggagattggttagagaattttgactctactagtgttggtttcatcttctcactgaaaaattatattttatttctgaaaagccttcatacaagctctactactttttttctcagtttaaatacttgtctacagaagaagagtcagtatgtagaaatgatacctcagtttttacgataacttacaataccaaatcagtgttacttgtttgggatagatgatgataaatactgcaagggtagggaaaaataaagaatatacaattgggtggcgagtagatattgagttattagacagtttattcaatttgcttgattgtatataaaaactttagaactatatttgatagaatatgtgggcctcgctatggtgaaaccaaagaaaaagatattgactggggaaaacgctgcgtggataaatttgatatcatcggaattattggagaaggtacttacggacaagtttacaaagccagggataaagacactggtaagaatgccaagttctggggatctttgggcctacggaatgtacttagtttgtgtttctcttctgatgtttggcttcagaaattttccaaaaaattaaattcaattttattgtgcttttgtttcatcttgtttttttattctatatatgcattttgtaagatatgagtacatgtaagtgggtctgtatatgtgtatattttaaaaagtgttcctttagtatttgtgatatactgtatggtaggatttagtttttctttcctcttttatggtgaataattcttatactgttattaatcagagggaaaggtatcttgacctgaattaattttagtagtaaattttttttgtcataagccttacacaacactttcatttagccttcagttttttttcctgcagtaactatccttggaggccagttttagcagcttaatctttcagaacataatcaggaattcagagaaagttttaaaaggcttcacaggagagcaaaaagtagctgtgtcagaagctatgtattttacttaataatgcatagagctagtattttatctttctttactcataactgcttattgaaataaaccaataggcc

SEQ ID NO: 125178 - DNA, 1020 bp, Homo sapiens
acgcctggcctagcatctttctgttttctttttattttttcccaagtgaatgtaaaagcatcttagttttttcactaaatatataaatggggagcatagtatatttggacttacctcattctttctaatggttgtatagtattccctggtttatgtaaatattccataatttgtttaatgacagacttaattttttgaactataaatattatttggtatattggaaactgaaacatactttgtggttctatttttgagaaataagaacagaattgaattaaaatacatttaaagttaagaaaaatgtcatctgcttttgttaactggtaacctgattttattaaattccttaataggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtatgtgtgcatatttaaataacgaattttttgtattcatgattgatgttgctaacttggaaattttttttatagatgtgactatttgagtaattacaaactattgctctaatcgtgaaactatatttttaagtttggtagagttgaataatgaattgatttactttagtggtttttgagtaaacttcgtaaagggtatttgccaatattacacataaagtattcactagtaatatatgttttattgggcatcagtgtatagtttttagtattcattttttagtagttgaaaaaccagttcatagtagtagtatttttaccctacatttttatgttacaaatgccttaacatataaggaaactttacagtaggcatatgtattatttctgaaagtgtggaggcaaaaatcatacttgaaattgcctttaataatctatagtggggtatgtatatatgtatagttattatttagcagagaagctgacaaaaaat

SEQ ID NO: 125179 - DNA, 1047 bp, Homo sapiens
gctgggattacaggcatgtgccccacatccagctgttttttttgtattttagcagagacggggttttaccatgttgtccaggctagtctcaaaacttacggcctcaagcgatccacccacctcggcctccgaaagtgttgggattacaggtgtgagccaccgtgctccagccctcctttttttttttttgagactgggtctgtctccttctgtcacccaggctggaatgcagtggccctgcagccacagtctccaaactctggggctcaagtagtcctcctgcctcagccccccaagtagctagaattacaggtgtgcactaccacacctggctaatttttaaatttctgtagagacaggatctctccatgtcgccccaggctagtctcaaacccctggcctcaagcagtcctctcgccccgatctcccaaagtgcttggattactggcgtgagctaccatgcgcagccatcatttgccttttatctctcttccatattgtttccttaggcagtacttctacattttcatttaatgaattgaaatctgttggctttttattgcatttttctttgatgtaactgtccacctccttgtgggattatacatttgtcaaaacactattttatctattctttcttcactgacttaaattggctatttttataattattagatatataactgggatttgttttctggtgtgtattatttccactgttctgtcagtccctatggtatgacacaggtcagattaatttctagtagggcaagtgtttattttcagaaatgttttggctagtactctggtttgttttcttcaaggataattttagaattattttgtcaagttaagtctcctcgctcctggtgacaaaagagaaaaaccattggtccttttattgaaattgctttaaaatacagagttttatatgtgcgtggtacctcaaacctgtaatctgccactttgggagccaaggtgggaggatctcttgagtcggggaattcaagactaacctgggtaacatagagagaccccatctctacc

SEQ ID NO: 125180 - DNA, 1025 bp, Homo sapiens
gacctcagatgatccacctgcctcagcctcccaaagtgctgggattataggcatgagccacagcgcccggctgtcttttgctttttgagtattgatttttctttttttgagacggagtctcgctctgtcacccaggctagagtgcagtagcgtgatctcggctcactgcaagctctgcctcccgggttcatgccattctcctgcctcagcctcccgagtagctggaactacaggcatccaccaccatgccaggctaattttttgtatatttattagagacggggtttcactgtgtcaaccaggatggtcttgatctcctgacctcatgatccgcccaccttggcctcccaaagccctgggattacaggcatgagccactggcaatttttgtttttaatctcatacataatatctagcctttcctattaaatatgacattggttgttggtttcagggaggtaccataataaacttttaagaaagactccttctgttgcaagtttaccgagagttctttgctctgttttaaaaattaggaacttatctgaaccaagttcagatgctttttttgtcttcgtgttagtttttctgcttttcacaaatgtaatgaattatatttctcattcagtttgtgtgtaagtttcttttaggatttctaaatctctcgtaagtacgtttgtatagtttgtgtgtgtgtgctatgtgctattttaggttttggtagcaggactaagctgttttttataaaataaagttgtaatttcaaattatattgtttttcctcaaattcttgcttttaggtactctggagctgtataaacagaattaaattacatgtttattgaggcatttagaagtcgcctaacatctttcttggcctgtactctttttttttttttttttaattaaaagcagttcttttaccaacttttaattttttgataaactatattgactttattcagcttctaagagacaatttgacgtctaaaacattaatcacacctagaaactatacaatatgg

SEQ ID NO: 125181 - DNA, 1845 bp, Homo sapiens
ggttctcattttaattaatagacagtgttctatgcacctagcccctctaaaactggagaattaaacaaattaaaagtgatgtcacttcgttcttgagcactgttaccttgaacaagaaatttgtcttactgctaagtaataaaaaggatctcattttattttcattgaagtatgcttttctaaataggaactgaatagtaataaaatactattctaatattataatacagtaattataataatcatattactataataattttaagactatccaaggatagtttactttcttgttttgtgaatttatccactacttgcctttccctgtattaccttgatgatattgcagtgtgagcagagttaaagtttacataggttttttttttttaatcagttctaggcatagaatataaatgtgtattgtcaattaagagtaaattaataccttttgttcattttgtcttatttccaccagagggcagataaaacttgcagactttggacttgctcgattgtatagctcagaagaaaggtaagcataccttcaaatgaatattgtagatactagagtttagtattagaagctatactaagaataccttattgatagttttattttttaaaagagaagtttacttttcatggttagtacataaaacattgaaattttataccatattgggttgattattgtaattacaatattttatacattatctcaatttaaaaattgatcttcaacaggtaaaaatgatttttttaaatgaacatctttaagtgtaactgaagtgaacttaaatttctaatacgtattcagatattaaatattcttaatgaaaaccttttaaattgcatttttaaacttataaactttggtttcattattattttagacagattttattgttatatctacagttctttgtttttttaactccctagaaccctttatttaaaccaactgttgggaggatgttcactgtataagacacaaaaatgtagaacttttctggctaaagttggattatatacccaacttggctttctttgtgcctggtggtagtgaaatatgatttgtcttattaaaactaatatgggatttcaaaataaaatatttttgtgcaatagtaggttttatgtaaataaaatacggaattaatttggcttaataaatctttagtccatttaccccattccttttttgtctttatttccatatgtgtatatatatatctgaaataatatagttaaagaattttaaaattattttatgacaattttgtcatttctttaatatcaccataatttaatataatgaaacatcagttgattgcagtcttaggaatagatgtttactttcatttaatctttgctttttttggttaaagcaataaacaaaaactctcgtttgaatttttcagagtaaaaagtcttattttgttaaatcttgcagcgcctgtgacataattctggaaagtattttccttatatagtgttctagagtagaggtttataagtgatatgttttggatctattcaagttccatgaaacccctcagaaagtgtgcagtgggccaggcgcagtggctcatgcttgtacaaatcccagcactttgggaggcagaggcaggcggatcacttgagggtcagcacttggagaccagcctggccaacatggtgaaaccccatctctactaaaaatagctgggcttggtggtgcacgcctataatcccagctacttgggaggctgaggcacaagaatcacttaaacctgggaggcggaggttgcagtgagccgagatcacaccactgtactccagcaagactgtctccaaaaaaaaaaa

SEQ ID NO: 125182 - DNA, 1050 bp, Homo sapiens
taagtgtagctgccaagttgtacaataaatctcttgaatttacttttgtctaactgaacttttatatccttaggccagcatcttccccccatactccctatgccccgtatctggtaactaccagctctactctctacctctatgagttgaggttttttagatttcacgtataagtgaaatgatgagttatttgtctttatgtgcctgccttattccacttaacacaatgcgcttcacgttcatccatgttgtcataaatgacaggatttccttgttttttaaagacttgaatagtatttcattgtgcgtatatgccacattttcctttttttgttttgttttgtttttttttgagacagagtctcactctgtcgcccaggctggagtgcagtggtgcaatctcagctcactacagcctccacctccggggtccaagtgattctcctgcctcagcctaccgatagctgggattacaggccacattttctttatccgtccatctcttagtggacgcttaacgttgattccctatcctggctattgtgaagggttgagtgactttaaagatcaaaaaatgttagcagagccaagggtgtatagttaagttttcaattcgcaattttttattctttctgtcatatataatagtgcctcttggtagaagttgaaaggaaaaattggtctgaactgtacttaatccaaaacttaacttgaagtatatttttttcttctgctgtttaagaagcatatgtattttattttatttgagacagtctcactctgtcgcctaggctggagtgcagtggcgtgatctcagctcactgcaacctccgcctcccgggttctagcgattctccagcttcagccttccgagtagctgggactgcagatgtgcaccaccatgcccagctaatttttgtattttttagtagagacaggatttcgccatgttggccaggctggtctcgaactcgtgaccacaagtgatctgcctgccttggcctcccaaagtgctgggattataggcatgagccaccatgcccagctgag

SEQ ID NO: 125183 - DNA, 1047 bp, Homo sapiens
acttgctgtgctcttgaatgcctttgtgaatctacataagctgtttcttttgtatgtaattatacttctcacctgagtttgacaaattttttttttctttcagtgtgcaattcaggccctaccgcctttgaaatctgtcctgaatcccacaggcatcattgggcacatcttcttttatgtgtttagagtatattattcattctatgtattatttatagtacatgattataatttatattaccaccatttttcttttttttttttaagaaaaagaagggaaaaggaaagaacaaacttaactaacgtttgtgtacatcactttattatacatagtttcctttcacaagaattattttaaaagaaagttgagatggatgatgtaggtatcattcttatgtacattttaaagttacagaagtttagaaaatttaagtgcatttgcaagatcacacaaccaataagtagtagagctcaggatcttttgacagaaagattattttcattatatgggagtgcttctctggtaagactctgaattcagccttgattacctagaagtatcttccaggtagagaactctaggggcctctcaagtctgctttagaggtaccattaggctgatggcaatttttagagttcttttttagtaaagggtctgctgaattttgctttttgtctttgcatcctccaaatatatttttgacaaatgagttatgctgtaggtttaatcttccagcagattaggaagttatgtgatatttctacttttgaatctccctttgtcatattggatttaattatattttaagcagtttgaaagctcttgaaatatctaatgagaaatctataaacaaaaaatattttgatagcaacaaatatttaaaattacctgtaatttttcccatgaaagttatattaaagtctgatgacttttttttttttgagatggagtttcgctcttgtctcccaagctggagtgcaatggcgcagtctcggctcaacccaacctctgtctcctgagttcaagcgattctcctgcctcagtct

SEQ ID NO: 125184 - DNA, 2048 bp, Homo sapiens
acctcaggtgatccacccaccttggccttccaaagtgctgggattacaggggtcagccacggcacctggcctgactttaaattttaatacttggttaatcacttaaggtttaaggaaaaacaaaagaattgtttgattttgttttctaatgtgttactttcctggcagacaaagaaatagtgtctgccttcttttaaaaaatattaatgagatttacaaatgaaagtatttagcagaaggactggccttggtgtctcttgcctgtaatcctagcactttggaaggccaagatgtggagattacttgagcctagaagttcgagtccagcctgggcaacatagtgagatctctattttaaaaaaagtagaaattgaaatgcacaatagttaacgttgagaccattatttttgggtctttacaaagtttagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaattatgtaaagtggagtggttcatttcatttttagatttttcttttttgtatgtacacatttatttgataacatctaagaagtcgactatatgtttttcagtcctgtttctttttcattgtgagttaatttgctttttgtgcaaatactgggtatagacacaccacaagaatgtaatttgttttttaatccatgaaagaaaaaagcatcgtatatgtagtgtcacatcagtttgcttcttctttgtgtgatctaaacaagatcatctctacgatgttgacagttggtagccaaatctaatagcgcaagtttgaaattcatttttgaggattctggattttttttttttttttttttgagacagagtctttcttgctctgtcaaccaggctggggtgcagtggtgtcatctaggttcactgcaacctctgcctcctgggttcaagcaattctcatgcctcagccttctcagcagctgggattacaggcatgcaccgtgatacctggctaatttgttttgtatttttagtagaggtggggtttcaccatgttggccaggctggttccgaactcctgggctcaagcaatccttaggcctctgcctctcaaagtgctgggattacaggcatgagccaccacgcccggatggattttcttttatttgtctgtctttggataatgtattttcatattacaacgtgctttaattttcctgggctttaaatttcctggaaccaaaacatagtttcagtctcttttacttttgtctttacatttgtaaacggttaacgggatttaatattagcatcctaatcgtaacgtggatttttgtttgatagtatactatattactgaattgggtgatacctgaaattgtccttattctcttctgactccacctacgttggaacttgcttttatgattaaatacttctgtctgcacactttctcaatatttgcttctttttcattagagaggtagaaagtgaggcatggtacctattatgcaaaatttttgagtaaatcaggtgtttttccttgtccttagtaacggtcattttcatttgtcttttgtcattgttaccttttaaaagctttttaaaaaatagtttattaaaaatatttaaaatacaattaaagtaccactaacttctttaaagttttcttgccagctctgttctctccctggctttatcccctttctctggaaaatgaacatttgctcacccgcctcagggaactgaaggtttagtgtgattggaacaaaaaccaaatgataatggattttataggccttgtgtaggtattctctagatggaagcaatgtgtactatagccataacatattcatgtttcatttcacgctatcactttgactgcactttggaaagtggtttggccttatacgtctggaagcaagaacaatcacttaagaaagctgttgcagtaaatctaaataggatgactatagct

SEQ ID NO: 125185 - DNA, 1071 bp, Homo sapiens
cactgtgatgatagaggaatttaaaagttatttttcttggaagatatcaaaaggagaaaaacaggagttcaaatagggggaaagaacatgagagaaaagattgtgtttattgttatgtagttatgttatatgaaagtattaataagttaggcaatgcatatgtagggtgaggaatttaaaatagctgagtgctacaaagcaaataaaataacgactatagtgtcaaagtaggggtggtagtggataattgggtaattttcgttaggggagttaagataggcctcttttaggaagtaaattggagctaagaccagagtgatgagaaagggaaaacttaatgaagacctgggccaagaacattccaagtacaaaggagaaggaactcagtacggcctgagaacagacttgggaggtttaaggtcaaaggttgcccagtgtaataggaggtaagatccttgctgtacagtcttatcaactgaagtaaagtttaaattttatttgattgcagtgggaaatcactgggcagttttaagcaagcagttgatacctggttttatgcttaataaaaaaactgaaaagaagttaagggtagctgggcatggtggtgcatgcctgtaatccaagctactccagaggcaggagaattgcttgaatccaggaggcagaggttgcagtgagccaagattgcaccactgaattccattcagggcaacagagcgagactctgtctcaaaaaaaataaataaaataataaaaacaaaaacgggcagggcgggcgggggggtgcaattagagatggaagccaggaaaccagttaagatattgttgtggtcataccagtgaaaagaataatggcttggactaggtatttggattggggatctattttggatgtagaattggcagaagttgtttggaaatttgagggaaagatgaatcaagaatgacacttggatttttgacattaaaagctgggtaggtgttagaaaatagatcccagatttcttttgtaggtttgatagatttttctgcaatggattgtgaatgtcttaaagatgacatggcattttg

SEQ ID NO: 125186 - DNA, 2072 bp, Homo sapiens
tcttttacttattcctttttagtcacctgaatttgtttagtttctctacgattcaacatacttttaatttttaagattttttaaaaaatacaagacactaaaaatattttttaaagtaaaataaaaattaactatttgtagatagatttatataaatttaaacatttccttgagcctagttatccagttgcacttttataacaccattgtataggtttgatatactcatagatccttgatgtgtttgagaaactagttgtcataatttttacaaattttgttcttccacccagtaaatcatgtgtcatctaaagttagagggcaatatacattaaggtgcctgacctgtgcccagcattgtttgggctttgtgtgtggggttcataataaagaatgttacgaggttttttaactttctgggaaaatacaaaatagggagttaagacaggtaagtatgatgtaaatttaagaatgtgaagataaatatattattaatagagattagactttatgaatatgcatcttttactgtgttgtaaaggaagtatagcacttgaatgagaaaaatagggaaaggattttattaaaaggggataaggcagctgggcacagtggctcacgcctataatcccagcactttgggaggccgaggtgcgcagatcacctgaggtcaggaatttgagaccagcctggccaacatggcaaaaccctgtctctactaaaagtacaaaaattagccaggagtggtggcgggtgcctgtaatcccagctactcaggaggctgaggcaggacaatcgcttgaacccgggaggcggaggttgcagtgagctgagattgcgccactgtactccagcctgggcgacaagagtgagactccagcgcaaaaaaaaaaaagggcgggggggctaaagcataaagaggtgagcataattttaaagaattactaagttcagtttaactagagtagctaaaatttgaaagacttgctcattatgtgaagataagtgattccagtaaacaagcaaaaatcactgagaaaagtacattaataatgttagaaaaacctaatcttaatttactattaaaaatattcatcttattctgtcctcttttcacagtttttaccaaagtcaaatgtttttgctagctttggagcactgttaactatagtcctatctgtggtaatgctataatgcccaaattgatagttttataatgctagtgcttaagttatttggagaaatttggctggatgggggcagagcaggtcaggcagatcttacactgcctggaactgcaaatctataggtggcaagagggaattgctttctaaattgaatgctccatttccttaacaagactggtccaggaccaagccaagcttaggtaaatgggcttggaatacagcctttctggggaatttgctatggcttttgagtccttgtgatttggaaaacatctggatataaagagatgtttatagctgatctgaatatatatgtgatctccctgaagtaagtaactacagatcagccgaagaacctcctctgactacttaggattctcttcaagcgtgtcaatcagctagaacgtgaccattctctgagcgttgaacactttacattgccagataatttgtgctgttttcgtcaaacctgaccctaatataacttgactaaataatcttgtctgtggcaaataaagaggtagcagtatatttatgtcctcttttcggaaggtgataaaggaattatttgataaagtacgatatgtattgctactttgcagagtagacctcaagtagatacttgagtagacactctgcatttgtgtgcttttttctattcacacactacagtgggtatgtgaatcagtgaaaaattgccaaaaatatgatcaattgaaaacttttgttaggtggtctttatttgaactatatcttgtcatccattagtaatttagcaagatttgatcagaaccagtcaacgctctttaaatcagttaatcccattaaaggtttttatggaaaggaaaaacagtgctcaacaattgagttgatactaaagctttg

SEQ ID NO: 125187 - DNA, 1165 bp, Homo sapiens
cctcccgggttcacatcattctcctgcctcagcttcctgagtagctggggctatgggcacccgtcaccacgcctggttaatttttttttagtacagatggggtttcaccgtgttagccaggatggtctcgatctcctgacctcgtgatctgccagcctcggcctcccagagtgctgggattacaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagttaggattatagggattgctttagtaaaataatatttcctcagagaatctgtcttactccaacaaatactaactctaaagactgttttctgtgttttttagtcggccgtatactaacaaggtaattactttatggtaccgtccacctgaactgctactgggagaagaacgatacacaccagccattgatgtatggagctgtgggtaagatagccttatttactggtttattttacttgaaacttttggtagtgaattaaaatagatcatttggtaatgacgggtattttttccattagctgtatccttggcgaactcttcactaaaaaacctatatttcaagcaaatcaggaacttgcacaactagaattaataaggtaagctgctgattataatattggtgggaattgggagagtgtcatactccacaggaaatttaaactctcccaagtttgtcttttcaggaagagaacaacatggttctctggagggcttatgactgctaaatggaggacaaactgaaatgtaggcactttgatacttgttccagtgaaattaaggatatcaaagcccctgggtgggtgcatgtgtatgtgtacatgcgtgcgtgcatgtgtgcgtttttttaagtcaaaggacttgaggcccaaaagataagactggcaaggaagagtaaatgtaggagagaatgaatgctagatacatattttttaattatgaaagaaatgaaaaattcatgttttggggtattgtttaaaaatactcttgtaaatacacataaaaatatgtgtctatatatgtgtgtatacacact

SEQ ID NO: 125188 - DNA, 1001 bp, Homo sapiens
tatccattttatagcatgctgtactgttactaagaaggaaatagttggtcaggcacaatggctcacgcctctagtcccaacactttgggaggccaaggcgggcggatcacttgaggtcgagttcaggaccagccttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgttaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtat

SEQ ID NO: 125189 - DNA, 1088 bp, Homo sapiens
tctgtttacctctaggaggtacccgaagactctccaagagggtacacctggaatttttttaaaggaatttccatatccatatgtctgctttcctaagactgagctttgaggatggcctgcttgtttaagcaagttcttttacatctcctctttcacaattagtcatgttataaaataaaggcagatgcaataatatggttgaatcttagcaatattagtttaaaaagtcattcccaaaatattacaaacagcatgacgcgcttttataaaattaacaactaaaatttttaaaatataaccttttatgagtacatatagatggcaacaaaaagtatatacaaaagaaaacagggatgatggttacctcaggtggaggaaggcaaggggataggttggtgggggtaggggtaatatgattacagtatgttattttcagcattctagcttttgtttggtaggttcatggctgcttattaacattattaaaaataactaaagtaactaaaataaataaaagagagccatgcatggaccaatgatgagtgacacaaggattatgattaaaccaagtctatgcacctgaggtccaaaaacaaaacaaaggcatacctctcagccatcttactatgatgcattgcctcagcgtgtaaaaacctcctggagtaacaaacaaagggacaatttgaaatatcgatattgggaagctttcaggcatcataaacccgccaaagaatttcctttctaagtgtttgtatgatatgatgtgggtctcagtctctgttgggataccttaaattcagatatactgtagtactgcacagtggggtaactggagtgattccacctttctatcctgaagctcagggaatgcattgctcttgaaggacagccccatgagagcaaagcaaagtaatccattaaaaagggcttttgttccctcccacaatttaaaagtaagagattattttctttcctttttttttttttgagatggaatcttgctctcgtgctctgtcacccaggctggagtgcagtggtgctatcccggctcactccaacctccgcctcccaggttcaagcaattctcc

SEQ ID NO: 125190 - DNA, 1161 bp, Homo sapiens
ataagcatatttctgtaggcattcctaacttacccaaagttacaaaaaaaaaaaggtaatttgaagaaaaacacaggcattttatcagaatctgaaaaatgtcatgatttcaatatagtgcaaagataaccttagattttgcataataaactttattttagagaaagtacggtgtagttaagagctcagattgtggaatcagaatatcagattcagatctcacctctgccacttacagaatatttgcccttgggcaagttgcttggtctctttcggtgtcagtttcttcttctcagtaaaaggaggctaataatagagtctgccttctaaggttgttgtaaggaataaaggatattaaatgcttagaaggtatgtgacactcccttagctgtcatcattatcattattcatttcccattcacaatgtgctgtttcctggttaaatccataacatgaggttttagtagtggtcttgattttccttttgaagtatttacccctaaagatttattcaaaattgactgcagttctttttatgtacaggtacattttaaatgtacatgatatttaactagacttgaggttctctttttacagtatttcttaaatactctccctcaaatatatattttcatatggtaatacagagccattttggtgtgggagtgggaggagctgtgaattatgacagttctaattaatataattttgtctttagtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcact

SEQ ID NO: 125191 - DNA, 1072 bp, Homo sapiens
tgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattc

SEQ ID NO: 125192 - DNA, 2065 bp, Homo sapiens
aactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaaagaatggagtagtccttatttaaactgtaatggtgtcaagtctcactgtgtgcacactctcacacatacacacacaattatactaattctagaaaggaaccaaaggtaaataaccagtgtttccattatcactaaatggaaaaattgactggaagttagagttgtgccaattaatcattttgttcatcaactgttctggtaacttatttttttttattggaatcttaaattggaacaactgttacagaatgtatattgctccagttctaaagccagttaaccctgtgccctctaacttatgaaccttcatttcaaaacagtatgtgggaagtcctgtagtttgataagagtaaaattattttaaagaggataatttaccattttactactataaaataagttgatatcagttgaccattttattttttgatggactctttttgttgggagaaagaaatgaatggaagaaaaaaatatgttgcttttatttgaatattgattactaacaacttataaactacattgcaggaaatgaagaaatattttgaaattagcaaaatagcaacagtattcaagtatctgaaattttaatatggtgagtcttagagctttagactttcctataagtgacagtatctaagttattcttaatagtcacacttgataattctgctgaccataagcagctaacctacagttgaagatatttatgtgacatgaatagcctgtgttttaaaaattaaatattttatataaaattgaactgtgtttggatagtttttctaatcaaacatttcagttatatatttatgttgggagagtggctgggaggacagggaaattgttgctttgacattgaaaatttgaactagaacttctaatattatccttacacagcactactgtgagacatactagtcttttatatgtcacttagaagaaaaaatgttgccaattaagccacaatacaatgctaagacgtcatcaattgtaagctgcatcccagattcagacatattatatgaaaatatgtcttataattgatgaaatatgatagtaaaaaattttaatgcttcccttcatagcatttaatattttaattcagtgaatttggattaatagaacaaagttgggaaatcactagttctgtaggttataacagcagtcatcgctgaaaatttgagtgaaatctaaagaacacaaaatattgcttaaattttttggaaaaaagcaggtaagtcagactgcaagttaagaagacaaaaatataaaagatttgacctgccaaaagaagaaagtatttatcttctcccacgtgaaattcccttttgtatttactgacacagcaggtttttctgcatgcaactcagtatgtttcctacgtcttcattatttgttggagagttgcaagtcatttgtgaaaccttaaaatgccaattttaaggagttgtcatttgtggaatgtgaaataaggtaataattctagctgtgattcagagctttattctgtcagcaaatacatagtcagtgcctacaacatgccaggtagtaatctagtccttggggtacatcaataaccgtcaacagtgttaaatcatactttcagtgtgct

SEQ ID NO: 125193 - DNA, 1110 bp, Homo sapiens
tccgcctcctgggttcaagtgattctcgtgcctcagtctcccgagtagctaggactatagatgcgcaccaccaagcacagctgatttttgtatttttagtagagacggggttttgctatgttggccaggctagtgttgaactcctggccttaaatgatccacccaccttagcctcccaaagtgctgggattacaggcatgagccacggattacgtatactttagacagttcttcattaatctttttctatcagatatttaaggtggaactagacagaaagtagtttaaaaccggaaggaaagtctcaagagtgaatattgttgctttgttgactggaacccataaattcctacttaaaaatttattttattacaaatacatttttcttaatcaagataaaaaataagcatcaaagcagcagcaaaattcccccttccccactcccacccagttcttctctcagtcacaacagcaaacattcagggagccctgaagtatgtacaaggcactattcagttacttaatcctcaacataaacctttaggtactgtacccacttcatgaacgaaaaaactgagaaataagggagttttaatagcttggctatagctatacagattaataaatagtaaaaccaggatttagtcttggctcacaagtctctttttaaaacaatctgctctattataacccacaatcagtttcagttttcaaatactctatgcactatatagaaatacttatttaatacaatggagtcattctatacttttatccatattatttaactgttctcctacaaatgaatatttaagatatttaccttttttcactttataattatatataaaattatacagacagaaataagctaaatatatatatgtccagaagtggagttgctagtcaaagtgtatttgttctttctcagtattttaaagttttcccattcagatctatgaaaatgtgttatttttttttcaaaatttgcctcttcctatttcttcttgtagataatcatttgtcccaggaatctttatatctggtagaacaaatccaaaatcttgttctttgaaattaccttagctattcatggcctcttcttctaca

SEQ ID NO: 125194 - DNA, 1085 bp, Homo sapiens
acgagtctcccgcctcgacctcctgagtagctgggaatacaggcacgcgcctggctcatttttgtattttgaatagagatggggtttcaccgtgttggccaggctggtctcgattgaactcctggtctcaagtgatcccctaccttggcttcccaaagtgctgggatttcaggcatgagccaccgtgcccagcccagaacatgtatttttagtatttttagtatttttagtttcaccatgttgaccaggctggtctcgaactcatgatctcaaatgatccacccatctcagcctcccacagtgctgagtttacaggcgtgagccaccatgcccggccaaaatcaggtgttttaacatgtaacacagactctaggcattttgaagttacaaaatacgaagatagagctagtaaaacttttgtttcaacattcccagaaagaaacgtgtaaaaacaaaatggtcacacctcctatttgaaccatacccacagaaatttgttcattaggtatttcacagagactagaaaataagaatggaaggcttttagattaataaaagctccatgaaagccaggattttggaaatgctgtttctacaagttactagctggatgagttcacttctctatgcctcaattttctcatgtgtaagatgagaaaattaatagtacctgtgtcatagaggtgttgtgttggaggattaaatgaatttatgtatgaaactcttaagccagagcctggcacatagtaagcactcaataagtggtagctgttactttctcatttacccccatttccttagtttttagaatagtgtctgcaagatagtaggtacttaagtgataaatggatgtagaaattctgattgtaactactatattgttctacctacaccctgtatataaaagggataacttagtaatttttccccagtattttaaagaaaaagtccttattcccaacattatgtctttccagatatgttgaggtcatgatgtataatggaaattaaagcaaagggaatacttttttaaatactttattgaactttataggtaagaaatgttgtctttaggaaatgacatt

SEQ ID NO: 125195 - DNA, 1321 bp, Homo sapiens
attactgcaaagttactacattagacacaaaagtatttgagatgacagtggtcatggaattataaataaatgagaataacgaattgctttaagtactttttttaaaaaataggaacacttgattaaaggaagcatggactttgtaattgaacattatttaggttcaagtcacaacttttaagcagcaatgtgattcccgctaacctttagctaaaggaagaagtaccaattatctttactaagtgtttttttaactgattttttttctaaagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttctagctattgtggttttgtggtatgataaagaagtagacttactacagtaatgctttgtagtcacttagagttcataggtaaatgttttgcaaattatttttgaaaatgaaataggtaaaccatcctttgagctgtagacagctctgtatttgttcgtaaataatgaggatgagaataacagagttctgttcatactcattttatctaatgcttctgttaaaatgcattaaaacttgaagccccagaaacccatttaagcataactttatactcatttaactggaaaaggcaagaatagaccatgcattgctaaatcaaagtgttctatctgaatttctctatacctcttagcattatggagttagtttctcttgaggccaaagaagatagctaccagcagcctcaaatcacttccattgcaaaaagaacatctctcatctccatcaatccaagagaagacaaatttgccatacttagatcatgtttctgtattattgaaccaattaactgtggccaaggccacagtgagaccta

SEQ ID NO: 125196 - DNA, 1088 bp, Homo sapiens
gtgtgatatcagaaaaagttgggttcaaatctctggtctgctatgtatgatataaaatctcaaacaagttactttagttctctaagcctcacttataaaacaggaatgatgatggaagctgcctcctagctttcggggtcccgatgtgataatacaatcatatatggccagtgcttaacctggtacctaacagagaataaaagctcaatattcctccttcttctcttccttctccttttcctcatcatcgttaattctctaatatgcttcttgttagtatgaagtctaccaagttgccatcctcccaagcatcttctcagaaatgtccaggtcactctctagctttcagtcagaagttctctccttaccatatcagtgttctcatcccttttgaatacctttgcatataatcacttgttttcatggattgatgactaaatgggacaccaacactcagatccccaacccaatactcatctcgtttcctacttctagatgctattagacatcttttactgactatttagtgggctcaacacactgtgtggtttttttttcctgaaaggtatttgttgtacacagacaaacagagaaaaggaaattctgaaaggaaagaactttgaggtctaggatccaaatgggttattataaacaattgagagtgtttaaaaagaaagaaagaaaaagaaacatttaaaagaggtcaagaaagtacctccacagaacccttttcatttatattatttcaagtaaaagatcacatattcaaaatgttcctattaattttcatatgctgcattctctcagcatgtttgaccatttcacttcataatgttttggcacaaaaatgtaaataacattgcacttcaccttcccaagttcccatagtccattttccgtaatagggggaagaatacactaacagtcagaaactatgcacattctgctggttgaaatccaaaagtagtttttttttagttttctgtcacaacttgttcttgggagtttgctccttgccaactagaaactatgattttcaagagaatacaagccctcttaacaatcagacaggattattatatctctgt

SEQ ID NO: 125197 - DNA, 1847 bp, Homo sapiens
tgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaatt

SEQ ID NO: 125198 - DNA, 1044 bp, Homo sapiens
tgcacctctttttctctctctttggtatgtgtccaccaagctcatagaggtttaagtgatgaaatattatcacccacatgggtttgcgtgggactttcttagtgaattactcaggcagagcaggctgtgatacagccttgctcacaagcctcgggagggaaaaaatagcacagaggatgaaaagaatattattagagagcaggtaatgaaaggttcgcaaagcaaccagctatatctggttagctaggtaatagtgcaggaacctaggtcgcacctgtacaaactaatgcagaacctgctcacggcgcactatgggaagacattcatttcaagagtttacagcatgagatatttgagtaaaacctgaaactgattagaaattgatcctgaacatcccagccttagtcaaccttccctttttcaaattgttatgcatggagattggaggattggggcatcttgaaagtgtcactgcagtatagcaatctctctcaggtaatatagagataaagggaatataataaattgacctgttatttattatctttttcatacctaggacattccgaggcttaatatatttctgaagcctacagccctgataaacatcaatcccacgtcagtttccagcagtctcatctccccacacccttctgcaatgaaagctaatgtaaaagaaagaaatatgcactgcttaataagtcagaatacaatagaacttgtaaaatgtacctgcatataaggtagacattaggaagacttgaatctctctcttccccctgttctcctgagcattatggcaacagcattttcatgaaattagatctgttttatattttttcctgataaaatatcatgcaatatacaaatagcagttccagaaatggacaccaggagaaggaggcgacaggcatgtcaattagtagggggaaaatccaaatgtcagaaatatgggggagagagaaagcacgcaggcagtggatgcaaatacagggaacagagtctttcaattcagataattaaacggatgcataaatcagcacc

SEQ ID NO: 125199 - DNA, 1079 bp, Homo sapiens
cctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggttggtgctggcattggcagggggtggggaggggtggggggtgggagggtaaaatatatttctttgacagtcccaggaggaacttcttttcccttcagctggaaactgcctgggaaggttattagttattaggtgatggtagcggactagccgacggagggcaggcaggggagggggagaggactttacagaaaaggaattctcggtcgagctctgcctggagatgactggcttacacttactaaacccagcgggtcacacagagaggaagctcggggccaatgttgagctggaaggcagactgtgaggggctgccttgccctgcctgtgaaaccagatctgagcagccggaggaaagccgcggcattttcgggtgctaggggagcagaggaggcttccggaccccatccaagtttttattgagggtagaggggtgaatgtaccaggattggagtggaa

SEQ ID NO: 125200 - DNA, 1274 bp, Homo sapiens
cagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttggggg

SEQ ID NO: 125201 - DNA, 1053 bp, Homo sapiens
cgccctgagcgtgaatgtgaaactcgtggagtacctttgcctggggacttgcctggaactcaagcgttgtgtaccatcacaagattctttttgtccttgcacagcgcttggggaggggcttcagtgaatcgagggagttgttattgttttgtttaagccaggcatcagcaaactacagcctgcggccatctccagccgcccctgtttttgtaaaggaagcttcatggacaccccgccacgcttgcttgctcactgctctctgtggccgtgttggggctacactgcagagctgagtagttgtgaggcaggcaatgtggcctgggacaccagaaatagttcctagctggccctttacagaaaagggttgctcatgcctggtgtaagtcatgctcgaagggaattcatctccgcatggtctctccctttctctgtctccaggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcc

SEQ ID NO: 125202 - DNA, 1071 bp, Homo sapiens
aatcaaatcagaacaagatgtgatcttactgagaaagaatccttataatatcacgttacctccccctgaaaattcccccaagcatgcataaaatccagaagaccttaagtagaatattgaagagagcctttaaggctgaaaagcaagctgcatttaccttccttgtatcatattatatatacatattacaattatgtcagcgattaaaagcattgtcatgctgcattatgaactgtttttacgtttaggattagataattctttccccataccccctcagattccttttatgtcctaagggcaaatcctttctcttgggtcaggaatgtaataaggtaggttttcctctctctgggatattgtgtctgtctcactgtgtttaaattgattcagaaagctcttcagagcaaaatacagtattttctttgtatatgagccagcggttgactaacccttggggaattctctgtgttgagcatttgaaaggtacaggttgggtatgtttgaactgctgatgctcagtgaagaccactgggaaagtggattggccgtggctctgagagaggccttttctctaatgtggactcgaggaaaaaaaaaataattgttccaacaaataatttttaatggtacaataatttaggaaaattagccagttcattttaataagaatggatcaagaccaaaataaagagggaattatagtttatacaaatgtatgaacatacagtttaaaggcatttagccaccaaaaataaattttctaaaaacagcagttttctctccatccactgtatgaagtgttaacacatccctcctgagagttgaaccacaggccctgggatcaaaacagagcaaatttaccatttacactgaaggggactttcacttagatttggtatctccttccagaccaccagttagcagaggtcagacccattgccaaccaaggataactaatttaacccttgtaatgttggttactggttttgacagtgccccagagtctaggatcttggaatatgtatcaagtatagtcagagtatcaggagtacactgtgtgtgtttgtg

SEQ ID NO: 125203 - DNA, 1033 bp, Homo sapiens
cccaaggagctctctaggacatgcgggagagcccagtttgtgaagaggaggtcttcctggtggcctttcctgggggcagggagagtttgcacaggttcctctggtgcagtttctaccacaagataaagcagtcaagctgcaagtgaaacacagccctcactgtattcctcctcgtgtttagcagagataaacttcactggaatctcagtactgagccatttggcttctggctgtagctttaattgatataatgcagattttttttttcttgatcaagaggggattattcttgttatcagtccagagcatcttattttaagatgaaaagcctttacggaattacagatgccagcacttgtacaaagctttttggcgattgacaactcaaagagaaagtatgatttattagcctataatggctaaccctgagcaatggtctaggtcctactgatttgtgaaattgcttaacgtgaactgcctttttatgctacacaagccccaggttactcaagtaaatgtagtgtctgcattacatgaaatgttacaggagagagaagaagaaaagggaggggggagaggagcaaggtggattctaaaatccatcttggtggtgccttttacagtagtttggctgataagccggcagaggaaagattaataacgaggcttgtcgctatcagtacctgcttgtcgattctctgtaacagggctgtctgttcagcatggaaattattgattaaataaaaatggctattagattgtgacgtgatccataatcacaaacaatggtggacattcctctcttagatcctcggccatgcatcaagtcgtttcttttttcccctggccgtaatttatattgcgctgacacttgggctcattaggtttatcctttctgctcagaggcacgagcggtgaggaccagcaggaagtcggggaggaagagaggagagatgatggccccggccagggatctggccagtgtactcactgggctagcataaacatgttgcagtaaaatacatatcacata

SEQ ID NO: 125204 - DNA, 1083 bp, Homo sapiens
agtcaccctgcagtaaatcctccgtgtctcatctgtaaagtggagataataatatccattctaggttcttcactgggttttttaatttgttttttgtttatgaggatagaatgagatcctataatggaagtactttgtaaactcaaaagctttattcaaacataaggaaaaatccatagcaagtagtactaataaactcactcaactgaagaatggagagattaagtgcacttttatgaacatttaaaaatagtcataagtataccattgatttcagttgcacaggctcgcctatgcaggctgctgttcatcttacctgtttactcatctgctgttgatccatcgtcaccacctggtggccactacagaaattgcaggcatagcagctagaagaaaacgcttcatgcatgtccgatctagggtgctggggttgggggctatccctttgagtaaggggagcatacagggcaggctgttatgagtactatcgatgtacaagcaggacagtgggaaaatgagtaaggtgaaggcacagaagaaggaatgaaagatacatctcatggagattggatatgagcatggtatggaataaactggtggatgtaaacacagaaagaccattgcagaaaggcattggggattctatgtggagaagacagcaggaagaagttaaagggtacagaaagtatgggaaaattttatctatgattatagctaatataataaaagactgaggtttttggcatctctttgaattagaaatataattacaaatgatttgttttatgctttttggttgaagagtggtatgataagtaatgcagttagagcagaaccaaagtatgtccggaaggcagaagggtagtgggtagtaagattaaagagccgagtagcaccatgtcatgggagatgtgattgctagactaggagtctgacttttattccaggtggagtaaggataattaaatgcttttgatgagaggaatggcttgagccagcatcagctttagaaagatggggctgagccttgcaaaacctggcaagttgcaagtacagtgtattaaagagggcaaggttagactg

SEQ ID NO: 125205 - DNA, 1695 bp, Homo sapiens
caatcatccacacagctaccttagctaagtcttgccataatcattcatgcttgcttttggaaacactggcagtaactataacgctgcagaaacggaatattattactgatttctccctaacttactgtgaacaatgactgttttcaccacgtttctgctttcctttattaaggaaatacaatgtagaatgaaaggagagtttctcaaagcctggtgaaattctcctagggtattcttaatgatattcagtcttaaatgggcaagctattgtaatgtaaggttctctgcaggaatgatagtaatgtaatcccattgaagctgcctgttatggattgtagtcaaataggcaaaatgtagagtcacattaatgaacagagtatatctttggaattattacttaaagttgttgaaatggtttgaattttgctattgtaattattttattctcctttaatgcgcttaatagccatagtaattaacccaccagattggaaatttgcatgagttctaactttgacattacaagaaaccctgattctttctgggtattacacagcaggacagggagaaatacatacatatatatatataaatatttttttcactgattatttttttaaaaagaaatttccatgaatgcaattattagtttttcatgcatttttaagccattggcaaattccttaagaacactccattcttttaagaggatttgattccagaaccacactggcacaaagaatgatttggcattgcctgctagtcgagaaatctttaggtattatcactgcttcctcaggacttactgtagcctgggaaatagtgtggcataataaagtggtgacagtcattagcatgcataatgggctttaatagacattaaatgctgtttagctagaagagggagcagtgctctcccactggaatattcctccatcgaagcccattgatcactgatttcagcggggagaggttaatccatcagcttctgtaaccagacggcactgatggaaattctttaggtggcattctggatgaaccaagctttccatctttacaaacaaatgagtgatatgacaagcatggtgttcaaaacacatttaaccaattgattttctttcctcttgtaataagatctggagacatatgaaagcgtgcagtgtgagctaagattaaaggaattgctccatgcacaggaacatacggaactaagagccaataaaagtcctataaagcatgtagtcacccattctctttttatataaagtttgttattgcaataaatagttattattgaactgatgccttttatttccgtttttgcagaatcttgttttaggtctgcgtgtatgtgtgcacacacatgtgtgtctcatctcagtgttcatctttctcttagaagttttcaagatgcttggcaataatcctaccttctcatttaaacaaatttgatttgggatggtaaaattatagatagaaagctgcagatcttgtgtacttgtctgagctcagcgtttaagtgatgatcgtctttttttatctcccccgtgcagccctgccttgagcttcacctactcttccgcgcccgtctctctccacatgcatcagcagatcctaagccgacaacagagcttaggttcagcctttggacacagccctccactcatccaccctgccccaacttttccaacacag

SEQ ID NO: 125206 - DNA, 1029 bp, Homo sapiens
taaagtaacatgataaatatttcccttgtggcctaaagtttttttccttaaatctctatctttaccatgtatcatggataaaaagtatatgaaacaaatataaaatacccacaaacctatcactagagtgctggtatttctagataataatcgtaaaacttttattgattgaatgctatgtgctaagtgtgctacatacataatttaatttttgctcctgacgacctcatggagccagtttaaatccagatctctatgagtctggaggccaccctcagaactgctacaatgtcttgctgcttttgcacgaaaattggcaggtggaaaccgactattatcctgttagaaagctgagtcttggcagtaaattgctccagattgataggtatattttctttttgattttgtaatgaagaaaaggaaaagagagcttttaaattatggaatgtaaaattgtagcttatcattcagttgtgttattaaagctgtgctgccttttttcatactggtaaaccctgacttttcatgtgagtgagagttaactcagacactcttgtcagaaagcttagaaaagtattttaagtatgtctggaaagatatcatagtcttctaagttgtctactattgtaagaaatgcaaacatacagtgatttgatataaaaatgattttatttggggggcaaatgtggttatgtacatatatacattttaatcattctgatttgttgataatttcttagaccaacaacaaaaacttagtaatgcatttcacttttttctattcctttccttcagttttattttcaaataaaagatgtttcatggaagtaagagcacaatttgagttaaaggagctttactctaataagccataaaaggaattgctgatgtgggttgtgtaatggactctgagatgcctcaagagaaacttctagttgaccttctttcgctagtaaccatacatctcttgtctcctcctagcgccccatgcaggagtcagcccagcagaatactatcatcagatggccc

SEQ ID NO: 125207 - DNA, 1024 bp, Homo sapiens
aattcaaatatgaatttatcaataaaaaccccaagtcttggttctatggcggaatataacagcaagccctcctgtagcccccactgtgtgttctaggccctcattactgacctgcattggcccgtggtgataacatcacgagacaagatgcgtcacatctggaccatcctcgtaggcagagtcgggggagtcacatttcaggtgtgactgttgagctgggttttctttggattttagttcttcctgcttttttagccaggctttggatactttactagcatctgactaaatggttctctagcagcctaaatgtataattatcaaaaagattgatgatgtaaagctgatagataatcctgagcctcaaaagacaagtcctggaagattctgagagggaatatcattgctgcgggcacagagaatggtgagcttatgggtttgtggcctcctgggactgcctggttttagtgcatcctggcagggccctgggtggacgctatgcttatgaagtgggccccagcaagctggggcatgtcacgcccctgtgtctttgtgactgacattctgtctgcattggtctcagtggccttccctctctgcatggtgaactcctgcttatattcatcctcaaggcctaatttaagggccgtcccagagactcgcatgtagctttgttgtgatgcttttcctcttgcttggtgatttattgttaacggtcactgctcccttctagtttcaggggcagtgcccagcacttggtcaggcactttgtaaaaggtgctcagtggacactcacattggcccagtctgagagacagtggaggagcagtcagagagctcgaattcctgttcttgtgttgccactcacttgtgctgtgcactctggccactgacctttgcatgtgttggtttcgtaacgtggaaatgaagctgtctgctgtacccacctcttcagatcacagggagagttcaatgaaataatgttcatgtaagcactctgaaaagcacagagctctaaataaat

SEQ ID NO: 125208 - DNA, 1083 bp, Homo sapiens
aggggtgtcgtagaaggacatggcctgagcagaactgaggcccttgaaggttgtcatggagaggaacgtaggctcataaagccaagttctgcagaattacacgtttactcacttcaggacagagaaaatggcatgataatttttaaaaagttattttttcttctttcaaaggacaaaggcttgagagagacattttgttaaattttagatcagtaaatgctgtttgccaagtaatgtctaagagaggggatcctggccatttccatggacacgagagcccctgctgggtcccgtgctcctggcaggctgctggtgtccaggggaaggggggctcccggggtaggccccaggcatcacctgcgtctccctccagcatctcccctcgtgcttaaccagagcctgggccagggcctgtgaggctgagaccgtctggggtctgatgcctgctgcttcctgtctcacatctcccgccccctgcccctccatcttccagggggagcgactgtctctaatagggtggctgtgacagatgctgtgggaattctgagtttgggataatgagctgtcatatgtcatttcacttaaacacaataatacaaatattttgatcaaacattttctccagctgttgaacgaaagcaataaaagcagcagggagtgccagtgaattctctgtttctgaaacgctttaccctttaaaagctgttgcctgttaactccttctatctctgtctgtctcctttccctctccttttcctggcctctctgatttcccactgcatgcctagtctggggctataaataaagaggctgaattcagggatgtgaagggggtgaaattgagcacagctttttattaaacatcccttaggctggccgcagagcaaccgcagctgctgtgaacttgtaaaacctggcttggcctggccactgcagcacagcctccaagtgtttccccaaccctcacaatcacatccaacttttaggcaacagtcttttgagataacctatctttgatggcaccaggcccttggagctctgtggctggagtctggtttcatggctgatttccatggcagagtt

SEQ ID NO: 125209 - DNA, 1084 bp, Homo sapiens
ccatctctcattttcctcttacttcctttcgcttctcgcttttctctctatgccagtgcattttctttttcatggagttttgcttttatttagagtaatttttataaatatttgaaactaaatttatgcttctcagaaacaagattctttctgaaaacatactttgggtgataaagatgtaatctgcttccaaatctttccaaatctgggtgtaaattatgaaacagaaaaaaaaagaagcagccatttagtacctgattatcagtccacatcaagccaagttcagtgtgccttcctgaatttgcccacttgaattcagggcacacagtagcaggcacatgtcagaccaggagttagaaacacacggcttcaggactggccatgaaggacccagggcagattatttattctgtttgaaccccagtttcctcacctgtaaaatgaaggcaatttcacagtgtttctttggataaattcagataataattatcaaagttcctggcagtatcacagtcttaatctgttcaggctgctgtaacaaaataccataaatggagtggcctataaacagtagaaatttatttctcacagttctggagactgagaagtctcagatcaaggtgccagcagatttgttgtctgatgaggacctgtcttctggttcatagatggccttcttctcactgtgtcctcacgtggtggaacggccaataggttctctggggcctctttaaaaggaaccccattcataagggctccacccttatgaacacctcccagttgccatactgccaaataccattacattggggattagagttcaatatgtgaattttagaagaatatattcagtctatagcaatgttgtaactttaaatgtttccctgaatcaatccatctttaaaccttttttaagccaagagtttgaatctcagaaatgtgtgtttattaaatgatgatttcataatctcacacccattacacatagtaatctcaggagtggttcattgattcagtaaatatttggaaatgcctactttatgccagattccttgctgtgtttatgggattcaaagattagtaa

SEQ ID NO: 125210 - DNA, 1016 bp, Homo sapiens
attatgctaaggtaagccattttagggcagcttcactcttttcctttccctttctctttctttttccctctgtaattgtggaatctatttgtgtgtgtggcttatgctaaagaagtcttaatcatgtattatttcctatcctcttactttgaaatggtcagacttctagctgagttgtgtttgggcactgtagagggaggcagggtgtctgtgtacagttgtgctgggtgtttactgcacaaaggacagaaataaggggctaaacttgaacacatactctgctcaccaagctacccagaggaagagtctatctttccagtttgcggaaagcgccatcagctcaccaagctgagtgccagaggggctaggtctccccagaagaggcatagttttctaatctgttagattagaggtttctagtctaatctgaagatgctggtcatgactctagagggaggcataacatatcatttttaatttatcaggattgacaaagttaagtctagacacatctgtgaattccgtggtgggctgtacaaacacagtgctaactattgctactaacggtgcaaagttccattaagcatccacgtatttctgcggactcaccaagcattcaggtccttggaagcatctggaggatttgctcaagttttcacttttcatctggatatttgacattgtgtgcacacagctctgtgcattctccttctagcccaggagattccttttgactcttccattcaccctcaatcctcaggggcaataaatttggttgaaaagcagttgaggatttatgaatgtgaggcacataaaacccctttggattctcagacttacactaaacaaacttgtgagtgtgccagtgaagaggaaaaagtttaaaaaatccagcacgccaccggcaaggttggttattttttaaaacaacaacaacagtaaacaaaatggaaacaaaacacaggtcgcgttgctgatagcaggcagcagttctttgagcaggcgtgaagagatgc

SEQ ID NO: 125211 - DNA, 1114 bp, Homo sapiens
agtaggtcactgaacagttgagcccaaatcttgttcctcatcaactgaagatacctggctggcttcctgcttataataacagtggacacagtcttctggggcccagatatgcacagtgaggcataatgcatttggagaaaaagcgttggtttccagaaagagtccatgatattatcatagacggcagatgaaattcctgtcatgcagtgaatagtggggtaaaatctcccctgtcattgtttgtgggagtcttcagcatctggcacacttttttgtccttcacaagctctgtgtctgtctttactggttccattttctattattcctcttcttgggctcctatttcctggatgtccagggctttacaccctggagctaagcactagggtggccactttctggatcttgctttaacattccccataccgggtgcactgctcacaatgggtcatctagtgtttttccagcttacccgcaatgctcatgatcacgttacagactgtgcaaacctaagccatcccacctggtttctgtgctccttttcctggactaaagagagcgagctgaggaaagaacagagctaggtgagctagctggtagaaaaggtgcttagcttcagggaagcttaagtgctctagaactttatttcttgttgctgtgtctcatgcacctgatattggctatttgaaacattttctaccttcctcaggcctgctctcctgcctttggcccatagaaaatgacacagtttcttgaagtatcacctccattctattcctggtgtcctgttcatgtctgggctgtggtaatggccttcagactttctgttctccagtctgtccttcatactgctgccttgttaatcttcttgaaatgcccccaagattaccttcctgctcagaccatagctactcactgacaacaccgtccagaccccttgatctgaccccttgagctaccttgcaacttggcacctatgagaacactctcacactgctgaacttgcctcacctgagcagatcttatgctgtagttcgctggtactcatatccgatcccagcactctgcatgcatgccttgccccttgttttcggcctcagtccagtctcactct

SEQ ID NO: 125212 - DNA, 1875 bp, Homo sapiens
ttttcttctgcccccaactgctcctaagcagtagttcttcatggaaaatatgattcattcttccatgcaaatgctttgattgaaaacataccactggtattcttcctatgttccccagctcagatgacagaactattggttgctaattagcaaaacctgaggaattagcttaaagaaaaaaccctgaatttttaattggcttgcatttattttctgtggaaggctgttgtgctaagcccacttgcattcttgtgtgctaaaaaactgcatagattttttttctacctgtctgtctttatattaggtgactttccacatccctttagaaatacatcttctgagtgaatggaagagaggatgtatattttacatatttaataggtacacttgctcatacttctctctcttactatccaagtgtcatcttgagactgtgagagacaaaaatgcctaagaggcataaatgaacagttttgtcttgaccaaactgcaaaggcagtgacagttccctgagctcttagttctcttctcatccagactgtcttttacatctttggagaacagttgatgagccaatcagaaatgctttgtttttttccgccctttgaaaattagattgtttaaccagaaagactgatgttgggtcacaccctgggggctttgctaggtctcttgcttcctaggctgttagtcttgaattgcagtaagagctggagtgaggagatccaaacaagtccataaacctttgcaaaactattatttgtgagcttgagaatagctccctgcttattcttgtctttctcttagaaattcaatagaatgacctggctttcttttagtaatccagaggtaatgttttaagactagaaacagtgagccacttacatagccttttttttttttttttttttttggagacagagtcttgctctcgcccaggctgtgcagtggcgcaatctcggctcactgcaagctccgcctcccgggttcatgtcattctcctgcctcagcctcccgagtagctgggactacaggcacctgccaccacacccggctaattttttttttttttgtattttttagtagagacggggtttcaccatgttagccaggatccatagacttttaaagagctgcattgcaagacaacttggagcaaagcaatacagatttagggataattcttagtgttccagatttgaactgttgccagtgaatcttgactactcttgtgcctgatgcgaccgtgagtctgcgtatctctgttttaggagatagtgaatgaaactgggaaccaacagtgagaaaagtccctgtagcatttagaaaaatttgttaacaattttattcatcaattttgaggataaatttattaaaggagactgggagaagcttgaagaccacccaggtcaggaagagaaagaaaagaccaagagagaccgcatttttctagagaaaatcacttagccccttagtgcactggtccagtcctctcttcccctgccgcctggcactgttctcttctacaacgactcagctcccattggccactgctctggtgctggccctgcccttgttgccctgcttgtatagttgtttctcctggaccagttacttgctttctctttgccttcaaatcctgcttatgtttaaaggcctatctaacaacccacctccttggaaagtctctaagagccatcttacaaggatattttcctaccgtggacacttgagtagtcatgtcattctcacctttaaacacatcacagctacttccttgtgttgcccctacctggtggcccgacctcctttggaataatgtgattagtccgaggcagtacttactttctgtgggcaccaaaactcctagggtag

SEQ ID NO: 125213 - DNA, 1030 bp, Homo sapiens
taagttctctgtaaccaaatggcaaatacaattttgacctaccatcccaatgtactccctaaattggtcataaattacattattatatagataatatggatgggaagtcctaaagactgcacagattggctcaacacttgggaatttgggttcaaggtccagctttgtcacttgctagctgtgtgaccttgacaagtgtgctgatccctctaggaatcctttcctcactgtgggatagggtgataatatgactgcctgctccatggtgttcttgtggaaattgagacaatgcaaataaagtattaactaaaatctctggcacatgttaagtgcctcaaatgtattaaggtagttcttctctgctttctcttcctccttctcctcctctttttttccttctcttctacatcatcatcctcctcctcctcatcatcatcaatatgtgataagttgactctctaagtcatgtttgtgagggttgcacttgtatttgattcagtgtagactgttttttttttttttctttctttcttgccagacctggtcacctgcttgcctgagaccagtttcttctataacacagattaagaattgagcaaactgcaaacctgtaactgtggtgtcgttagagctgtgcactgtggccttctgaacataatcttttctcagtcaacctcagtagatcgactataacttttttctgttttgtaagtgaagaaattgtaaagattttaaatgagtttgagaagtgttaacattttaaattcttagcagaaagtgttttatgtaacaaatgcaaactttaatacatgcaggaacataaaagatatagtattatttattcatattgaatatttaaagacatcctaaactaagcctcagcatcatatgggatatgactttactttttctttagaactctgttggattacttaatctcctgccagtatcacaagtattttttgagatactttataataaaatctatctgctcacatggatttaattatccaggcaaagctaatgattg

SEQ ID NO: 125214 - DNA, 1390 bp, Homo sapiens
tggctgccttgccaaacggagcacctgtggaacacgccatcaacacagaaagtgctattggacagtgctgctcatagccttagaatccaagagattcctggactcttggaggcccgttgtaaatcgtagggccccaggaacctaggagagaaagagttcttacagacaaacttacagatgaccctaaacatgaaacaacaacagtaacaaagctagctcatctacaaggaccactctgaagtcctgtaatctgaagatggaagtctcattttactggcccaggcaactagttcctggaaagttcggtacatggatgatttttctagctagttagtgcttgatgttatttaccaagatgtatgagaccttgttccttcgtgtgagtattttaacctaggccattatctttttgcaaaatgggtatagtcatcttaggggaatgtagtgtggggcaatggaatgtttttattacacctcgaaatcacagttgaatggtatttatagagttatactaaaaactatatgaactggctttggaagtttttgtttttgtttttgttgtttttttgtttgttgttgagatggggtctcgctttggcacccaggctagaatgcaaagttgtgatcatggttcatttcagtcttgacctcctgggctcaggcagtcctcccacctaagcctcccatgtagccgggaccacaggcatgcgccaccacactggctaatttttttttggatttttttatagagacagggtttcatcatgttgcccaagctggtcttgaactcctgggctcaagatatccacccacctcatcctcccaaagtgctaggattacaggggtgagccaccgcgcctagcctggaaattctgcataggctgaaatttaagtcatgttacccattgctgtctgtgatgtatctggaccttccatttgttaggcagtaatatttttagtgtaggtgagaagttctgatattctaatataatccctagaaagtctgttttctagattataggagttggcaaaccatagttggagggccaaacccagcctgtttgtgtaagtaaagttttattggaacacagccactccatttgtttatgattgtgtgtggttgccttagccctactattgcagagttgcagaattacaacagactggcctgcaaaactgaaaatatttacactgtagcctttgacaaaaaaagctttgccagcccccagtccagatactgggtgaacgattggaacgcctttccagtaaggaaacatctgtgcaggtccaggtttgccagaggattttagagtagatgtgagatttccttattcttgggctatataatttagtagacaatagaaagggtaattacacattataccttttt

SEQ ID NO: 125215 - DNA, 1038 bp, Homo sapiens
ttctagagagggcacctcctagagagtgcttagcatgtgctcatcccattctgagtgttttgcatgagtgacgcatctaatcctcggtaatcctatcaagtggctactgtcattatccctccccattttacagaagagggaactgaggcagagacatgcctaaggcccatggccagtgtcggagctggggacccaacctgaggaggccaggcttacatttctggctcccgatttccatgctgtggtcattgttttgaaaaggtggcctggtcaacatgtggggcaggaggagagctaggaggtcatttaggaggctactgcagcttggctgagtccgggtgagagggggtgacggtccagctctgaagagggagggaagtggatggactcagcctatgttgtggagagaggaatccaagatgactcatcgttttttgacttgagcaaatataaaacataaatatagatataatataggacatcttacttgttctttatttgacggcggtgtagggattgggaagtcttcaggctgtcacaggtccttcagtgacctggaaagaaaactaaactcacttcctgtaaggggcatggatttctgactaggaaccccttcctatctgctgtccccagaaattgtccacttttcaaagcttgattgtcctgggcccttgctatggccctggctggggtaagataaggtaatgacgaggtgcctcaggccccttcctgatttgccccccacccaaataacagcctggcacatgaaagttcatcagcatttagcctgttgccacctgtccttgtgctgtttgcttgcacctggtgaaaagcaaatatggaggttggcatcaccaatatgatagtgtttataccctgaaaggatgagaacgtcaatattaacagtgatttttttttaattttttgagacagagtctcattctgtcacccaggctggagtgccatggcgcaatctcggctcactgcaacctctgcctcctgggttcaagcgattctcatgcctcagcctcctgagta

SEQ ID NO: 125216 - DNA, 1208 bp, Homo sapiens
catgtcctttctgttgagaaatactacttgatggcttctttaccattttgttccataagtaaacatgctgccaaccaatattcagatacatttccttttcttcttttatcctttctgctttccttcccttctttttctttccctcttgattagaaaggtccagcattttttaacatctcaagtgagacatgaaacggctttgaagatgatctcttgtcaagtgtaccaacagagattttagaggaaatttggaatcttcatgtcagaagcagtgttgtcttcaccaggttcataaggtggaactaagataaacttatagtgtgaactttaagtaacaaaggtggtgacctctttaaaaatctatataaatttaatctttaatgctttaaaaggggatgctgaaggatgcttttgtgtaatatattttttggtgttctatttacacgtagatttttaaaagatcttttttgggaggtacatcttctgcaatgcaacgttaatcaggacgcctttgtaggtagagaaaatatttagtctcctgtaaagctggcccctcccatccacattttctgcagctcttatttaacactggtgagaattaatagttgaaattcaaagagctgactgacattctctagcctagataatccaactatgtttccttaccactttctgctaaaagagatttacgatgtacctgcattgagaggtaggtccctttaaaagatatttcccattttgtaggaccatgaaaatgtctttaatcatgagtaaatgaagagagccagcattgtcttctgaagaatcttggggatccaccttatttatttatgtactgttggatattagtgaggataggggaggctgtttttgcttttctccccattaatttttgtgtttaacgttgtttaccttattggacacactccacctgcacaacttggcaacaaagtcatgtatgaaaaatgatcaaaaaaggaattacatttaattgtagcattctagttagagccaagatacatagaaactgacacactgtgtctgctcatttggcccttctatcctgccagaggaagatagcaaaccagatttattgaatacttactcatctgtccatccacccattaattcatgcattcagtaggtatttttcatgtatgtcctatgtgccaatactgtgctaagtactgagggagtgaattaaacaa

SEQ ID NO: 125217 - DNA, 1062 bp, Homo sapiens
cacaaggttactctcttcccaggcgtatatcaaagccacacaaatgcacacttgctttggtgtttacattttgcatttatctttagaagtgttttaaaaaaatctgtcacttataagaaaatacgtaggaaataacagttggcaagacctaacaggtgtttgctgtgttttcaccttttatactttaacatgttctggaagcaatttagttttacttttgtctcatctgtcttgaactgaaagttgcaggtacgttgatgagtactctggttaatgtaaacacctcttatattggctcaggaaaagtacgattctccagcttctctacagtgggctgcatgcttattaagtcacaccagctgccctctctgttctttgagagtggcatctgttgtttggtgactttttcttctgaaatctgtcagtgccaaggacaaggattaggagtgggttgaggctgtttgttatttgtttgttgttgctgggagttacttaatagtggtggaaaaggccaaaggaatattggagctcttacccttgaccttaagttaccctaactttagggtaaccttagtcaactaatgacttacaggtgccagacttaagataatgctggttgtcaaatcaaagagagaaggtatgtgtaggatgtggtctcagttccgtacatggtatgttgctaggatgcgtatgtatgaggtggattcttataaaaagtatcacaaacacctttaagaacaccacatagcaggctatacatcccttcaaagataagaagtgtcaccgtctgaggtgtaattccagcagtttcttaagcctcaacttcgtacacttgaaagcacacccacaacctgctgctgaaagcttttggaagtcattgagagacatggctcttgtttattctccaaattttaaatcatgcagcgtttggttggccttttgtctgaggagatacaaatttatcatagccatgtcaataagtacagaaaatttgccagcccacagagaaatttgaacttccttcctttcccgaaggagagtctcggggaagtcgtgcataca

SEQ ID NO: 125218 - DNA, 1030 bp, Homo sapiens
tttgggctatgcagtggtatccagttgtggtttcatttgtctctgatgactgagggactcaagtatctttttaagatatttatcggccgtttggatatcttcttttctgaagtgtctgttgaagtctcttttttaaaaaattttttagttctttgtgggtagataattgtttaccagtttttctatcactgatttgaagtgatacctgcattggttactgccttaatatatattttaggttctttttctgtaaaattttattgtatgatcaacctgtctattcttttgttgtaccatactctttcagatgttatacacagagtacattttatctgataatgcacattatctcttattattcttccttttcaaatggctcttggcttctattcgattttttcttctagctgaacttgaggaacacctttgtagaactatgttacttattgaattcatatgtatgaagtgaaagtataaaaacatgcatggatataatcatttctttaatagtggttaactctggggagagtggaaagggaacaagatggagagggttcagctctatctgtattatcttatttcgttaaagagaagaggttttaagcaaatgtaacaaaatattaacatgtattaaacctgtgtggcggatacctagatgttgcttatgttattctctgaaatacgtcatgattaaaagtatccctttagaatttattattattattattgttattattattattattattttttagatggggtctcgttctgttgcccaggctggggtgcagtagtgctatcttggctcactgcaacctccacctcccagattcaagcaattctcctgtctcagcttactgagtagttgagactacaggcatgcaccaccacgcctggctaatttttgtatttttagtagagatggggtttcaccatattggtcaggctggtctcgaacttctgacctcagatgatccaccagcctcagcctcccaaagtgctgggattacaggcatgagccactgcacct

SEQ ID NO: 125219 - DNA, 1955 bp, Homo sapiens
atagcaagaccctgtctctacaaaaaaattattaaaaaattagctgggcatggtggctgtagtaccagctacttgggaggctgaggtgggaagatcacttgaaccaggagatcaaggctgcagtgagctatgatcatgccattgcactccagtgtgggcagcagagtgagaccctgtctctaaaataaaaattaaaaaaaaaattgcaagtattttgaagggtactctacagataaaagtttcaggtacaaattcagggagattttgcccaattctggctgaattgctgataattacaattagctgccacaacagcagttgatcctttgaaatctgaaatgtgtgttttcttgatttagacttggtattattcattacccaccaggcttcctatactcatcttcctggaagaagatgtgtgtggcagccagaaggaacattttggactcttgtgtgactaactcctcccagatcatggccctctttcaaacctcttgaacatcctcatagagtgctttgcatagttttctgtttggcatctggttttatgtagttatagttcatcatggcttcacttagagcttttgcaaatttctttgatgctaatttagttgcattaaactttttggagtggaaaaaagaaacaaaaccaagagtacaataaactttgattaccagacccctaaacactgaacctctcaagtaacccatatttgtaatttattctttcagattggcatttacaggcgggagctggggaacgttgttattgaaaagttaggcagcagcgttcagatgcagctgaagcaagggcactaaactttcacagggacacttggagaaggtgctgcatcatctaacgaagattagatggtttattatatagaaattattaaaataattcattttagaaagagttccagtaaaaatggagcctaaaggagccccaggaatgcaggacgcctctgacttcactgaaggccacatagcctgctcactccagcctgagaccttagacccatccatgctattccctgctctcctctgtcttaaatgtgtttttatttttatttttatttatctacttattttttgagatggagtctccctctgtcgcctaggctggagtgcagtggtgcgatctcggctcactgcaacctctgcctcccaggttcaagtgattctcctgcctcagcctcctgagtatctgagactagaggcacgtgccaccacgcctcgctaatttttgtattttttagtagagacggggttttgccacgttggccaggctggtgtcaaactcctgactttgggtgttctacccaccttggcctctcaaagtgctgtgattataggcgtgagccaccgtgctcggctgtgcttttatttttatgaaaggaatacttgctcattgggaaattcagaaaagcataaaagaaaaacacgaagctggcctggaatctcaccacttggaaaataaaagttaacactttggtatattttcagtctttctctctgttcaggtaaccatatgctaggatcattttctgtgtcatgaaccactcttctccaacttggctttaatagctatgaatttactcaatcaatcccctatcattggacatgcacattttttttcaattgtgaataatgatgtgatgaaattccttccaaaaaaactgtgtgctttgactacatcttacccaattagctccaagaaacacagcaacttatatttccatcagctgtttatgtgagtgctcattttcagaaacacgtatcaacattagtgaaatattttaaaagaagataggataggtgaaaaccttacctcgctttttaaactttttaattgaaatacaatacacagattaaaaagtcacatagcataagtgagcagcttgatgaattttctcaaaatgaacacaccatgtaaacagagcccaggtcaagaa

SEQ ID NO: 125220 - DNA, 1004 bp, Homo sapiens
taataagagccccgactctcttgagctccaaactcacatgtcctgaactctggttaccactgtgttctttattttggctaagtatatcacctttcctgtggtcagccaggcttgaaaccgcaccatcacctttgacccctccttctctcctgctcccatgtcctaccggttttgaggtcctgttagattttcctctgtaattactcgctcgtgtgtctcttcaggccaacctactgtactgtgtggtgaaaaccctcacacctcatgcttagatgattaaaatgaccctctgtctaatcaccttgcctttcatctccactcttgtcacgcatgggacttgctcctgccaaattaggcttattacagttctgcttatgccacaaccctgctctaaaagctccagtgactcccagctacttgtagaataaagctcaaagtctttgacttaacatttagatatcttctaaaatctggccccagtctgacagtccaatctgatatgttcagaagtagatatgctactatcccatcgcataacctatgctttagctaaatgcaagggctcttggcctcttgtccatagaaatgttttgctaacaccaatgcatgtttaaattctcaaatgtgaatatgtccccagtctctttctctcctcataaggtcttgtgtcctttggggaactagcttataacactagatttttttatttttaaaattattattattttaagtaatagacttcatgttttagagaggttttaggtttacagaaaaattgagcagaagacacagagagttctcatataccccgtcatacatactttcccctcttattaacatcttacattaatgtggtacatttgttacaactgatgaaccaatattgatgcactgttattaactttccatcattcacatgggggctcactctgttgtacagttgtatgggttttgacaaatgtatgtcacatatccaccactgcagtatgctacagaatactttg

SEQ ID NO: 125221 - DNA, 1928 bp, Homo sapiens
tattagatggagacctcatactcccctcaaatgtttctcatcaagtacttctggcaacaggggaagagtagctgatgatcttttcttttaaatacaaatggcagaaaagtaaaactggctcacagaaatgttgtttgtgattttaactgcagtagcaatgattactttcatgtcaaataagcttttcagtggttgaagttaaatatatggatttcttaaaagtttagatagtgttaatttaccaaaaccaaattcacttaatccatagccaggcaattatttccccttagagtaatttagttccccttggagtaattccatttgggtatgtctgtcatgaatactgcttatctgtgattaggagcatcagaaatgtaggaaagaaagattgaagacactaggcagtggatttggggaaccctgagctaccaaatggcaaagcggacagatagaagctttcctatttggagttaagattctaggctttcctgattatggaaaaataatcatatatacaggtaaaataattatacatgaaaaaatggttaaaaattaatgaagatttcattaagaacttatgaagttgggctttccaccccccccccccccgcccaacccttgcagaaaaaggcaacacagacagggaagggagaggaaatgaagccttaggaatcctgggaactgctagagtgtcacaaaggttatgcatatctaattgattttgccctcagaagatattttgaacacaaggaaacatcaaccacattaaaaacctataagaggttttctgtggtgcatgaatacatgaaatccaatgaaatgtttaaaattccctgcattttgctcattgaaactcagactatttctcacttccagaattgatcaaaaagttcaaatcaacattagtttgtacttcttgattctgaaaaaaaaattctctttctaaaggatttatttatttttgagaaatgggttattaaatagctacagggaggtacatatctttaatagtagttttacctggatggttaatccgggagtagcatcttgaagtagcagttgatctactagtaatataagtatgagagcaatgtcactcttcagtgctacagggtaggttgcctcaaaaatccttatgacaagctgctttcttctggatatttaaaacagcaaatcaagattattcagcttatgaaaatacaggcaggtgtaaataaatgttatttctctggaggaaaaccttcttccactggagtaatagttccctaaactacacggaataatttctcacttaaggctgagccatggtgctgttaatagcactgcctcgcctggaatgtcttctgtttctgatctcttattgccagtagctgttttaacctatcagaaacagatcgggttatcattaaataggcttttaacttagttgttttaaatcttgaaatacactaagaaaaaaaagagaagagagtttttgcccaagtttaggcaacttaaaccaactggcttagggaaataaatgaagtagtctgctgttcagggaggatgcactatcatgattgaaggatgctgttcgacttcaccctacattagaaagttgttttattcacttcaaacatcattttaaacgttggctttggcatgggtgctttatttttaaacattttagtgtttaaacgataaaggaatcctgctcccatgggggttagaggtttcactgcagagacttgaaaggagaaaagctaattttttctcacgttcccacacttgtgacttttcatattttctatttactacagaaagcctctggttgttgaggttgaacattgggactccactcagggcctccctgagctcaagacaatgaggcgatgtgtctgtcttagccattcacagcacttgaatctatgtatggcagctaatgaaga

SEQ ID NO: 125222 - DNA, 1016 bp, Homo sapiens
ggagtaacttcagaaggtagtgtgacattatattgcttattttcatgtggaaatttttaacttttgctactttaacttttttttttttttgaagattgcatgaaatgcctaggaaggctccagagtgctttacattacaaactattgatttgtacaaagagagactgaaaactcaccatttagatgaaagataagtttcaaattgcagtaatgaaggactgagatagttaagccctattattgatttcattttgtgatatttttaaaaagaatgattcagtctgaagaaagttagcagtgtgtagagaaatttcatccagcagcttaagattgaagccttaatgactctgatgtatggaaacctggaatccagtggccagacgtgtggagcaggccatgccacttcaggacagtgtctgctgtttgaactgtggatactacaatgaaattccatatcagagagtttcattgagagggtgtgtagtttggtgtaggttacactggcagttttgtacatgcaaggcagaaaaataagacagctaaagaattctgtctgtgaacaagcaaagtttatagggtaagtggaccatggggtaatttttactggataatccttaattataaatgcttaaattctgaaagtattgcttttaaatctgcaattaagaatcaaggatcaaaagtttaaaagttgggaggataaaatatggtaagtagtacttcacaaaaaaatgttaaatacctttgggatagctgtagatgattttaacatgcaacaggttattggtctaatatttgtgatggtttaaaagtaaattactattcatggaacatacactctactcccttatactcccttaagccttactgtaaagacacacatgattctaagaaaccaaagctacacaagttctataagaataattaaagttttttcttctgaaaatgtgtgaaaacttttaattcctataagcctcagggaagcgagacaagggacacatctgatcagtcatgat

SEQ ID NO: 125223 - DNA, 1064 bp, Homo sapiens
tccatatcaactgcgcttcatgtatctttgtgaactctactgtgtctctgcaaaagttgacactgtaagactgtaaacacatatgaagtatcgaaacattttagaaatactgttattgaagatttttgggtggttgttctcttccaaagaaaaataatttcttgagaaattaatttattataattattaggatgggaggtttggattaacctttaagagggtatcagacttagcaaaatgaattctcaaaaaaatctctggctacagctgtctttaggactgaggggataaggaggcacccagctcgtggagcgagaggcacggcttgttttaacccacactgaccgcacaggggagctttaagccttttctgtacagcccagtcgcccctctcatattaatggcgctgcggcaaggacaacagtcacgttttagccaaatgtacgccccttttccgacaagaccaccaaatctagtcatctgaggtggcactaaaaatttgtgacagtttaaatttaagtagaagaacattgcaagattctcttgtatggcttgtgtggaacaggtcgtttttgcagctaaagaaaggattagatttgcaaataagccccaggctgcatttgctctattttattttattaagaaaatttaaaaaattattattttaaaaaagagatgggctctcgctatgttgaccaagctggtcttgagctcctggtctcaagaggtcttcctgcctcggcttctcaaagtgtttgggattacaggcgtgagccaccgcttctggtcagatcttataatatcactaaatataatttgtccccaagtttggaagagaaaggaggctatttcataggagtctttgagtttattaaaaaactgttatattattgaaaatttcaaatatatgtagaaaaaacagtacagtggacccgatgtatcattacttattcatacataccatacacaattacaaccaagaatgtctgggaagtattttgtcaactctaccctcttcaatgttattttgaactaaatctcagacatcacatcggaatactttg

SEQ ID NO: 125224 - DNA, 1142 bp, Homo sapiens
acaaaaagtacataatacagaagaaatgagaaagtgaattatggttatttgagtgccatgaacccattggtagacctttgtgaaaagaaagccaacaatcttactactataagataaaaccaggacacttaaggtaaaatactaatttgaatgaattgaaaaaggattatgtaaaagattttaaaaattcaatacagaaagcccccatattataagtatttgaacaataaatactattttcatgtttcatttgcaagtggcaagtgacaactgcattaccttactttcatgagatggtgacagaatattccatgccaattccatgacacaagttgtagttaaaaatacacttctatggctacattgcgctagatactttatcagttttcaataaagcaaaactagcaaagtcggtatgtattcaccacatttaaaaatttggaatttgagtcctggagcttaaatattaactcatgctaagtgtaggagctggtattaaaacttgatgtttctagccacagtctgatctctttctaccatgccaaatgtcgtatttgttgagaagagaatctcaatttacagccacagtgtttgttggggtggaatttggttattggcattcatgaacaccctgaaatgaatgcaaaattaagtgtatgggggtggttctctggggagagattgctttactaagtcagaatacattttctagtagaaaggctgtgatttgcttccagtttagtgtagagtggtatatgtctagtgttagaaatggaatttaagctttttgagcatctattaaggtcatgtagtacttgatactattaagtaccaagcattataatagtttggtgtgaaaagatgaatgtttgctctaaggaattcttaagtctaaagtggaagtaaacaactgaagtgcaattaaatgtactaaattctctaggatatgttgaaaatactatggggacagagtaaaggagtacttgttatggggccaggaagtcagagaggaagtgttgtttgagggtttggggtgtgaaatttcacaagatgtgtgagaaagggtactcaaaagtacatggaggaatgggattggaaaagtaccagaactgtgactatgaggacctgttcagggaccaggc

SEQ ID NO: 125225 - DNA, 1053 bp, Homo sapiens
agcaaagcaatgtcaaaattctacaaatcaaagaagggaaaattaaaggcatgttaatatttcagaggtaaggaaaactcatgtaggtttttattgtgtgctaacaaaattaggcctaaagaataaagggaggaaaaatcagctgaaccagatttgatccaggttctgttttccacctcctgcccccattaaatgcaaagcccagttccagttcaagctgcctacaacacttctccctttgttctgtttattctttccacgggccttaaaattaagttgttcctttttgtcccagttcttagagttctttgatgtagcaacccactgcattcctaaacattccaaaactcttgaaccatttccagcctgtggattttagcttaagtatcataatgtttctaatgttcagagcctctgccttttggttcattttgtatcttctaacccttaaaacattttaactccatttgttctacttcctcccagttctactgaaccatgaatttaaatttgcaaagcaattaatagcagtgaaacatggagatgcttaaaattcacatacacaggcaataaagaatactaatacagagccttataattatcaagtgctgataacactcaagcatccctgaaggaaaaaaaaaaaaacccaaccttgagataattaccttgcacagtctctcaggcatcaagtaggtgataagtgaacattgaagggttttcatctattgctcagttttcttcatagaatgaaactgccaactcttagtacttacctcacctttttttcaggagtctactcacccatgtaggcaagctctctgagccccccattgcaaagaagagcaagttgatgttcagcgaattgcccaagaacatataggagttgagagttcccttggattagaatcctgatttcctgaaaaccagtcctggtggttctgtatgaaagtcacattgcttcacacagttccttcaatttagagctcctccctccaccctgttctcaagaaacttatgaaactagcaatatctggctgccaattatctgat

SEQ ID NO: 125226 - DNA, 1046 bp, Homo sapiens
gattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaactatggcttaaggctcttgttaattcattaatgtaatctcagtataataaatagcttcactataatgaaagttataattaagtatctgcactcatatgaaggcagtgcttaggtttttttttttaaattttttttaaggcaacttaggataaaatcattaatttggtttacagaacataaggagagtttataagcataatcattcttaccaacgtgaaagtatagtgggcaattccatgatttaaatggagctcagaagattctaagatttagttaagggcaaaagaaccttattttggagatttttctcagggtccccagttctgttccctaccatcactataacacccatatcttgttttaggtggcaaaagcattaaggagatgaaagatggtaactttggcttcctgtttcaagatgtttatcttggccttgtctaataatctctcttatgggctcttgatatattttgactttggcacactagaaagcggacatagtagcaaaaaggtctttgaagtcaagtctcagctatctcacttactggctgagtgactatgtgaggtaattatctcagggttggttggttggtttgttttttgagacaatctctctgtcacccagggggagtgcagtggcgtgatcttggctcactgcaacctcatcctcccaggctcaggtgatcaatccttttacctcagcctcccgagtggctgggactacaggcgcgtaccaccatgtttggtttatttttgtatttttagtagagacggggtttcaccatgttgcccagactggtctccaactcctcagctcaagcggttcac

SEQ ID NO: 125227 - DNA, 1161 bp, Homo sapiens
aggaagtcaacttgtaatgttcttatcttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactagatggtgtatgatgacctcatgtagcctgaacatcctaagaaagttaaaatgtaagcattgctcctgtcagtggttatttgttcgttatattgcctcatgttaaaatacgtttttgtttattgttttaaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaatagaggaagattctttatgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaattctgtgttttggctttggttttgtttgccagtgccttttcttagacaagaatacttaacacagataactccatttaagtaacacatggaaataggttattatttgcatttttggtattgttttttaagatggtaggtgtggcagtaagaatggtttttgttcttatttttctc

SEQ ID NO: 125228 - DNA, 1049 bp, Homo sapiens
tatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggtaatgtatcttaccaagagtttctgcctccaggatttctgtgatatcatctttatgcctttaaaacttaaccccatttcagatatctcctcctcctggctacactggcactgtgggctcccaactgcctcctcacccccacactgtaaacacagatagtggagggcagaaggatgggtgggaatttgcaaacttttggtcaaagcttatcagcttattttactcactctaaggaaaaaatatgaattagttttcacctatgcttatgtcatgatattattttggctttattcatgtgatacttatattgctaaatgctgggatatcctaaaaatgctcaaatcagagaaactgattgtcttatttgcatagtttgtagtttttgttgtttctaaacaggaataaccatttattaaatatttagtatatgctaggaacttggaaactctgctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccac

SEQ ID NO: 125229 - DNA, 1250 bp, Homo sapiens
tggatgtaggtgtgcagactcttagtggacattgtaagggctgcaggggatccacagttcacactgaggaacccactggtggaagccctgggcctagctcatgtccctaatctcaaaaatagctggtagcctcatctttctggcccatgggatgaccagtgtttttataaggcagccaagaaagcaggaaaggggctagatgtggtggcatcatcttgagttttgtaccctgactcaggcctccatcttcctttttgtaaaataaggataatgataatacctactaaactgaattggcttgggaattaatgacataacatactttgaactttaaagtgttatttttcttattccattagcagaagaaaagagaagaggctgggggtgaagggtgggattgtgctcagcgcttttggatgttgactctggagttatggcagggccctggggcaatgaggctgattcttctattatgcccttccctcttcaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgtcttgcctctctgtttttactcttggatgagggaactagagtagcgtttctttgacgatgctccagggtttgcaggaaggctgacgccagttgtttgaagtttaattcatagctacagtttggtgagtacctgtgccaatcaatcactctgtcaagcactttgcctaaaagttctttgttttttctcaagatggaaagacccattcagtgttagtttttaagaatcaaaacaggctgggcacggtgactcacgcctgtaatcccagcactttgggaggccgagatgggcagatcacgaggttaggagattgagaccatcctggctaacaaggtga

SEQ ID NO: 125230 - DNA, 1128 bp, Homo sapiens
atttgaagatggatgcaaaactgactttttccatggcaggcagggactcaattgatcctccactgaacagaaattatttgcatgtctacagacaagaattattttgcattcctgtcagttatctgtaatttacagagctgtaaaatagctcagagtcaaggaaaggagtgaaaccgttgcagaatctgataaccctgaacagtgtgctctaaggaatgcagttttccactaaagcacaaatttttctctgtaaatatatacagacaaccctcgttattcatgaattccatattttcagattcttctactgactaaaatttatttgtaagccccaaatcaacactctgggcactctcaaggtcactctgagatgtgggtggagctgccaccccaggtgcatgtcccgagctgaggtcgacaaggctctgcctagtttcagctctcgtactgtaaaaggtgtcctttttatggtctagaatcttttttttttaatttgcattttcgtgctttttgttagtgattttgctgtttaaaatggccttgcaatgctgaagtgctatctagtgttcctaagcgggagaaggctgtgacgtgccttagggagaacatacatgtattagagaatctttcttcagtcatgagttgctcttggccctgaattcaatgttagtgaatctaccatatatattaaacaaggtgtctttaaacagaaacacaaaggaaactaggttatgtattgatttgttaacaaaaatacggtgcccagaggctgaaaggaatctaaccctgtatttcacctaggagcaatggttcagtattcactaagtcagtgttggcagtgactttatagaatataactattgtgaacaattgataaccaactgtgctttgtttagtacaggggttcttggatgtttgagatgcatctagagaacttacttaaaatacagatgcttgcctggcacggtggctcacgcctgtaatcccagcactttgggaggccgaggagggtggatcctgaggtcaggagttcaataccaacctggccaagatggtgaaaccccatctctactaaaaatacaaaaaaattagctgggcgtagtggcgggcgcctgcaatcccagctat

SEQ ID NO: 125231 - DNA, 1128 bp, Homo sapiens; identical to SEQ ID NO: 125230

SEQ ID NO: 125232 - DNA, 1007 bp, Homo sapiens
acagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaaca

SEQ ID NO: 125233 - DNA, 1091 bp, Homo sapiens
caccagctcttccctggcccctagctcagaaacacagggtgagcacttatgtcttcatttctttccacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgct

SEQ ID NO: 125234 - DNA, 1050 bp, Homo sapiens
cgtccatgcgcacgaaggcgaaggcgggcgccctggacaagaccacgctgtcttcccggaagctccccatgccccttgggggctgggaccaccatgtcctcacaatgccccgcatggcccacagcagaaatgtatggtagtggttctccgagtcaggcaacacgagtgggagtgcaaactggcagagggccattttcaacgctatttcttgttgcaggaaactgtctgaggagagcagcagggcacagagaaggtctaaggggttcactggcgtatcaggggtgggcagctcagaaaaggaataaatgtcggcagcaaggtcatcagctgggtcccagtagatgatctcctcttccatctggctctccttctccacaggcctggcgtctgggagcacgtccagcaccatagtggtattcctggcatcagcattgagggcctgcaacttcctgaggaaattccagggcaagtctttgggaacctgaggggcccagttcttcatactgtcaaaactgatctgcagagagtcctggaggctgagtttctggacctggtacgtctctaggcccaaaagtgacagcatttcttgaagcctgcttctctccactgtggaaagaaatgaagacataagtgctcaccctgtgtttctgagctaggggccagggaagagctggtgaaggagagcccagcaggatggggagagtgacgacccccttcagagagcagagtgcaggcacaggaggctcagggtgtgctcaaggctgacctgagatcaaggcagggctggaacccggacatcaaggtacaataggtaccaacctaaccacagatatatgtgacattaaacaaaagaaagaacagaaataaataagctacatttaacaactggaagagttcttgcaaaagccatatttctggtctttctagaaacctgtaagatctaacactgagctcaaaattaattggctacagtgagcagcacatgactcctacaagctgaatgcaggcctcacctccccactgtgttgcttccgtgggctactcagagtc
